United States Patent 11,446,398 (REGULATED BIOCIRCUIT SYSTEMS) - sequence listing, part 18

SEQ ID NO: 79571 - protein, 394 aa, Homo sapiens
  Payload ID: 15842
  Gene Symbol: SSH3
  Gene Name: slingshot protein phosphatase 3
  ENSP ID: ENSP00000310055
MALVTVSRSPPGSGASTPVGPWDQAVQRRSRLQRRQSFAVLRGAVLGLQDGGDNDDAAEASSEPTEKAPSEEELHGDQTDFGQGSQSPQKQEEQRQHLHLMVQLLRPQDDIRLAAQLEAPRPPRLRYLLVVSTREGEGLSQDETVLLGVDFPDSSSPSCTLGLVLPLWSDTQVYLDGDGGFSVTSGGQSRIFKPISIQTMWATLQVLHQACEAALGSGLVPGGSALTWASHYQERLNSEQSCLNEWTAMADLESLRPPSAEPGGSSEQEQMEQAIRAELWKVLDLESTSETSDMPEVFSSHESSHEEPLQPFPQLARTKGGQQVDRGPQPALKSRQSVVTLQGSAVVANRTQAFQEQEQGQGQGQGEPCISSTPRFRKVVRQASVHDSGEEGEA

SEQ ID NO: 79572 - protein, 659 aa, Homo sapiens
  Payload ID: 15842
  Gene Symbol: SSH3
  Gene Name: slingshot protein phosphatase 3
  Uniprot ID: Q8TE77
  ENSP ID: ENSP00000312081
MALVTVSRSPPGSGASTPVGPWDQAVQRRSRLQRRQSFAVLRGAVLGLQDGGDNDDAAEASSEPTEKAPSEEELHGDQTDFGQGSQSPQKQEEQRQHLHLMVQLLRPQDDIRLAAQLEAPRPPRLRYLLVVSTREGEGLSQDETVLLGVDFPDSSSPSCTLGLVLPLWSDTQVYLDGDGGFSVTSGGQSRIFKPISIQTMWATLQVLHQACEAALGSGLVPGGSALTWASHYQERLNSEQSCLNEWTAMADLESLRPPSAEPGGSSEQEQMEQAIRAELWKVLDVSDLESVTSKEIRQALELRLGLPLQQYRDFIDNQMLLLVAQRDRASRIFPHLYLGSEWNAANLEELQRNRVTHILNMAREIDNFYPERFTYHNVRLWDEESAQLLPHWKETHRFIEAARAQGTHVLVHCKMGVSRSAATVLAYAMKQYECSLEQALRHVQELRPIARPNPGFLRQLQIYQGILTASRQSHVWEQKVGGVSPEEHPAPEVSTPFPPLPPEPEGGGEEKVVGMEESQAAPKEEPGPRPRINLRGVMRSISLLEPSLELESTSETSDMPEVFSSHESSHEEPLQPFPQLARTKGGQQVDRGPQPALKSRQSVVTLQGSAVVANRTQAFQEQEQGQGQGQGEPCISSTPRFRKVVRQASVHDSGEEGEA

SEQ ID NO: 79573 - protein, 513 aa, Homo sapiens
  Payload ID: 15842
  Gene Symbol: SSH3
  Gene Name: slingshot protein phosphatase 3
  Uniprot ID: Q8TE77
  ENSP ID: ENSP00000365948
MAFPLSPASSPSCTLGLVLPLWSDTQVYLDGDGGFSVTSGGQSRIFKPISIQTMWATLQVLHQACEAALGSGLVPGGSALTWASHYQERLNSEQSCLNEWTAMADLESLRPPSAEPGGSSEQEQMEQAIRAELWKVLDVSDLESVTSKEIRQALELRLGLPLQQYRDFIDNQMLLLVAQRDRASRIFPHLYLGSEWNAANLEELQRNRVTHILNMAREIDNFYPERFTYHNVRLWDEESAQLLPHWKETHRFIEAARAQGTHVLVHCKMGVSRSAATVLAYAMKQYECSLEQALRHVQELRPIARPNPGFLRQLQIYQGILTASRQSHVWEQKVGGVSPEEHPAPEVSTPFPPLPPEPEGGGEEKVVGMEESQAAPKEEPGPRPRINLRGVMRSISLLEPSLELESTSETSDMPEVFSSHESSHEEPLQPFPQLARTKGGQQVDRGPQPALKSRQSVVTLQGSAVVANRTQAFQEQEQGQGQGQGEPCISSTPRFRKVVRQASVHDSGEEGEA

SEQ ID NO: 79574 - protein, 471 aa, Homo sapiens
  Payload ID: 15842
  Gene Symbol: SSH3
  Gene Name: slingshot protein phosphatase 3
  Uniprot ID: Q8TE77
  ENSP ID: ENSP00000431788
MALVTVSRSPPGSGASTPVGPWDQAVQRRSRLQRRQSFAVLRGAVLGLQDGGDNDDAAEASSEPTEKAPSEEELHGDQTDFGQGSQSPQKQEEQRQHLHLMVQLLRPQDDIRLAAQLEAPRPPRLRYLLVVSTREGEGLSQDETVLLGVDFPDSSSPSCTLGLVLPLWSDTQVYLDGDGGFSVTSGGQSRIFKPISIQTMWATLQVLHQACEAALGSGLVPGGSALTWASHYQERLNSEQSCLNEWTAMADLESLRPPSAEPGGSSEQEQMEQAIRAELWKVLDVSDLESVTSKEIRQALELRLGLPLQQYRDFIDNQMLLLVAQRDRASRIFPHLYLGSEWNAANLEELQRNRVTHILNMAREIDNFYPERFTYHNVRLWDEESAQLLPHWKETHRFIEAARAQGTHVLVHCKMGVSRSAATVLAYAMKQYECSLEQALRHVQELRPIARPNPGFLRQLQIYQGILTART

SEQ ID NO: 79575 - protein, 41 aa, Homo sapiens
  Payload ID: 15842
  Gene Symbol: SSH3
  Gene Name: slingshot protein phosphatase 3
  ENSP ID: ENSP00000432974
MALVTVSRSPPGSGASTPVGPWAELCGAPWGCPGTAGWRGQ

SEQ ID NO: 79576 - protein, 219 aa, Homo sapiens
  Payload ID: 15842
  Gene Symbol: SSH3
  Gene Name: slingshot protein phosphatase 3
  ENSP ID: ENSP00000433902
  MOD_RES (1)..(1): Any amino acid
XSEQSCLNEWTAMADLESLRPPSAEPGGSSEQEQMEQAIRAELWKVLDVSDLESVTSKEIRQALELRLGLPLQQYRDFIDNQMLLLVAQRDRASRIFPHLYLGSEWNAANLEELQRNRAQGTHVLVHCKMGVSRSAATVLAYAMKQYECSLEQALRHVQELRPIARPNPGFLRQLQIYQGILTASRQSHVWEQKVGGVSPEEHPAPEVSTPFPPLPPEP

SEQ ID NO: 79577 - protein, 316 aa, Homo sapiens
  Payload ID: 15842
  Gene Symbol: SSH3
  Gene Name: slingshot protein phosphatase 3
  ENSP ID: ENSP00000480198
  MOD_RES (1)..(1): Any amino acid
XAVQRRSRLQRRQSFAVLRGAVLGLQDGGDNDDAAEASSEPTEKAPSEEELHGDQTDFGQGSQSPQKQEEQRQHLHLMVQLLRPQDDIRLAAQLEAPRPPRLRYLLVVSTREGEGLSQDETVLLGVDFPDSSSPSCTLGLVLPLWSDTQVYLDGDGGFSVTSGGQSRIFKPISIQTMWSSEQEQMEQAIRAELWKVLDVSDLESVTSKEIRQALELRLGLPLQQYRDFIDNQMLLLVAQRDRASRIFPHLYLGSEWNAANLEELQRNRVTHILNMAREIDNFYPERFTYHNVRLWDEESAQLLPHWKETHRFIEAA

SEQ ID NO: 79578 - protein, 696 aa, Homo sapiens
  Payload ID: 15843
  Gene Symbol: SLITRK1
  Gene Name: SLIT and NTRK-like family, member 1
  Uniprot ID: Q96PX8
  ENSP ID: ENSP00000366288
MLLWILLLETSLCFAAGNVTGDVCKEKICSCNEIEGDLHVDCEKKGFTSLQRFTAPTSQFYHLFLHGNSLTRLFPNEFANFYNAVSLHMENNGLHEIVPGAFLGLQLVKRLHINNNKIKSFRKQTFLGLDDLEYLQADFNLLRDIDPGAFQDLNKLEVLILNDNLISTLPANVFQYVPITHLDLRGNRLKTLPYEEVLEQIPGIAEILLEDNPWDCTCDLLSLKEWLENIPKNALIGRVVCEAPTRLQGKDLNETTEQDLCPLKNRVDSSLPAPPAQEETFAPGPLPTPFKTNGQEDHATPGSAPNGGTKIPGNWQIKIRPTAAIATGSSRNKPLANSLPCPGGCSCDHIPGSGLKMNCNNRNVSSLADLKPKLSNVQELFLRDNKIHSIRKSHFVDYKNLILLDLGNNNIATVENNTFKNLLDLRWLYMDSNYLDTLSREKFAGLQNLEYLNVEYNAIQLILPGTFNAMPKLRILILNNNLLRSLPVDVFAGVSLSKLSLHNNYFMYLPVAGVLDQLTSIIQIDLHGNPWECSCTIVPFKQWAERLGSEVLMSDLKCETPVNFFRKDFMLLSNDEICPQLYARISPTLTSHSKNSTGLAETGTHSNSYLDTSRVSISVLVPGLLLVFVTSAFTVVGMLVFILRNRKRSKRRDANSSASEINSLQTVCDSSYWHNGPYNADGAHRVYDCGSHSLSD

SEQ ID NO: 79579 - protein, 724 aa, Homo sapiens
  Payload ID: 15844
  Gene Symbol: SLITRK2
  Gene Name: SLIT and NTRK-like family, member 2
  ENSP ID: ENSP00000334374
MLSGVWFLSVLTVAGILQTESRKTAKDICKIRCLCEEKENVLNINCENKGFTTVSLLQPPQYRIYQLFLNGNLLTRLYPNEFVNYSNAVTLHLGNNGLQEIRTGAFSGLKTLKRLHLNNNKLEILREDTFLGLESLEYLQADYNYISAIEAGAFSKLNKLKVLILNDNLLLSLPSNVFRFVLLTHLDLRGNRLKVMPFAGVLEHIGGIMEIQLEENPWNCTCDLLPLKAWLDTITVFVGEIVCETPFRLHGKDVTQLTRQDLCPRKSASDSSQRGSHADTHVQRLSPTMNPALNPTRAPKASRPPKMRNRPTPRVTVSKDRQSFGPIMVYQTKSPVPLTCPSSCVCTSQSSDNGLNVNCQERKFTNISDLQPKPTSPKKLYLTGNYLQTVYKNDLLEYSSLDLLHLGNNRIAVIQEGAFTNLTSLRRLYLNGNYLEVLYPSMFDGLQSLQYLYLEYNVIKEIKPLTFDALINLQLLFLNNNLLRSLPDNIFGGTALTRLNLRNNHFSHLPVKGVLDQLPAFIQIDLQENPWDCTCDIMGLKDWTEHANSPVIINEVTCESPAKHAGEILKFLGREAICPDSPNLSDGTVLSMNHNTDTPRSLSVSPSSYPELHTEVPLSVLILGLLVVFILSVCFGAGLFVFVLKRRKGVPSVPRNTNNLDVSSFQLQYGSYNTETHDKTDGHVYNYIPPPVGQMCQNPIYMQKEGDPVAYYRNLQEFSYSNLE

SEQ ID NO: 79580 - protein, 845 aa, Homo sapiens
  Payload ID: 15844
  Gene Symbol: SLITRK2
  Gene Name: SLIT and NTRK-like family, member 2
  Uniprot ID: Q9H156
  ENSP ID: ENSP00000359521
MLSGVWFLSVLTVAGILQTESRKTAKDICKIRCLCEEKENVLNINCENKGFTTVSLLQPPQYRIYQLFLNGNLLTRLYPNEFVNYSNAVTLHLGNNGLQEIRTGAFSGLKTLKRLHLNNNKLEILREDTFLGLESLEYLQADYNYISAIEAGAFSKLNKLKVLILNDNLLLSLPSNVFRFVLLTHLDLRGNRLKVMPFAGVLEHIGGIMEIQLEENPWNCTCDLLPLKAWLDTITVFVGEIVCETPFRLHGKDVTQLTRQDLCPRKSASDSSQRGSHADTHVQRLSPTMNPALNPTRAPKASRPPKMRNRPTPRVTVSKDRQSFGPIMVYQTKSPVPLTCPSSCVCTSQSSDNGLNVNCQERKFTNISDLQPKPTSPKKLYLTGNYLQTVYKNDLLEYSSLDLLHLGNNRIAVIQEGAFTNLTSLRRLYLNGNYLEVLYPSMFDGLQSLQYLYLEYNVIKEIKPLTFDALINLQLLFLNNNLLRSLPDNIFGGTALTRLNLRNNHFSHLPVKGVLDQLPAFIQIDLQENPWDCTCDIMGLKDWTEHANSPVIINEVTCESPAKHAGEILKFLGREAICPDSPNLSDGTVLSMNHNTDTPRSLSVSPSSYPELHTEVPLSVLILGLLVVFILSVCFGAGLFVFVLKRRKGVPSVPRNTNNLDVSSFQLQYGSYNTETHDKTDGHVYNYIPPPVGQMCQNPIYMQKEGDPVAYYRNLQEFSYSNLEEKKEEPATPAYTISATELLEKQATPREPELLYQNIAERVKELPSAGLVHYNFCTLPKRQFAPSYESRRQNQDRINKTVLYGTPRKCFVGQSKPNHPLLQAKPQSEPDYLEVLEKQTAISQL

SEQ ID NO: 79581 - protein, 977 aa, Homo sapiens
  Payload ID: 15845
  Gene Symbol: SLITRK3
  Gene Name: SLIT and NTRK-like family, member 3
  Uniprot ID: O94933
  ENSP ID: ENSP00000241274
MKPSIAEMLHRGRMLWIILLSTIALGWTTPIPLIEDSEEIDEPCFDPCYCEVKESLFHIHCDSKGFTNISQITEFWSRPFKLYLQRNSMRKLYTNSFLHLNNAVSINLGNNALQDIQTGAFNGLKILKRLYLHENKLDVFRNDTFLGLESLEYLQADYNVIKRIESGAFRNLSKLRVLILNDNLIPMLPTNLFKAVSLTHLDLRGNRLKVLFYRGMLDHIGRSLMELQLEENPWNCTCEIVQLKSWLERIPYTALVGDITCETPFHFHGKDLREIRKTELCPLLSDSEVEASLGIPHSSSSKENAWPTKPSSMLSSVHFTASSVEYKSSNKQPKPTKQPRTPRPPSTSQALYPGPNQPPIAPYQTRPPIPIICPTGCTCNLHINDLGLTVNCKERGFNNISELLPRPLNAKKLYLSSNLIQKIYRSDFWNFSSLDLLHLGNNRISYVQDGAFINLPNLKSLFLNGNDIEKLTPGMFRGLQSLHYLYFEFNVIREIQPAAFSLMPNLKLLFLNNNLLRTLPTDAFAGTSLARLNLRKNYFLYLPVAGVLEHLNAIVQIDLNENPWDCTCDLVPFKQWIETISSVSVVGDVLCRSPENLTHRDVRTIELEVLCPEMLHVAPAGESPAQPGDSHLIGAPTSASPYEFSPPGGPVPLSVLILSLLVLFFSAVFVAAGLFAYVLRRRRKKLPFRSKRQEGVDLTGIQMQCHRLFEDGGGGGGGSGGGGRPTLSSPEKAPPVGHVYEYIPHPVTQMCNNPIYKPREEEEVAVSSAQEAGSAERGGPGTQPPGMGEALLGSEQFAETPKENHSNYRTLLEKEKEWALAVSSSQLNTIVTVNHHHPHHPAVGGVSGVVGGTGGDLAGFRHHEKNGGVVLFPPGGGCGSGSMLLDRERPQPAPCTVGFVDCLYGTVPKLKELHVHPPGMQYPDLQQDARLKETLLFSAGKGFTDHQTQKSDYLELRAKLQTKPDYLEVLEKTTYRF

SEQ ID NO: 79582 - protein, 162 aa, Homo sapiens
  Payload ID: 15845
  Gene Symbol: SLITRK3
  Gene Name: SLIT and NTRK-like family, member 3
  ENSP ID: ENSP00000419611
MKPSIAEMLHRGRMLWIILLSTIALGWTTPIPLIEDSEEIDEPCFDPCYCEVKESLFHIHCDSKGFTNISQITEFWSRPFKLYLQRNSMRKLYTNSFLHLNNAVSINLGNNALQDIQTGAFNGLKILKRLYLHENKLDVFRNDTFLGLESLEYLQADYNVIK

SEQ ID NO: 79583 - protein, 977 aa, Homo sapiens; identical to SEQ ID NO: 79581
  Payload ID: 15845
  Gene Symbol: SLITRK3
  Gene Name: SLIT and NTRK-like family, member 3
  Uniprot ID: O94933
  ENSP ID: ENSP00000420091

SEQ ID NO: 79584 - protein, 837 aa, Homo sapiens
  Payload ID: 15846
  Gene Symbol: SLITRK4
  Gene Name: SLIT and NTRK-like family, member 4
  Uniprot ID: Q8IW52
  ENSP ID: ENSP00000336627
MFLWLFLILSALISSTNADSDISVEICNVCSCVSVENVLYVNCEKVSVYRPNQLKPPWSNFYHLNFQNNFLNILYPNTFLNFSHAVSLHLGNNKLQNIEGGAFLGLSALKQLHLNNNELKILRADTFLGIENLEYLQADYNLIKYIERGAFNKLHKLKVLILNDNLISFLPDNIFRFASLTHLDIRGNRIQKLPYIGVLEHIGRVVELQLEDNPWNCSCDLLPLKAWLENMPYNIYIGEAICETPSDLYGRLLKETNKQELCPMGTGSDFDVRILPPSQLENGYTTPNGHTTQTSLHRLVTKPPKTTNPSKISGIVAGKALSNRNLSQIVSYQTRVPPLTPCPAPCFCKTHPSDLGLSVNCQEKNIQSMSELIPKPLNAKKLHVNGNSIKDVDVSDFTDFEGLDLLHLGSNQITVIKGDVFHNLTNLRRLYLNGNQIERLYPEIFSGLHNLQYLYLEYNLIKEISAGTFDSMPNLQLLYLNNNLLKSLPVYIFSGAPLARLNLRNNKFMYLPVSGVLDQLQSLTQIDLEGNPWDCTCDLVALKLWVEKLSDGIVVKELKCETPVQFANIELKSLKNEILCPKLLNKPSAPFTSPAPAITFTTPLGPIRSPPGGPVPLSILILSILVVLILTVFVAFCLLVFVLRRNKKPTVKHEGLGNPDCGSMQLQLRKHDHKTNKKDGLSTEAFIPQTIEQMSKSHTCGLKESETGFMFSDPPGQKVVMRNVADKEKDLLHVDTRKRLSTIDELDELFPSRDSNVFIQNFLESKKEYNSIGVSGFEIRYPEKQPDKKSKKSLIGGNHSKIVVEQRKSEYFELKAKLQSSPDYLQVLEEQTALNKI

SEQ ID NO: 79585 - protein, 837 aa, Homo sapiens; identical to SEQ ID NO: 79584
  Payload ID: 15846
  Gene Symbol: SLITRK4
  Gene Name: SLIT and NTRK-like family, member 4
  Uniprot ID: Q8IW52
  ENSP ID: ENSP00000349400

SEQ ID NO: 79586 - protein, 837 aa, Homo sapiens; identical to SEQ ID NO: 79584
  Payload ID: 15846
  Gene Symbol: SLITRK4
  Gene Name: SLIT and NTRK-like family, member 4
  Uniprot ID: Q8IW52
  ENSP ID: ENSP00000469205

SEQ ID NO: 79587 - protein, 958 aa, Homo sapiens
  Payload ID: 15847
  Gene Symbol: SLITRK5
  Gene Name: SLIT and NTRK-like family, member 5
  Uniprot ID: O94991
  ENSP ID: ENSP00000366283
MHTCCPPVTLEQDLHRKMHSWMLQTLAFAVTSLVLSCAETIDYYGEICDNACPCEEKDGILTVSCENRGIISLSEISPPRFPIYHLLLSGNLLNRLYPNEFVNYTGASILHLGSNVIQDIETGAFHGLRGLRRLHLNNNKLELLRDDTFLGLENLEYLQVDYNYISVIEPNAFGKLHLLQVLILNDNLLSSLPNNLFRFVPLTHLDLRGNRLKLLPYVGLLQHMDKVVELQLEENPWNCSCELISLKDWLDSISYSALVGDVVCETPFRLHGRDLDEVSKQELCPRRLISDYEMRPQTPLSTTGYLHTTPASVNSVATSSSAVYKPPLKPPKGTRQPNKPRVRPTSRQPSKDLGYSNYGPSIAYQTKSPVPLECPTACSCNLQISDLGLNVNCQERKIESIAELQPKPYNPKKMYLTENYIAVVRRTDFLEATGLDLLHLGNNRISMIQDRAFGDLTNLRRLYLNGNRIERLSPELFYGLQSLQYLFLQYNLIREIQSGTFDPVPNLQLLFLNNNLLQAMPSGVFSGLTLLRLNLRSNHFTSLPVSGVLDQLKSLIQIDLHDNPWDCTCDIVGMKLWVEQLKVGVLVDEVICKAPKKFAETDMRSIKSELLCPDYSDVVVSTPTPSSIQVPARTSAVTPAVRLNSTGAPASLGAGGGASSVPLSVLILSLLLVFIMSVFVAAGLFVLVMKRRKKNQSDHTSTNNSDVSSFNMQYSVYGGGGGTGGHPHAHVHHRGPALPKVKTPAGHVYEYIPHPLGHMCKNPIYRSREGNSVEDYKDLHELKVTYSSNHHLQQQQQPPPPPQQPQQQPPPQLQLQPGEEERRESHHLRSPAYSVSTIEPREDLLSPVQDADRFYRGILEPDKHCSTTPAGNSLPEYPKFPCSPAAYTFSPNYDLRRPHQYLHPGAGDSRLREPVLYSPPSAVFVEPNRNEYLELKAKLNVEPDYLEVLEKQTTFSQF

SEQ ID NO: 79588 - protein, 841 aa, Homo sapiens
  Payload ID: 15848
  Gene Symbol: SLITRK6
  Gene Name: SLIT and NTRK-like family, member 6
  Uniprot ID: Q9H5Y7
  ENSP ID: ENSP00000383143
MKLWIHLFYSSLLACISLHSQTPVLSSRGSCDSLCNCEEKDGTMLINCEAKGIKMVSEISVPPSRPFQLSLLNNGLTMLHTNDFSGLTNAISIHLGFNNIADIEIGAFNGLGLLKQLHINHNSLEILKEDTFHGLENLEFLQADNNFITVIEPSAFSKLNRLKVLILNDNAIESLPPNIFRFVPLTHLDLRGNQLQTLPYVGFLEHIGRILDLQLEDNKWACNCDLLQLKTWLENMPPQSIIGDVVCNSPPFFKGSILSRLKKESICPTPPVYEEHEDPSGSLHLAATSSINDSRMSTKTTSILKLPTKAPGLIPYITKPSTQLPGPYCPIPCNCKVLSPSGLLIHCQERNIESLSDLRPPPQNPRKLILAGNIIHSLMKSDLVEYFTLEMLHLGNNRIEVLEEGSFMNLTRLQKLYLNGNHLTKLSKGMFLGLHNLEYLYLEYNAIKEILPGTFNPMPKLKVLYLNNNLLQVLPPHIFSGVPLTKVNLKTNQFTHLPVSNILDDLDLLTQIDLEDNPWDCSCDLVGLQQWIQKLSKNTVTDDILCTSPGHLDKKELKALNSEILCPGLVNNPSMPTQTSYLMVTTPATTTNTADTILRSLTDAVPLSVLILGLLIMFITIVFCAAGIVVLVLHRRRRYKKKQVDEQMRDNSPVHLQYSMYGHKTTHHTTERPSASLYEQHMVSPMVHVYRSPSFGPKHLEEEEERNEKEGSDAKHLQRSLLEQENHSPLTGSNMKYKTTNQSTEFLSFQDASSLYRNILEKERELQQLGITEYLRKNIAQLQPDMEAHYPGAHEELKLMETLMYSRPRKVLVEQTKNEYFELKANLHAEPDYLEVLEQQT

SEQ ID NO: 79589 - protein, 1534 aa, Homo sapiens
  Payload ID: 15849
  Gene Symbol: SLIT1
  Gene Name: slit guidance ligand 1
  Uniprot ID: O75093
  ENSP ID: ENSP00000266058
MALTPGWGSSAGPVRPELWLLLWAAAWRLGASACPALCTCTGTTVDCHGTGLQAIPKNIPRNTERLELNGNNITRIHKNDFAGLKQLRVLQLMENQIGAVERGAFDDMKELERLRLNRNQLHMLPELLFQNNQALSRLDLSENAIQAIPRKAFRGATDLKNLQLDKNQISCIEEGAFRALRGLEVLTLNNNNITTIPVSSFNHMPKLRTFRLHSNHLFCDCHLAWLSQWLRQRPTIGLFTQCSGPASLRGLNVAEVQKSEFSCSGQGEAGRVPTCTLSSGSCPAMCTCSNGIVDCRGKGLTAIPANLPETMTEIRLELNGIKSIPPGAFSPYRKLRRIDLSNNQIAEIAPDAFQGLRSLNSLVLYGNKITDLPRGVFGGLYTLQLLLLNANKINCIRPDAFQDLQNLSLLSLYDNKIQSLAKGTFTSLRAIQTLHLAQNPFICDCNLKWLADFLRTNPIETSGARCASPRRLANKRIGQIKSKKFRCSAKEQYFIPGTEDYQLNSECNSDVVCPHKCRCEANVVECSSLKLTKIPERIPQSTAELRLNNNEISILEATGMFKKLTHLKKINLSNNKVSEIEDGAFEGAASVSELHLTANQLESIRSGMFRGLDGLRTLMLRNNRISCIHNDSFTGLRNVRLLSLYDNQITTVSPGAFDTLQSLSTLNLLANPFNCNCQLAWLGGWLRKRKIVTGNPRCQNPDFLRQIPLQDVAFPDFRCEEGQEEGGCLPRPQCPQECACLDTVVRCSNKHLRALPKGIPKNVTELYLDGNQFTLVPGQLSTFKYLQLVDLSNNKISSLSNSSFTNMSQLTTLILSYNALQCIPPLAFQGLRSLRLLSLHGNDISTLQEGIFADVTSLSHLAIGANPLYCDCHLRWLSSWVKTGYKEPGIARCAGPQDMEGKLLLTTPAKKFECQGPPTLAVQAKCDLCLSSPCQNQGTCHNDPLEVYRCACPSGYKGRDCEVSLDSCSSGPCENGGTCHAQEGEDAPFTCSCPTGFEGPTCGVNTDDCVDHACANGGVCVDGVGNYTCQCPLQYEGKACEQLVDLCSPDLNPCQHEAQCVGTPDGPRCECMPGYAGDNCSENQDDCRDHRCQNGAQCMDEVNSYSCLCAEGYSGQLCEIPPHLPAPKSPCEGTECQNGANCVDQGNRPVCQCLPGFGGPECEKLLSVNFVDRDTYLQFTDLQNWPRANITLQVSTAEDNGILLYNGDNDHIAVELYQGHVRVSYDPGSYPSSAIYSAETINDGQFHTVELVAFDQMVNLSIDGGSPMTMDNFGKHYTLNSEAPLYVGGMPVDVNSAAFRLWQILNGTGFHGCIRNLYINNELQDFTKTQMKPGVVPGCEPCRKLYCLHGICQPNATPGPMCHCEAGWVGLHCDQPADGPCHGHKCVHGQCVPLDALSYSCQCQDGYSGALCNQAGALAEPCRGLQCLHGHCQASGTKGAHCVCDPGFSGELCEQESECRGDPVRDFHQVQRGYAICQTTRPLSWVECRGSCPGQGCCQGLRLKRRKFTFECSDGTSFAEEVEKPTKCGCALCA

SEQ ID NO: 79590 - protein, 781 aa, Homo sapiens
  Payload ID: 15849
  Gene Symbol: SLIT1
  Gene Name: slit guidance ligand 1
  ENSP ID: ENSP00000315005
LWLLLWAAAWRLGASACPALCTCTGTTVDCHGTGLQAIPKNIPRNTERLELNGNNITRIHKNDFAGLKQLRVLQLMENQIGAVERGAFDDMKELERLRLNRNQLHMLPELLFQNNQALSRLDLSENAIQAIPRKAFRGATDLKNLQLDKNQISCIEEGAFRALRGLEVLTLNNNNITTIPVSSFNHMPKLRTFRLHSNHLFCDCHLAWLSQWLRQRPTIGLFTQCSGPASLRGLNVAEVQKSEFSCSGQGEAGRVPTCTLSSGSCPAMCTCSNGIVDCRGKGLTAIPANLPETMTEIRLELNGIKSIPPGAFSPYRKLRRICPLSFCSPCRDLSNNQIAEIAPDAFQGLRSLNSLVLYGNKITDLPRGVFGGLYTLQLLLLNANKINCIRPDAFQDLQNLSLLSLYDNKIQSLAKGTFTSLRAIQTLHLAQNPFICDCNLKWLADFLRTNPIETSGARCASPRRLANKRIGQIKSKKFRCSAKEQYFIPGTEDYQLNSECNSDVVCPHKCRCEANVVECSSLKLTKIPERIPQSTAELRLNNNEISILEATGMFKKLTHLKKINLSNNKVSEIEDGAFEGAASVSELHLTANQLESIRSGMFRGLDGLRTLMLRNNRISCIHNDSFTGLRNVRLLSLYDNQITTVSPGAFDTLQSLSTLNLLANPFNCNCQLAWLGGWLRKRKIVTGNPRCQNPDFLRQIPLQDVAFPDFRCEEGQEEGGCLPRPQCPQECACLDTVVRCSNKHLRALPKGIPKNVTELYLDGNQFTLVPGQLSTFKYLQL

SEQ ID NO: 79591 - protein, 409 aa, Homo sapiens
  Payload ID: 15849
  Gene Symbol: SLIT1
  Gene Name: slit guidance ligand 1
  ENSP ID: ENSP00000360080
MALTPGWGSSAGPVRPELWLLLWAAAWRLGASACPALCTCTGTTVDCHGTGLQAIPKNIPRNTERLELNGNNITRIHKNDFAGLKQLRVLQLMENQIGAVERGAFDDMKELERLRLNRNQLHMLPELLFQNNQALSRLDLSENAIQAIPRKAFRGATDLKNLQLDKNQISCIEEGAFRALRGLEVLTLNNNNITTIPVSSFNHMPKLRTFRLHSNHLFCDCHLAWLSQWLRQRPTIGLFTQCSGPASLRGLNVAEVQKSEFSCSGQGEAGRVPTCTLSSGSCPAMCTCSNGIVDCRGKGLTAIPANLPETMTEIRLELNGIKSIPPGAFSPYRKLRRIDLSNNQIAEIAPDAFQGLRSLNSLHTGPVTCPHTTGTHSSHCRAFAVAVPHSRNDLEAMFEEEVPRIFYSA

SEQ ID NO: 79592 - protein, 1461 aa, Homo sapiens
  Payload ID: 15849
  Gene Symbol: SLIT1
  Gene Name: slit guidance ligand 1
  ENSP ID: ENSP00000360109
MALTPGWGSSAGPVRPELWLLLWAAAWRLGASACPALCTCTGTTVDCHGTGLQAIPKNIPRNTERLELNGNNITRIHKNDFAGLKQLRVLQLMENQIGAVERGAFDDMKELERLRLNRNQLHMLPELLFQNNQALSRLDLSENAIQAIPRKAFRGATDLKNLQLDKNQISCIEEGAFRALRGLEVLTLNNNNITTIPVSSFNHMPKLRTFRLHSNHLFCDCHLAWLSQWLRQRPTIGLFTQCSGPASLRGLNVAEVQKSEFSCSGQGEAGRVPTCTLSSGSCPAMCTCSNGIVDCRGKGLTAIPANLPETMTEIRLELNGIKSIPPGAFSPYRKLRRIDLSNNQIAEIAPDAFQGLRSLNSLVLYGNKITDLPRGVFGGLYTLQLLLLNANKINCIRPDAFQDLQNLSLLSLYDNKIQSLAKGTFTSLRAIQTLHLAQNPFICDCNLKWLADFLRTNPIETSGARCASPRRLANKRIGQIKSKKFRCSAKEQYFIPGTEDYQLNSECNSDVVCPHKCRCEANVVECSSLKLTKIPERIPQSTAELRLNNNEISILEATGMFKKLTHLKKINLSNNKVSEIEDGAFEGAASVSELHLTANQLESIRSGMFRGLDGLRTLMLRNNRISCIHNDSFTGLRNVRLLSLYDNQITTVSPGAFDTLQSLSTLNLLANPFNCNCQLAWLGGWLRKRKIVTGNPRCQNPDFLRQIPLQDVAFPDFRCEEGQEEGGCLPRPQCPQECACLDTVVRCSNKHLRALPKGIPKNVTELYLDGNQFTLVPGQLSTFKYLQLVDLSNNKISSLSNSSFTNMSQLTTLILSYNALQCIPPLAFQGLRSLRLLSLHGNDISTLQEGIFADVTSLSHLAIGANPLYCDCHLRWLSSWVKTGYKEPGIARCAGPQDMEGKLLLTTPAKKFECQGPPTLAVQAKCDLCLSSPCQNQGTCHNDPLEVYRCACPSGYKGRDCEVSLDSCSSGPCENGGTCHAQEGEDAPFTCSCPTGFEGPTCGVNTDDCVDHACANGGVCVDGVGNYTCQCPLQYEGKACEQLVDLCSPDLNPCQHEAQCVGTPDGPRCECMPGYAGDNCSENQDDCRDHRCQNGAQCMDEVNSYSCLCAEGYSGQLCEIPPHLPAPKSPCEGTECQNGANCVDQGNRPVCQCLPGFGGPECEKLLSVNFVDRDTYLQFTDLQNWPRANITLQVSTAEDNGILLYNGDNDHIAVELYQGHVRVSYDPGSYPSSAIYSAETINDGQFHTVELVAFDQMVNLSIDGGSPMTMDNFGKHYTLNSEAPLYVGGMPVDVNSAAFRLWQILNGTGFHGCIRNLYINNELQDFTKTQMKPGVVPGCEPCRKLYCLHGICQPNATPGPMCHCEAGWVGLHCDQPADGPCHGHKCVHGQCVPLDALSYSCQCQDGYSGALCNQSPSAGGTLSGTFTRSRGAMPSARPRAPCHGWSAGARAQARAAARAFG

SEQ ID NO: 79593 - protein, 1542 aa, Homo sapiens
  Payload ID: 15850
  Gene Symbol: SLIT2
  Gene Name: slit guidance ligand 2
  ENSP ID: ENSP00000273739
MRGVGWQMLSLSLGLVLAILNKVAPQACPAQCSCSGSTVDCHGLALRSVPRNIPRNTERLDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSDEEEGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSAKEQYFIPGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTAANLNEVEKGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 79594 - protein, 212 aa, Homo sapiens
  Payload ID: 15850
  Gene Symbol: SLIT2
  Gene Name: slit guidance ligand 2
  ENSP ID: ENSP00000421975
MTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGLPGPCGFLIPGPVDVNILAKCNPCLSNPCKNDGTCNSDPVDFYRCTCPYGFKGQDCDVPIHACISNPCKHGGTCHLKEGEEDGFWCICADGFEGENCEVNVD

SEQ ID NO: 79595 - protein, 1525 aa, Homo sapiens
  Payload ID: 15850
  Gene Symbol: SLIT2
  Gene Name: slit guidance ligand 2
  Uniprot ID: O94813
  ENSP ID: ENSP00000422261
MRGVGWQMLSLSLGLVLAILNKVAPQACPAQCSCSGSTVDCHGLALRSVPRNIPRNTERLDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSDEEEGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 79596 - protein, 1529 aa, Homo sapiens
  Payload ID: 15850
  Gene Symbol: SLIT2
  Gene Name: slit guidance ligand 2
  Uniprot ID: O94813
  ENSP ID: ENSP00000422591
MRGVGWQMLSLSLGLVLAILNKVAPQACPAQCSCSGSTVDCHGLALRSVPRNIPRNTERLDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSAKEQYFIPGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 79597 - protein, 82 aa, Homo sapiens
  Payload ID: 15850
  Gene Symbol: SLIT2
  Gene Name: slit guidance ligand 2
  ENSP ID: ENSP00000423179
  MOD_RES (1)..(1): Any amino acid
XSYDTGSHPASAIYSVETINDGNFHIVELLALDQSLSLSVDGGNPKIITNLSKQSTLNFDSPLYVGGMPGKSNVASLRQGAL

SEQ ID NO: 79598 - protein, 196 aa, Homo sapiens
  Payload ID: 15850
  Gene Symbol: SLIT2
  Gene Name: slit guidance ligand 2
  ENSP ID: ENSP00000425609
  MOD_RES (1)..(1): Any amino acid
XSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGTNNRKYFAFHQYICLKASLELCYICLVNLFLFDKW

SEQ ID NO: 79599 - protein, 146 aa, Homo sapiens
  Payload ID: 15850
  Gene Symbol: SLIT2
  Gene Name: slit guidance ligand 2
  ENSP ID: ENSP00000426356
MEAVLFVNAEAAAPRQSGRPRDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNN

SEQ ID NO: 79600 - protein, 1521 aa, Homo sapiens
  Payload ID: 15850
  Gene Symbol: SLIT2
  Gene Name: slit guidance ligand 2
  Uniprot ID: O94813
  ENSP ID: ENSP00000427548
MRGVGWQMLSLSLGLVLAILNKVAPQACPAQCSCSGSTVDCHGLALRSVPRNIPRNTERLDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 79601 - protein, 1439 aa, Homo sapiens
  Payload ID: 15850
  Gene Symbol: SLIT2
  Gene Name: slit guidance ligand 2
  ENSP ID: ENSP00000482129
MENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSARHGGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 79602 - protein, 1530 aa, Homo sapiens
  Payload ID: 15851
  Gene Symbol: SLIT3
  Gene Name: slit guidance ligand 3
  Uniprot ID: O75094
  ENSP ID: ENSP00000332164
MAPGWAGVGAAVRARLALALALASVLSGPPAVACPTKCTCSAASVDCHGLGLRAVPRGIPRNAERLDLDRNNITRITKMDFAGLKNLRVLHLEDNQVSVIERGAFQDLKQLERLRLNKNKLQVLPELLFQSTPKLTRLDLSENQIQGIPRKAFRGITDVKNLQLDNNHISCIEDGAFRALRDLEILTLNNNNISRILVTSFNHMPKIRTLRLHSNHLYCDCHLAWLSDWLRQRRTVGQFTLCMAPVHLRGFNVADVQKKEYVCPAPHSEPPSCNANSISCPSPCTCSNNIVDCRGKGLMEIPANLPEGIVEIRLEQNSIKAIPAGAFTQYKKLKRIDISKNQISDIAPDAFQGLKSLTSLVLYGNKITEIVKGLFDGLVSLQLLLLNANKINCLRVNTFQDLQNLNLLSLYDNKLQTISKGLFAPLQSIQTLHLAQNPFVCDCHLKWLADYLQDNPIETSGARCSSPRRLANKRISQIKSKKFRCSGSEDYRSRFSSECFMDLVCPEKCRCEGTIVDCSNQKLVRIPSHLPEYVTDLRLNDNEVSVLEATGIFKKLPNLRKINLSNNKIKEVREGAFDGAASVQELMLTGNQLETVHGRVFRGLSGLKTLMLRSNLIGCVSNDTFAGLSSVRLLSLYDNRITTITPGAFTTLVSLSTINLLSNPFNCNCHLAWLGKWLRKRRIVSGNPRCQKPFFLKEIPIQDVAIQDFTCDGNEESSCQLSPRCPEQCTCMETVVRCSNKGLRALPRGMPKDVTELYLEGNHLTAVPRELSALRHLTLIDLSNNSISMLTNYTFSNMSHLSTLILSYNRLRCIPVHAFNGLRSLRVLTLHGNDISSVPEGSFNDLTSLSHLALGTNPLHCDCSLRWLSEWVKAGYKEPGIARCSSPEPMADRLLLTTPTHRFQCKVLWFCCPGPVDINIVAKCNACLSSPCKNNGTCTQDPVELYRCACPYSYKGKDCTVPINTCIQNPCQHGGTCHLSDSHKDGFSCSCPLGFEGQRCEINPDDCEDNDCENNATCVDGINNYVCICPPNYTGELCDEVIDHCVPELNLCQHEAKCIPLDKGFSCECVPGYSGKLCETDNDDCVAHKCRHGAQCVDTINGYTCTCPQGFSGPFCEHPPPMVLLQTSPCDQYECQNGAQCIVVQQEPTCRCPPGFAGPRCEKLITVNFVGKDSYVELASAKVRPQANISLQVATDKDNGILLYKGDNDPLALELYQGHVRLVYDSLSSPPTTVYSVETVNDGQFHSVELVTLNQTLNLVVDKGTPKSLGKLQKQPAVGINSPLYLGGIPTSTGLSALRQGTDRPLGGFHGCIHEVRINNELQDFKALPPQSLGVSPGCKSCTVCKHGLCRSVEKDSVVCECRPGWTGPLCDQEARDPCLGHRCHHGKCVATGTSYMCKCAEGYGGDLCDNKNDSANACSAFKCHHGQCHISDQGEPYCLCQPGFSGEHCQQENPCLGQVVREVIRRQKGYASCATASKVPIMECRGGCGPQCCQPTRSKRRKYVFQCTDGSSFVEEVERHLECGCLACS

SEQ ID NO: 79603 - protein, 1393 aa, Homo sapiens
  Payload ID: 15851
  Gene Symbol: SLIT3
  Gene Name: slit guidance ligand 3
  ENSP ID: ENSP00000384890
RDLSENQIQGIPRKAFRGITDVKNLQLDNNHISCIEDGAFRALRDLEILTLNNNNISRILVTSFNHMPKIRTLRLHSNHLYCDCHLAWLSDWLRQRRTVGQFTLCMAPVHLRGFNVADVQKKEYVCPAPHSEPPSCNANSISCPSPCTCSNNIVDCRGKGLMEIPANLPEGIVEIRLEQNSIKAIPAGAFTQYKKLKRIDISKNQISDIAPDAFQGLKSLTSLVLYGNKITEIVKGLFDGLVSLQLLLLNANKINCLRVNTFQDLQNLNLLSLYDNKLQTISKGLFAPLQSIQTLHLAQNPFVCDCHLKWLADYLQDNPIETSGARCSSPRRLANKRISQIKSKKFRCSGSEDYRSRFSSECFMDLVCPEKCRCEGTIVDCSNQKLVRIPSHLPEYVTDLRLNDNEVSVLEATGIFKKLPNLRKINLSNNKIKEVREGAFDGAASVQELMLTGNQLETVHGRVFRGLSGLKTLMLRSNLIGCVSNDTFAGLSSVRLLSLYDNRITTITPGAFTTLVSLSTINLLSNPFNCNCHLAWLGKWLRKRRIVSGNPRCQKPFFLKEIPIQDVAIQDFTCDGNEESSCQLSPRCPEQCTCMETVVRCSNKGLRALPRGMPKDVTELYLEGNHLTAVPRELSALRHLTLIDLSNNSISMLTNYTFSNMSHLSTLILSYNRLRCIPVHAFNGLRSLRVLTLHGNDISSVPEGSFNDLTSLSHLALGTNPLHCDCSLRWLSEWVKAGYKEPGIARCSSPEPMADRLLLTTPTHRFQCKVLWFCCPGPVDINIVAKCNACLSSPCKNNGTCTQDPVELYRCACPYSYKGKDCTVPINTCIQNPCQHGGTCHLSDSHKDGFSCSCPLGFEGQRCEINPDDCEDNDCENNATCVDGINNYVCICPPNYTGELCDEVIDHCVPELNLCQHEAKCIPLDKGFSCECVPGYSGKLCETDNDDCVAHKCRHGAQCVDTINGYTCTCPQGFSGPFCEHPPPMVLLQTSPCDQYECQNGAQCIVVQQEPTCRCPPGFAGPRCEKLITVNFVGKDSYVELASAKVRPQANISLQVATDKDNGILLYKGDNDPLALELYQGHVRLVYDSLSSPPTTVYSVETVNDGQFHSVELVTLNQTLNLVVDKGTPKSLGKLQKQPAVGINSPLYLGGIPTSTGLSALRQGTDRPLGGFHGCIHEVRINNELQDFKALPPQSLGVSPGCKSCTVCKHGLCRSVEKDSVVCECRPGWTGPLCDQEARDPCLGHRCHHGKCVATGTSYMCKCAEGYGGDLCDNKNDSANACSAFKCHHGQCHISDQGEPYCLCQPGFSGEHCQQENPCLGQVVREVIRRQKGYASCATASKVPIMECRGGCGPQCCQPTRSKRRKYVFQCTDGSSFVEEVERHLECGCLACS

SEQ ID NO: 79604 - protein, 1523 aa, Homo sapiens
  Payload ID: 15851
  Gene Symbol: SLIT3
  Gene Name: slit guidance ligand 3
  Uniprot ID: O75094
  ENSP ID: ENSP00000430333
MAPGWAGVGAAVRARLALALALASVLSGPPAVACPTKCTCSAASVDCHGLGLRAVPRGIPRNAERLDLDRNNITRITKMDFAGLKNLRVLHLEDNQVSVIERGAFQDLKQLERLRLNKNKLQVLPELLFQSTPKLTRLDLSENQIQGIPRKAFRGITDVKNLQLDNNHISCIEDGAFRALRDLEILTLNNNNISRILVTSFNHMPKIRTLRLHSNHLYCDCHLAWLSDWLRQRRTVGQFTLCMAPVHLRGFNVADVQKKEYVCPAPHSEPPSCNANSISCPSPCTCSNNIVDCRGKGLMEIPANLPEGIVEIRLEQNSIKAIPAGAFTQYKKLKRIDISKNQISDIAPDAFQGLKSLTSLVLYGNKITEIVKGLFDGLVSLQLLLLNANKINCLRVNTFQDLQNLNLLSLYDNKLQTISKGLFAPLQSIQTLHLAQNPFVCDCHLKWLADYLQDNPIETSGARCSSPRRLANKRISQIKSKKFRCSGSEDYRSRFSSECFMDLVCPEKCRCEGTIVDCSNQKLVRIPSHLPEYVTDLRLNDNEVSVLEATGIFKKLPNLRKINLSNNKIKEVREGAFDGAASVQELMLTGNQLETVHGRVFRGLSGLKTLMLRSNLIGCVSNDTFAGLSSVRLLSLYDNRITTITPGAFTTLVSLSTINLLSNPFNCNCHLAWLGKWLRKRRIVSGNPRCQKPFFLKEIPIQDVAIQDFTCDGNEESSCQLSPRCPEQCTCMETVVRCSNKGLRALPRGMPKDVTELYLEGNHLTAVPRELSALRHLTLIDLSNNSISMLTNYTFSNMSHLSTLILSYNRLRCIPVHAFNGLRSLRVLTLHGNDISSVPEGSFNDLTSLSHLALGTNPLHCDCSLRWLSEWVKAGYKEPGIARCSSPEPMADRLLLTTPTHRFQCKGPVDINIVAKCNACLSSPCKNNGTCTQDPVELYRCACPYSYKGKDCTVPINTCIQNPCQHGGTCHLSDSHKDGFSCSCPLGFEGQRCEINPDDCEDNDCENNATCVDGINNYVCICPPNYTGELCDEVIDHCVPELNLCQHEAKCIPLDKGFSCECVPGYSGKLCETDNDDCVAHKCRHGAQCVDTINGYTCTCPQGFSGPFCEHPPPMVLLQTSPCDQYECQNGAQCIVVQQEPTCRCPPGFAGPRCEKLITVNFVGKDSYVELASAKVRPQANISLQVATDKDNGILLYKGDNDPLALELYQGHVRLVYDSLSSPPTTVYSVETVNDGQFHSVELVTLNQTLNLVVDKGTPKSLGKLQKQPAVGINSPLYLGGIPTSTGLSALRQGTDRPLGGFHGCIHEVRINNELQDFKALPPQSLGVSPGCKSCTVCKHGLCRSVEKDSVVCECRPGWTGPLCDQEARDPCLGHRCHHGKCVATGTSYMCKCAEGYGGDLCDNKNDSANACSAFKCHHGQCHISDQGEPYCLCQPGFSGEHCQQENPCLGQVVREVIRRQKGYASCATASKVPIMECRGGCGPQCCQPTRSKRRKYVFQCTDGSSFVEEVERHLECGCLACS

SEQ ID NO: 79605 - protein, 1085 aa, Homo sapiens
  Payload ID: 15852
  Gene Symbol: SRGAP1
  Gene Name: SLIT-ROBO Rho GTPase activating protein 1
  Uniprot ID: Q7Z6B7
  ENSP ID: ENSP00000347198
MSTPSRFKKDKEIIAEYESQVKEIRAQLVEQQKCLEQQTEMRVQLLQDLQDFFRKKAEIETEYSRNLEKLAERFMAKTRSTKDHQQYKKDQNLLSPVNCWYLLLNQVRRESKDHATLSDIYLNNVIMRFMQISEDSTRMFKKSKEIAFQLHEDLMKVLNELYTVMKTYHMYHAESISAESKLKEAEKQEEKQIGRSGDPVFHIRLEERHQRRSSVKKIEKMKEKRQAKYSENKLKSIKARNEYLLTLEATNASVFKYYIHDLSDLIDCCDLGYHASLNRALRTYLSAEYNLETSRHEGLDIIENAVDNLEPRSDKQRFMEMYPAAFCPPMKFEFQSHMGDEVCQVSAQQPVQAELMLRYQQLQSRLATLKIENEEVKKTTEATLQTIQDMVTIEDYDVSECFQHSRSTESVKSTVSETYLSKPSIAKRRANQQETEQFYFMKLREYLEGSNLITKLQAKHDLLQRTLGEGHRAEYMTTRPPNVPPKPQKHRKSRPRSQYNTKLFNGDLETFVKDSGQVIPLIVESCIRFINLYGLQHQGIFRVSGSQVEVNDIKNSFERGENPLADDQSNHDINSVAGVLKLYFRGLENPLFPKERFNDLISCIRIDNLYERALHIRKLLLTLPRSVLIVMRYLFAFLNHLSQYSDENMMDPYNLAICFGPTLMPVPEIQDQVSCQAHVNEIIKTIIIHHETIFPDAKELDGPVYEKCMAGDDYCDSPYSEHGTLEEVDQDAGTEPHTSEDECEPIEAIAKFDYVGRSARELSFKKGASLLLYHRASEDWWEGRHNGIDGLVPHQYIVVQDMDDTFSDTLSQKADSEASSGPVTEDKSSSKDMNSPTDRHPDGYLARQRKRGEPPPPVRRPGRTSDGHCPLHPPHALSNSSVDLGSPSLASHPRGLLQNRGLNNDSPERRRRPGHGSLTNISRHDSLKKIDSPPIRRSTSSGQYTGFNDHKPLDPETIAQDIEETMNTALNELRELERQSTAKHAPDVVLDTLEQVKNSPTPATSTESLSPLHNVALRSSEPQIRRSTSSSSDTMSTFKPMVAPRMGVQLKPPALRPKPAVLPKTNPTIGPAPPPQGPTDKSCTM

SEQ ID NO: 79606 - protein, 1022 aa, Homo sapiens
  Payload ID: 15852
  Gene Symbol: SRGAP1
  Gene Name: SLIT-ROBO Rho GTPase activating protein 1
  ENSP ID: ENSP00000437948
MRVQLLQDLQDFFRKKAEIETEYSRNLEKLAERFMAKTRSTKDHQQYKKDQNLLSPVNCWYLLLNQVRRESKDHATLSDIYLNNVIMRFMQISEDSTRMFKKSKEIAFQLHEDLMKVLNELYTVMKTYHMYHAESISAESKLKEAEKQEEKQIGRSGDPVFHIRLEERHQRRSSVKKIEKMKEKRQAKYSENKLKSIKARNEYLLTLEATNASVFKYYIHDLSDLIDCCDLGYHASLNRALRTYLSAEYNLETSRHEGLDIIENAVDNLEPRSDKQRFMEMYPAAFCPPMKFEFQSHMGDEVCQVSAQQPVQAELMLRYQQLQSRLATLKIENEEVKKTTEATLQTIQDMVTIEDYDVSECFQHSRSTESVKSTVSETYLSKPSIAKRRANQQETEQFYFMKLREYLEGSNLITKLQAKHDLLQRTLGEGHRAEYMTTSRGRRNSHTRHQDSGQVIPLIVESCIRFINLYGLQHQGIFRVSGSQVEVNDIKNSFERGENPLADDQSNHDINSVAGVLKLYFRGLENPLFPKERFNDLISCIRIDNLYERALHIRKLLLTLPRSVLIVMRYLFAFLNHLSQYSDENMMDPYNLAICFGPTLMPVPEIQDQVSCQAHVNEIIKTIIIHHETIFPDAKELDGPVYEKCMAGDDYCDSPYSEHGTLEEVDQDAGTEPHTSEDECEPIEAIAKFDYVGRSARELSFKKGASLLLYHRASEDWWEGRHNGIDGLVPHQYIVVQDMDDTFSDTLSQKADSEASSGPVTEDKSSSKDMNSPTDRHPDGYLARQRKRGEPPPPVRRPGRTSDGHCPLHPPHALSNSSVDLGSPSLASHPRGLLQNRGLNNDSPERRRRPGHGSLTNISRHDSLKKIDSPPIRRSTSSGQYTGFNDHKPLDPETIAQDIEETMNTALNELRELERQSTAKHAPDVVLDTLEQVKNSPTPATSTESLSPLHNVALRSSEPQIRRSTSSSSDTMSTFKPMVAPRMGVQLKPPALRPKPAVLPKTNPTIGPAPPPQGPTDKSCTM

SEQ ID NO: 79607 - protein, 1022 aa, Homo sapiens; identical to SEQ ID NO: 79606
  Payload ID: 15852
  Gene Symbol: SRGAP1
  Gene Name: SLIT-ROBO Rho GTPase activating protein 1
  ENSP ID: ENSP00000485752

SEQ ID NO: 79608 - protein, 305 aa, Homo sapiens
  Payload ID: 15853
  Gene Symbol: SRGAP2
  Gene Name: SLIT-ROBO Rho GTPase activating protein 2
  ENSP ID: ENSP00000397990
MKVLNELYSVMKTYHMYNADSISAQSKLKEAEKQEEKQIGKSVKQEDRQTPRSPDSTANVRIEEKHVRRSSVKKIEKMKEKRQAKYTENKLKAIKARNEYLLALEATNASVFKYYIHDLSDLIDCCDLGYHASLNRALRTFLSAELNLEQSKHEGLDAIENAVENLDATSDKQRLMEMYNNVFCPPMKFEFQPHMGDMASQLCAQQPVQSELVQRCQQLQSRLSTLKIENEEVKKTMEATLQTIQDIVTVEDFDVSDCFQYSNSMESVKSTVSETFMSKPSIAKRRANQQETEQFYFTVRECYGF

SEQ ID NO: 79609 - protein, 118 aa, Homo sapiens
  Payload ID: 15853
  Gene Symbol: SRGAP2
  Gene Name: SLIT-ROBO Rho GTPase activating protein 2
  ENSP ID: ENSP00000459397
MKCLDQQCELRVQLLQDLQDFFRKKAEIEMDYSRNLEKLAERFLAKTRSTKDQQFKKDQNVLSPVNCWNLLLNQSKEVGQQLQDDLMKVLNELYSVMKTYHMYNADSISAQSKLKEAE

SEQ ID NO: 79610 - protein, 1071 aa, Homo sapiens
  Payload ID: 15853
  Gene Symbol: SRGAP2
  Gene Name: SLIT-ROBO Rho GTPase activating protein 2
  ENSP ID: ENSP00000459615
MTSPAKFKKDKEIIAEYDTQVKEIRAQLTEQMKCLDQQCELRVQLLQDLQDFFRKKAEIEMDYSRNLEKLAERFLAKTRSTKDQQFKKDQNVLSPVNCWNLLLNQVKRESRDHTTLSDIYLNNIIPRFVQVSEDSGRLFKKSKEVGQQLQDDLMKVLNELYSVMKTYHMYNADSISAQSKLKEAEKQEEKQIGKSVKQEDRQTPRSPDSTANVRIEEKHVRRSSVKKIEKMKEKRQAKYTENKLKAIKARNEYLLALEATNASVFKYYIHDLSDLIDQCCDLGYHASLNRALRTFLSAELNLEQSKHEGLDAIENAVENLDATSDKQRLMEMYNNVFCPPMKFEFQPHMGDMASQLCAQQPVQSELVQRCQQLQSRLSTLKIENEEVKKTMEATLQTIQDIVTVEDFDVSDCFQYSNSMESVKSTVSETFMSKPSIAKRRANQQETEQFYFTKMKEYLEGRNLITKLQAKHDLLQKTLGESQRTDCSLARRSSTVRKQDSSQAIPLVVESCIRFISRHGLQHEGIFRVSGSQVEVNDIKNAFERGEDPLAGDQNDHDMDSIAGVLKLYFRGLEHPLFPKDIFHDLMACVTMDNLQERALHIRKVLLVLPKTTLIIMRYLFAFLNHLSQFSEENMMDPYNLAICFGPSLMSVPEGHDQVSCQAHVNELIKTIIIQHENIFPSPRELEGPVYSRGGSMEDYCDSPHGETTSVEDSTQDVTAEHHTSDDECEPIEAIAKFDYVGRTARELSFKKGASLLLYQRASDDWWEGRHNGIDGLIPHQYIVVQDTEDGVVERSSPKSEIEVISEPPEEKVTARAGASCPSGGHVADIYLANINKQRKRPESGSIRKTFRSDSHGLSSSLTDSSSPGVGASCRPSSQPIMSQSLPKEGPDKCSISGHGSLNSISRHSSLKNRLDSPQIRKTATAGRSKSFNNHRPMDPEVIAQDIEATMNSALNELRELERQSSVKHTPDVVLDTLEPLKTSPVVAPTSEPSSPLHTQLLKDPEPAFQRSASTAGDIACAFRPVKSVKMAAPVKPPATRPKPTVFPKTNATSPGVNSSTSPQSTDKSCTV

SEQ ID NO: 79611 - protein, 789 aa, Homo sapiens
  Payload ID: 15853
  Gene Symbol: SRGAP2
  Gene Name: SLIT-ROBO Rho GTPase activating protein 2
  ENSP ID: ENSP00000473954
MTSPAKFKKDKEIIAEYDTQVKEIRAQLTEQMKCLDQQCELRVQLLQDLQDFFRKKAEIEMDYSRNLEKLAERFLAKTRSTKDQQFKKDQNVLSPVNCWNLLLNQVKRESRDHTTLSDIYLNNIIPRFVQVSEDSGRLFKKSKEVGQQLQDDLMKVLNELYSVMKTYHMYNADSISAQSKLKEAEKQEEKQIGKSVKQEDRQTPRSPDSTANVRIEEKHVRRSSVKKIEKMKEKRQAKYTENKLKAIKARNEYLLALEATNASVFKYYIHDLSDLIDCCDLGYHASLNRALRTFLSAELNLEQSKHEGLDAIENAVENLDATSDKQRLMEMYNNVFCPPMKFEFQPHMGDMASQLCAQQPVQSELVQRCQQLQSRLSTLKIENEEVKKTMEATLQTIQDIVTVEDFDVSDCFQYSNSMESVKSTVSETFMSKPSIAKRRANQQETEQFYFTKMKEYLEGRNLITKLQAKHDLLQKTLGESQRTDCSLARRSSTVRKQDSSQAIPLVVESCIRFISRHGLQHEGIFRVSGSQVEVNDIKNAFERGEDPLAGDQNDHDMDSIAGVLKLYFRGLEHPLFPKDIFHDLMACVTMDNLQERALHIRKVLLVLPKTTLIIMRYLFAFLNHLSQFSEENMMDPYNLAICFGPSLMSVPEGHDQVSCQAHVNELIKTIIIQHENIFPSPRELEGPVYSRGGSMEDYCDSPHGETTSVEDSTQDVTAEHHTSDDECEPIEAIAKFDYVGRTARELSFKKGASLLLYQRASDDWWEGRHNGIDGLIPHQYIVVQDTLIS

SEQ ID NO: 79612 - protein, 86 aa, Homo sapiens
  Payload ID: 15853
  Gene Symbol: SRGAP2
  Gene Name: SLIT-ROBO Rho GTPase activating protein 2
  ENSP ID: ENSP00000474255
MTSPAKFKKDKEIIAEYDTQVKEIRAQLTEQMKCLDQQCELRVQLLQDLQDFFRKKAEIEMDYSRNLEKLAERFLAKTRSTKDQQF

SEQ ID NO: 79613 - protein, 450 aa, Homo sapiens
  Payload ID: 15853
  Gene Symbol: SRGAP2
  Gene Name: SLIT-ROBO Rho GTPase activating protein 2
  ENSP ID: ENSP00000474270
VKKTMEATLQTIQDIVTVEDFDVSDCFQYSNSMESVKSTVSETFMSKPSIAKRRANQQETEQFYFTKMKEYLEGRNLITKLQAKHDLLQKTLGESQRTDCSLARRSSTVRKQDSSQAIPLVVESCIRFISRHGLQHEGIFRVSGSQVEVNDIKNAFERGEDPLAGDQNDHDMDSIAGVLKLYFRGLEHPLFPKDIFHDLMACVTMDNLQERALHIRKVLLVLPKTTLIIMRYLFAFLNHLSQFSEENMMDPYNLAICFGPSLMSVPEGHDQVSCQAHVNELIKTIIIQHENIFPSPRELEGPVYSRGGSMEDYCDSPHGETTSVEDSTQDVTAEHHTSDDECEPIEAIAKFDYVGRTARELSFKKGASLLLYQRASDDWWEGRHNGIDGLIPHQYIVVQDTEDGVVERSSPKSEIEVISEPPEEKVTARAGASCPSGGHVADIYLANINK

SEQ ID NO: 79614 - protein, 224 aa, Homo sapiens
  Payload ID: 15853
  Gene Symbol: SRGAP2
  Gene Name: SLIT-ROBO Rho GTPase activating protein 2
  ENSP ID: ENSP00000474699
  MOD_RES (1)..(1): Any amino acid
XLFAFLNHLSQFSEENMMDPYNLAICFGPSLMSVPEGHDQVSCQAHVNELIKTIIIQHENIFPSPRELEGPVYSRGGSMEDYCDSPHGETTSVEDSTQDVTAEHHTSDDECEPIEAIAKFDYVGRTARELSFKKGASLLLYQRASDDWWEGRHNGIDGLIPHQYIVVQDTEDGVVERSSPKSEIEVISEPPEEKVTARAGASCPSGGHVADIYLANINNFHCGC

SEQ ID NO: 79615 - protein, 294 aa, Homo sapiens
  Payload ID: 15853
  Gene Symbol: SRGAP2
  Gene Name: SLIT-ROBO Rho GTPase activating protein 2
  ENSP ID: ENSP00000474818
ECEPIEAIAKFDYVGRTARELSFKKGASLLLYQRASDDWWEGRHNGIDGLIPHQYIVVQDTEDGVVERSSPKSEIEVISEPPEEKVTARAGASCPSGGHVADIYLANINNNLHLDNTKPVTTKQRKRPESGSIRKTFRSDSHGLSSSLTDSSSPGVGASCRPSSQPIMSQSLPKEGPDKCSISGHGSLNSISRHSSLKNRLDSPQIRKTATAGRSKSFNNHRPMDPEVIAQDIEATMNSALNELRELERQSSVKHTPDVVLDTLEPLKTSPVVAPTSEPSSPLHTQLLKDPEPA

SEQ ID NO: 79616 - protein, 1070 aa, Homo sapiens
  Payload ID: 15853
  Gene Symbol: SRGAP2
  Gene Name: SLIT-ROBO Rho GTPase activating protein 2
  ENSP ID: ENSP00000485517
MTSPAKFKKDKEIIAEYDTQVKEIRAQLTEQMKCLDQQCELRVQLLQDLQDFFRKKAEIEMDYSRNLEKLAERFLAKTRSTKDQQFKKDQNVLSPVNCWNLLLNQVKRESRDHTTLSDIYLNNIIPRFVQVSEDSGRLFKKSKEVGQQLQDDLMKVLNELYSVMKTYHMYNADSISAQSKLKEAEKQEEKQIGKSVKQEDRQTPRSPDSTANVRIEEKHVRRSSVKKIEKMKEKRQAKYTENKLKAIKARNEYLLALEATNASVFKYYIHDLSDLIDCCDLGYHASLNRALRTFLSAELNLEQSKHEGLDAIENAVENLDATSDKQRLMEMYNNVFCPPMKFEFQPHMGDMASQLCAQQPVQSELVQRCQQLQSRLSTLKIENEEVKKTMEATLQTIQDIVTVEDFDVSDCFQYSNSMESVKSTVSETFMSKPSIAKRRANQQETEQFYFTKMKEYLEGRNLITKLQAKHDLLQKTLGESQRTDCSLARRSSTVRKQDSSQAIPLVVESCIRFISRHGLQHEGIFRVSGSQVEVNDIKNAFERGEDPLAGDQNDHDMDSIAGVLKLYFRGLEHPLFPKDIFHDLMACVTMDNLQERALHIRKVLLVLPKTTLIIMRYLFAFLNHLSQFSEENMMDPYNLAICFGPSLMSVPEGHDQVSCQAHVNELIKTIIIQHENIFPSPRELEGPVYSRGGSMEDYCDSPHGETTSVEDSTQDVTAEHHTSDDECEPIEAIAKFDYVGRTARELSFKKGASLLLYQRASDDWWEGRHNGIDGLIPHQYIVVQDTEDGVVERSSPKSEIEVISEPPEEKVTARAGASCPSGGHVADIYLANINKQRKRPESGSIRKTFRSDSHGLSSSLTDSSSPGVGASCRPSSQPIMSQSLPKEGPDKCSISGHGSLNSISRHSSLKNRLDSPQIRKTATAGRSKSFNNHRPMDPEVIAQDIEATMNSALNELRELERQSSVKHTPDVVLDTLEPLKTSPVVAPTSEPSSPLHTQLLKDPEPAFQRSASTAGDIACAFRPVKSVKMAAPVKPPATRPKPTVFPKTNATSPGVNSSTSPQSTDKSCTV

SEQ ID NO: 79617 - protein, 458 aa, Homo sapiens
  Payload ID: 15854
  Gene Symbol: SRGAP2B
  Gene Name: SLIT-ROBO Rho GTPase activating protein 2B
  Uniprot ID: P0DMP2
  ENSP ID: ENSP00000477776
MTSPAKFKKDKEIIAEYDTQVKEIRAQLTEQMKCLDQQCELRVQLLQDLQDFFRKKAEIEMDYSRNLEKLAERFLAKTCSTKDQQFKKDQNVLSPVNCWNLLLNQVKRESRDHTTLSDIYLNNIIPRFVQVSEDSGRLFKKSKEVGQQLQDDLMKVLNELYSVMKTYHMYNADSISAQSKLKEAEKQEEKQIGKSVKQEDRQTPRSPDSTANVRIEEKHVRRSSVKKIEKMKEKRQAKYTENKLKAIKARNEYLLALEATNASVFKYYIHDLSDLIDCCDLGYHASLNRALRTFLSAELNLEQSKHEGLDAIENAVENLDATSDKQRLMEMYNNVFCPPMKFEFQPHMGDMASQLCAQQPVQSELLQRCQQLQSRLSTLKIENEEVKKTMEATLQTIQDIVTVEDFDVSDCFQYSNSMESVKSTVSETFMSKPSIAKRRANQQETEQFYFTVRECYGF

SEQ ID NO: 79618 - protein, 305 aa, Homo sapiens
  Payload ID: 15854
  Gene Symbol: SRGAP2B
  Gene Name: SLIT-ROBO Rho GTPase activating protein 2B
  ENSP ID: ENSP00000479960
MKVLNELYSVMKTYHMYNADSISAQSKLKEAEKQEEKQIGKSVKQEDRQTPRSPDSTANVRIEEKHVRRSSVKKIEKMKEKRQAKYTENKLKAIKARNEYLLALEATNASVFKYYIHDLSDLIDCCDLGYHASLNRALRTFLSAELNLEQSKHEGLDAIENAVENLDATSDKQRLMEMYNNVFCPPMKFEFQPHMGDMASQLCAQQPVQSELLQRCQQLQSRLSTLKIENEEVKKTMEATLQTIQDIVTVEDFDVSDCFQYSNSMESVKSTVSETFMSKPSIAKRRANQQETEQFYFTVRECYGF

SEQ ID NO: 79619 - protein, 43 aa, Homo sapiens
  Payload ID: 15854
  Gene Symbol: SRGAP2B
  Gene Name: SLIT-ROBO Rho GTPase activating protein 2B
  ENSP ID: ENSP00000484189
  MOD_RES (1)..(1): Any amino acid
XKKSKEVGQQLQDDLMKVLNELYSHQCSEQTKGGGEAGGEANW

SEQ ID NO: 79620 - protein, 459 aa, Homo sapiens
  Payload ID: 15855
  Gene Symbol: SRGAP2C
  Gene Name: SLIT-ROBO Rho GTPase activating protein 2C
  Uniprot ID: P0DJJ0
  ENSP ID: ENSP00000478290
MTSPAKFKKDKEIIAEYDTQVKEIRAQLTEQMKCLDQQCELRVQLLQDLQDFFRKKAEIEMDYSRNLEKLAEHFLAKTRSTKDQQFKKDQNVLSPVNCWNLLLNQVKWESRDHTTLSDIYLNNIIPRFVQVSEDSGRLFKKSKEVGQQLQDDLMKVLNELYSVMKTYHMYNADSISAQSKLKEAEKQEEKQIGKSVKQEDRQTPCSPDSTANVRIEEKHVRRSSVKKIEKMKEKHQAKYTENKLKAIKAQNEYLLALEATNASVFKYYIHDLSDLIDQCCDLGYHASLNRALRTFLSAELNLEQSKHEGLDAIENAVENLDATSDKQRLMEMYNNVFCPPMKFEFQPHMGDMASQLCAQQPVQSELVQRCQQLQSRLSTLKIENEEVKKTMEATLQTIQDIVTVEDFDVSDCFQYSNSMESVKSTVSETFMSKPSIAKRRANQQETEQFYFTVRECYGF

SEQ ID NO: 79621 - protein, 305 aa, Homo sapiens
  Payload ID: 15855
  Gene Symbol: SRGAP2C
  Gene Name: SLIT-ROBO Rho GTPase activating protein 2C
  ENSP ID: ENSP00000483477
MKVLNELYSVMKTYHMYNADSISAQSKLKEAEKQEEKQIGKSVKQEDRQTPCSPDSTANVRIEEKHVRRSSVKKIEKMKEKHQAKYTENKLKAIKAQNEYLLALEATNASVFKYYIHDLSDLIDCCDLGYHASLNRALRTFLSAELNLEQSKHEGLDAIENAVENLDATSDKQRLMEMYNNVFCPPMKFEFQPHMGDMASQLCAQQPVQSELVQRCQQLQSRLSTLKIENEEVKKTMEATLQTIQDIVTVEDFDVSDCFQYSNSMESVKSTVSETFMSKPSIAKRRANQQETEQFYFTVRECYGF

SEQ ID NO: 79622 - protein, 1075 aa, Homo sapiens
  Payload ID: 15856
  Gene Symbol: SRGAP3
  Gene Name: SLIT-ROBO Rho GTPase activating protein 3
  Uniprot ID: O43295
  ENSP ID: ENSP00000353587
MSSQTKFKKDKEIIAEYEAQIKEIRTQLVEQFKCLEQQSESRLQLLQDLQEFFRRKAEIELEYSRSLEKLAERFSSKIRSSREHQFKKDQYLLSPVNCWYLVLHQTRRESRDHATLNDIFMNNVIVRLSQISEDVIRLFKKSKEIGLQMHEELLKVTNELYTVMKTYHMYHAESISAESKLKEAEKQEEKQFNKSGDLSMNLLRHEDRPQRRSSVKKIEKMKEKRQAKYSENKLKCTKARNDYLLNLAATNAAISKYYIHDVSDLIDCCDLGFHASLARTFRTYLSAEYNLETSRHEGLDVIENAVDNLDSRSDKHTVMDMCNQVFCPPLKFEFQPHMGDEVCQVSAQQPVQTELLMRYHQLQSRLATLKIENEEVRKTLDATMQTLQDMLTVEDFDVSDAFQHSRSTESVKSAASETYMSKINIAKRRANQQETEMFYFTKFKEYVNGSNLITKLQAKHDLLKQTLGEGERAECGTTRGRRNARTRNQDSGQAIPLVVESCIRYINLYGLQQQGIFRVPGSQVEVNDIKNSFERGEDPLVDDQNERDINSVAGVLKLYFRGLENPLFPKERFQDLISTIKLENPAERVHQIQQILVTLPRVVIVVMRYLFAFLNHLSQYSDENMMDPYNLAICFGPTLMHIPDGQDPVSCQAHINEVIKTIIIHHEAIFPSPRELEGPVYEKCMAGGEEYCDSPHSEPGAIDEVDHDNGTEPHTSDEEVEQIEAIAKFDYMGRSPRELSFKKGASLLLYHRASEDWWEGRHNGVDGLIPHQYIVVQDMDDAFSDSLSQKADSEASSGPLLDDKASSKNDLQSPTEHISDYGFGGVMGRVRLRSDGAAIPRRRSGGDTHSPPRGLGPSIDTPPRAAACPSSPHKIPLTRGRIESPEKRRMATFGSAGSINYPDKKALSEGHSMRSTCGSTRHSSLGDHKSLEAEALAEDIEKTMSTALHELRELERQNTVKQAPDVVLDTLEPLKNPPGPVSSEPASPLHTIVIRDPDAAMRRSSSSSTEMMTTFKPALSARLAGAQLRPPPMRPVRPVVQHRSSSSSSSGVGSPAVTPTEKMFPNSSADKSGTM

SEQ ID NO: 79623 - protein, 1099 aa, Homo sapiens
  Payload ID: 15856
  Gene Symbol: SRGAP3
  Gene Name: SLIT-ROBO Rho GTPase activating protein 3
  Uniprot ID: O43295
  ENSP ID: ENSP00000373347
MSSQTKFKKDKEIIAEYEAQIKEIRTQLVEQFKCLEQQSESRLQLLQDLQEFFRRKAEIELEYSRSLEKLAERFSSKIRSSREHQFKKDQYLLSPVNCWYLVLHQTRRESRDHATLNDIFMNNVIVRLSQISEDVIRLFKKSKEIGLQMHEELLKVTNELYTVMKTYHMYHAESISAESKLKEAEKQEEKQFNKSGDLSMNLLRHEDRPQRRSSVKKIEKMKEKRQAKYSENKLKCTKARNDYLLNLAATNAAISKYYIHDVSDLIDCCDLGFHASLARTFRTYLSAEYNLETSRHEGLDVIENAVDNLDSRSDKHTVMDMCNQVFCPPLKFEFQPHMGDEVCQVSAQQPVQTELLMRYHQLQSRLATLKIENEEVRKTLDATMQTLQDMLTVEDFDVSDAFQHSRSTESVKSAASETYMSKINIAKRRANQQETEMFYFTKFKEYVNGSNLITKLQAKHDLLKQTLGEGERAECGTTRPPCLPPKPQKMRRPRPLSVYSHKLFNGSMEAFIKDSGQAIPLVVESCIRYINLYGLQQQGIFRVPGSQVEVNDIKNSFERGEDPLVDDQNERDINSVAGVLKLYFRGLENPLFPKERFQDLISTIKLENPAERVHQIQQILVTLPRVVIVVMRYLFAFLNHLSQYSDENMMDPYNLAICFGPTLMHIPDGQDPVSCQAHINEVIKTIIIHHEAIFPSPRELEGPVYEKCMAGGEEYCDSPHSEPGAIDEVDHDNGTEPHTSDEEVEQIEAIAKFDYMGRSPRELSFKKGASLLLYHRASEDWWEGRHNGVDGLIPHQYIVVQDMDDAFSDSLSQKADSEASSGPLLDDKASSKNDLQSPTEHISDYGFGGVMGRVRLRSDGAAIPRRRSGGDTHSPPRGLGPSIDTPPRAAACPSSPHKIPLTRGRIESPEKRRMATFGSAGSINYPDKKALSEGHSMRSTCGSTRHSSLGDHKSLEAEALAEDIEKTMSTALHELRELERQNTVKQAPDVVLDTLEPLKNPPGPVSSEPASPLHTIVIRDPDAAMRRSSSSSTEMMTTFKPALSARLAGAQLRPPPMRPVRPVVQHRSSSSSSSGVGSPAVTPTEKMFPNSSADKSGTM

SEQ ID NO: 79624 - protein, 335 aa, Homo sapiens
  Payload ID: 15856
  Gene Symbol: SRGAP3
  Gene Name: SLIT-ROBO Rho GTPase activating protein 3
  ENSP ID: ENSP00000482666
MNNVIVRLSQISEDVIRLFKKSKEIGLQMHEELLKVTNELYTVMKTYHMYHAESISAESKLKEAEKQEEKQFNKSGDLSMNLLRHEDRPQRRSSVKKIEKMKEKRQAKYSENKLKCTKARNDYLLNLAATNAAISKYYIHDVSDLIDCCDLGFHASLARTFRTYLSAEYNLETSRHEGLDVIENAVDNLDSRSDKHTVMDMCNQVFCPPLKFEFQPHMGDEVCQVSAQQPVQTELLMRYHQLQSRLATLKIENEEVRKTLDATMQTLQDMLTVEDFDVSDAFQHSRSTESVKSAASETYMSKINIAKRRANQQETEMFYFTKGPDDVFPICHPRL

SEQ ID NO: 79625 - protein, 138 aa, Homo sapiens
  Payload ID: 15857
  Gene Symbol: SCIMP
  Gene Name: SLP adaptor and CSK interacting membrane protein
  Uniprot ID: Q6UWF3
  ENSP ID: ENSP00000382509
MDTFTVQDSTAMSWWRNNFWIILAVAIIVVSVGLGLILYCVCKKWEIAKPLKHKQVDEEKMYENVLNESPVQLPPLPPRNWPSLEDSSPQEAPSQPPATYSLVNKVKNKKTVSIPSYIEPEDDYDDVEIPANTEKASF

SEQ ID NO: 79626 - protein, 130 aa, Homo sapiens
  Payload ID: 15857
  Gene Symbol: SCIMP
  Gene Name: SLP adaptor and CSK interacting membrane protein
  ENSP ID: ENSP00000459153
MDTFTVQDSTAMSWWRNNFWIILAVAIIVVSVGLGLILYCVCKWQLRRGKKWEIAKPLKHKQVDEEKMYENVLNESPVQLPPLPPRNWPSLEDSYGVLLCHPGWSAMARSRLTASSASRVHAILLPQPPE

SEQ ID NO: 79627 - protein, 123 aa, Homo sapiens
  Payload ID: 15857
  Gene Symbol: SCIMP
  Gene Name: SLP adaptor and CSK interacting membrane protein
  Uniprot ID: Q6UWF3
  ENSP ID: ENSP00000459605
MDTFTVQDSTAMSWWRNNFWIILAVAIIVVSVGLGLILYCVCKKWEIAKPLKHKQVDEEKMYENVLNESPVQLPPLPPRNWPSLEDSYGVLLCHPGWSAMARSRLTASSASRVHAILLPQPPE

SEQ ID NO: 79628 - protein, 145 aa, Homo sapiens
  Payload ID: 15857
  Gene Symbol: SCIMP
  Gene Name: SLP adaptor and CSK interacting membrane protein
  Uniprot ID: Q6UWF3
  ENSP ID: ENSP00000461269
MDTFTVQDSTAMSWWRNNFWIILAVAIIVVSVGLGLILYCVCKWQLRRGKKWEIAKPLKHKQVDEEKMYENVLNESPVQLPPLPPRNWPSLEDSSPQEAPSQPPATYSLVNKVKNKKTVSIPSYIEPEDDYDDVEIPANTEKASF

SEQ ID NO: 79629 - protein, 586 aa, Homo sapiens
  Payload ID: 15858
  Gene Symbol: SLU7
  Gene Name: SLU7 homolog, splicing factor
  Uniprot ID: O95391
  ENSP ID: ENSP00000297151
MSATVVDAVNAAPLSGSKEMSLEEPKKMTREDWRKKKELEEQRKLGNAPAEVDEEGKDINPHIPQYISSVPWYIDPSKRPTLKHQRPQPEKQKQFSSSGEWYKRGVKENSIITKYRKGACENCGAMTHKKKDCFERPRRVGAKFTGTNIAPDEHVQPQLMFDYDGKRDRWNGYNPEEHMKIVEEYAKVDLAKRTLKAQKLQEELASGKLVEQANSPKHQWGEEEPNSQMEKDHNSEDEDEDKYADDIDMPGQNFDSKRRITVRNLRIREDIAKYLRNLDPNSAYYDPKTRAMRENPYANAGKNPDEVSYAGDNFVRYTGDTISMAQTQLFAWEAYDKGSEVHLQADPTKLELLYKSFKVKKEDFKEQQKESILEKYGGQEHLDAPPAELLLAQTEDYVEYSRHGTVIKGQERAVACSKYEEDVKIHNHTHIWGSYWKEGRWGYKCCHSFFKYSYCTGEAGKEIVNSEECIINEITGEESVKKPQTLMELHQEKLKEEKKKKKKKKKKHRKSSSDSDDEEKKHEKLKKALNAEEARLLHVKETMQIDERKRPYNSMYETREPTEEEMEAYRMKRQRPDDPMASFLGQ

SEQ ID NO: 79630 - protein, 101 aa, Homo sapiens
  Payload ID: 15858
  Gene Symbol: SLU7
  Gene Name: SLU7 homolog, splicing factor
  ENSP ID: ENSP00000428362
MSATVVDAVNAAPLSGSKEMSLEEPKKMTREDWRKKKELEEQRKLGNAPAEVDEEGKDINPHIPQYISSVPWYIDPSKRPTLKHQRPQPEKQKQFSSSGEW

SEQ ID NO: 79631 - protein, 143 aa, Homo sapiens
  Payload ID: 15858
  Gene Symbol: SLU7
  Gene Name: SLU7 homolog, splicing factor
  ENSP ID: ENSP00000428943
MSATVVDAVNAAPLSGSKEMSLEEPKKMTREDWRKKKELEEQRKLGNAPAEVDEEGKDINPHIPQYISSVPWYIDPSKRPTLKHQRPQPEKQKQFSSSGEWYKRGVKENSIITKYRKGACENCGAMTHKKKDCFERPRRVGAK

SEQ ID NO: 79632 - protein, 124 aa, Homo sapiens
  Payload ID: 15858
  Gene Symbol: SLU7
  Gene Name: SLU7 homolog, splicing factor
  ENSP ID: ENSP00000429990
MSATVVDAVNAAPLSGSKEMSLEEPKKMTREDWRKKKELEEQRKLGNAPAEVDEEGKDINPHIPQYISSVPWYIDPSKRPTLKHQRPQPEKQKQFSSSGEWYKRGVKENSIITKYRKGACENCG

SEQ ID NO: 79633 - protein, 275 aa, Homo sapiens
  Payload ID: 15859
  Gene Symbol: SLX1A
  Gene Name: SLX1 homolog A, structure-specific endonuclease subunit
  Uniprot ID: Q9BQ83
  ENSP ID: ENSP00000251303
MGPAGVAARPGRFFGVYLLYCLNPRYRGRVYVGFTVNTARRVQQHNGGRKKGGAWRTSGRGPWEMVLVVHGFPSSVAALRFEWAWQHPHASRRLAHVGPRLRGETAFAFHLRVLAHMLRAPPWARLPLTLRWVRPDLRQDLCLPPPPHVPLAFGPPPPQAPAPRRRAGPFDDAEPEPDQGDPGACCSLCAQTIQDEEGPLCCPHPGCLLRAHVICLAEEFLQEEPGQLLPLEGQCPCCEKSLLWGDLIWLCQMDTEKEVEDSELEEAHWTDLLET

SEQ ID NO: 79634 - protein, 161 aa, Homo sapiens
  Payload ID: 15859
  Gene Symbol: SLX1A
  Gene Name: SLX1 homolog A, structure-specific endonuclease subunit
  Uniprot ID: Q9BQ83
  ENSP ID: ENSP00000333945
MGPAGVAARPGRFFGVYLLYCLNPRYRGRVYVGFTVNTARRVQQHNGGRKKGGAWRTSGRGPWEMVLVVHGFPSSVAALRDEEGPLCCPHPGCLLRAHVICLAEEFLQEEPGQLLPLEGQCPCCEKSLLWGDLIWLCQMDTEKEVEDSELEEAHWTDLLET

SEQ ID NO: 79635 - protein, 81 aa, Homo sapiens
  Payload ID: 15859
  Gene Symbol: SLX1A
  Gene Name: SLX1 homolog A, structure-specific endonuclease subunit
  ENSP ID: ENSP00000455250
MGPAGVAARPGRFFGVYLLYCLNPRYRGRVYVGFTVNTARRVQQHNGGRKKGGAWRTSGRGPWEMVLVVHGFPSSVAALRL

SEQ ID NO: 79636 - protein, 275 aa, Homo sapiens; identical to SEQ ID NO: 79633
  Payload ID: 15860
  Gene Symbol: SLX1B
  Gene Name: SLX1 homolog B, structure-specific endonuclease subunit
  Uniprot ID: Q9BQ83
  ENSP ID: ENSP00000328940

SEQ ID NO: 79637 - protein, 161 aa, Homo sapiens; identical to SEQ ID NO: 79634
  Payload ID: 15860
  Gene Symbol: SLX1B
  Gene Name: SLX1 homolog B, structure-specific endonuclease subunit
  Uniprot ID: Q9BQ83
  ENSP ID: ENSP00000335316

SEQ ID NO: 79638 - protein, 88 aa, Homo sapiens
  Payload ID: 15860
  Gene Symbol: SLX1B
  Gene Name: SLX1 homolog B, structure-specific endonuclease subunit
  ENSP ID: ENSP00000456372
MVLVVHGFPSSVAALRFEWAWQHPHASRRLAHVGPRLRGETAFAFHLRVLAHMLRAPPWARLPLTLRWVRPDLRQDLCLPPPPHVPLA

SEQ ID NO: 79639 - protein, 408 aa, Homo sapiens
  Payload ID: 15861
  Gene Symbol: SLX4IP
  Gene Name: SLX4 interacting protein
  Uniprot ID: Q5VYV7
  ENSP ID: ENSP00000335557
MASKKFAVKCGNFAVLVDLHILPQGSNKDTSWFSEQKKEEVCLLLKETIDSRVQEYLEVRKQHRPSNAEFTRSNPLSLKGYGFQITAYFLKRGIRLRCIRSTQNAELCVFPDRFVVCVSQLAFSRDLLASQNEDLTERVLHGVSDYFAECAESSLPPSAKLRRNALKEIVKRTETKSSVTSKSQTRRDTVETSSDSVIAEIARRRNDGQASSSPPSESMGQAKDSIKAAESHWGLPVQKLEKVNQTQPEDTSGQQKPHPGERLKTGLLSRSPVCSCESASPCPKQSPRVAKTQQKRRNCSSAEDFDHHGRVSLGSDRLVPREIIVEKSKAVRVLPASELSDPGLLLKQDLAKTTSKEELHVLESLSSRHLMKNNPGQAQQTGLATNTERLSTIQNSPTKKRKKYERGH

SEQ ID NO: 79640 - protein, 78 aa, Homo sapiens
  Payload ID: 15861
  Gene Symbol: SLX4IP
  Gene Name: SLX4 interacting protein
  ENSP ID: ENSP00000432784
  MOD_RES (1)..(1): Any amino acid
XYGFQITAYFLKRGIRLRCIRSTQNAELCVFPDRFVVCVSQLAFSRDLLASQNEDLDNQSTIACFLLPEGRGKSTLHN

SEQ ID NO: 79641 - protein, 1834 aa, Homo sapiens
  Payload ID: 15862
  Gene Symbol: SLX4
  Gene Name: SLX4 structure-specific endonuclease subunit
  Uniprot ID: Q8IY92
  ENSP ID: ENSP00000294008
MKLSVNEAQLGFYLGSLSHLSACPGIDPRSSEDQPESLKTGQMMDESDEDFKELCASFFQRVKKHGIKEVSGERKTQKAASNGTQIRSKLKRTKQTATKTKTLQGPAEKKPPSGSQAPRTKKQRVTKWQASEPAHSVNGEGGVLASAPDPPVLRETAQNTQTGNQQEPSPNLSREKTRENVPNSDSQPPPSCLTTAVPSPSKPRTAQLVLQRMQQFKRADPERLRHASEECSLEAAREENVPKDPQEEMMAGNVYGLGPPAPESDAAVALTLQQEFARVGASAHDDSLEEKGLFFCQICQKNLSAMNVTRREQHVNRCLDEAEKTLRPSVPQIPECPICGKPFLTLKSRTSHLKQCAVKMEVGPQLLLQAVRLQTAQPEGSSSPPMFSFSDHSRGLKRRGPTSKKEPRKRRKVDEAPSEDLLVAMALSRSEMEPGAAVPALRLESAFSERIRPEAENKSRKKKPPVSPPLLLVQDSETTGRQIEDRVALLLSEEVELSSTPPLPASRILKEGWERAGQCPPPPERKQSFLWEGSALTGAWAMEDFYTARLVPPLVPQRPAQGLMQEPVPPLVPPEHSELSERRSPALHGTPTAGCGSRGPSPSASQREHQALQDLVDLAREGLSASPWPGSGGLAGSEGTAGLDVVPGGLPLTGFVVPSQDKHPDRGGRTLLSLGLLVADFGAMVNNPHLSDVQFQTDSGEVLYAHKFVLYARCPLLIQYVNNEGFSAVEDGVLTQRVLLGDVSTEAARTFLHYLYTADTGLPPGLSSELSSLAHRFGVSELVHLCEQVPIATDSEGKPWEEKEAENCESRAENFQELLRSMWADEEEEAETLLKSKDHEEDQENVNEAEMEEIYEFAATQRKLLQEERAAGAGEDADWLEGGSPVSGQLLAGVQVQKQWDKVEEMEPLEPGRDEAATTWEKMGQCALPPPQGQHSGARGAEAPEQEAPEEALGHSSCSSPSRDCQAERKEGSLPHSDDAGDYEQLFSSTQGEISEPSQITSEPEEQSGAVRERGLEVSHRLAPWQASPPHPCRFLLGPPQGGSPRGSHHTSGSSLSTPRSRGGTSQVGSPTLLSPAVPSKQKRDRSILTLSKEPGHQKGKERRSVLECRNKGVLMFPEKSPSIDLTQSNPDHSSSRSQKSSSKLNEEDEVILLLDSDEELELEQTKMKSISSDPLEEKKALEISPRSCELFSIIDVDADQEPSQSPPRSEAVLQQEDEGALPENRGSLGRRGAPWLFCDRESSPSEASTTDTSWLVPATPLASRSRDCSSQTQISSLRSGLAVQAVTQHTPRASVGNREGNEVAQKFSVIRPQTPPPQTPSSCLTPVSPGTSDGRRQGHRSPSRPHPGGHPHSSPLAPHPISGDRAHFSRRFLKHSPPGPSFLNQTPAGEVVEVGDSDDEQEVASHQANRSPPLDSDPPIPIDDCCWHMEPLSPIPIDHWNLERTGPLSTSSPSRRMNEAADSRDCRSPGLLDTTPIRGSCTTQRKLQEKSSGAGSLGNSRPSFLNSALWDVWDGEEQRPPETPPPAQMPSAGGAQKPEGLETPKGANRKKNLPPKVPITPMPQYSIMETPVLKKELDRFGVRPLPKRQMVLKLKEIFQYTHQTLDSDSEDESQSSQPLLQAPHCQTLASQTYKPSRAGVHAQQEATTGPGAHRPKGPAKTKGPRHQRKHHESITPPSRSPTKEAPPGLNDDAQIPASQESVATSVDGSDSSLSSQSSSSCEFGAAFESAGEEEGEGEVSASQAAVQAADTDEALRCYIRSKPALYQKVLLYQPFELRELQAELRQNGLRVSSRRLLDFLDTHCITFTTAATRREKLQGRRRQPRGKKKVERN

SEQ ID NO: 79642 - protein, 465 aa, Homo sapiens
  Payload ID: 15863
  Gene Symbol: SMAD1
  Gene Name: SMAD family member 1
  Uniprot ID: Q15797
  ENSP ID: ENSP00000305769
MNVTSLFSFTSPAVKRLLGWKQGDEEEKWAEKAVDALVKKLKKKKGAMEELEKALSCPGQPSNCVTIPRSLDGRLQVSHRKGLPHVIYCRVWRWPDLQSHHELKPLECCEFPFGSKQKEVCINPYHYKRVESPVLPPVLVPRHSEYNPQHSLLAQFRNLGQNEPHMPLNATFPDSFQQPNSHPFPHSPNSSYPNSPGSSSSTYPHSPTSSDPGSPFQMPADTPPPAYLPPEDPMTQDGSQPMDTNMMAPPLPSEINRGDVQAVAYEEPKHWCSIVYYELNNRVGEAFHASSTSVLVDGFTDPSNNKNRFCLGLLSNVNRNSTIENTRRHIGKGVHLYYVGGEVYAECLSDSSIFVQSRNCNYHHGFHPTTVCKIPSGCSLKIFNNQEFAQLLAQSVNHGFETVYELTKMCTIRMSFVKGWGAEYHRQDVTSTPCWIEIHLHGPLQWLDKVLTQMGSPHNPISSVS

SEQ ID NO: 79643 - protein, 465 aa, Homo sapiens; identical to SEQ ID NO: 79642
  Payload ID: 15863
  Gene Symbol: SMAD1
  Gene Name: SMAD family member 1
  Uniprot ID: Q15797
  ENSP ID: ENSP00000377652

SEQ ID NO: 79644 - protein, 10 aa, Homo sapiens
  Payload ID: 15863
  Gene Symbol: SMAD1
  Gene Name: SMAD family member 1
  ENSP ID: ENSP00000421601
MNVTSLFSFT

SEQ ID NO: 79645 - protein, 58 aa, Homo sapiens
  Payload ID: 15863
  Gene Symbol: SMAD1
  Gene Name: SMAD family member 1
  ENSP ID: ENSP00000422706
MNVTSLFSFTSPAVKRLLGWKQGDEEEKWAEKAVDALVKKLKKKKGAMEELEKALSCP

SEQ ID NO: 79646 - protein, 95 aa, Homo sapiens
  Payload ID: 15863
  Gene Symbol: SMAD1
  Gene Name: SMAD family member 1
  ENSP ID: ENSP00000424649
MNVTSLFSFTSPAVKRLLGWKQGDEEEKWAEKAVDALVKKLKKKKGAMEELEKALSCPGQPSNCVTIPRSLDGRLQVSHRKGLPHVIYCRVWRWP

SEQ ID NO: 79647 - protein, 106 aa, Homo sapiens
  Payload ID: 15863
  Gene Symbol: SMAD1
  Gene Name: SMAD family member 1
  ENSP ID: ENSP00000424959
MNVTSLFSFTSPAVKRLLGWKQGDEEEKWAEKAVDALVKKLKKKKGAMEELEKALSCPGQPSNCVTIPRSLDGRLQVSHRKGLPHVIYCRVWRWPDLQSHHELKPL

SEQ ID NO: 79648 - protein, 112 aa, Homo sapiens
  Payload ID: 15863
  Gene Symbol: SMAD1
  Gene Name: SMAD family member 1
  ENSP ID: ENSP00000425270
MNVTSLFSFTSPAVKRLLGWKQGDEEEKWAEKAVDALVKKLKKKKGAMEELEKALSCPGQPSNCVTIPRSLDGRLQVSHRKGLPHVIYCRVWRWPDLQSHHELKPLECCEFP

SEQ ID NO: 79649 - protein, 465 aa, Homo sapiens; identical to SEQ ID NO: 79642
  Payload ID: 15863
  Gene Symbol: SMAD1
  Gene Name: SMAD family member 1
  Uniprot ID: Q15797
  ENSP ID: ENSP00000426568

SEQ ID NO: 79650 - protein, 133 aa, Homo sapiens
  Payload ID: 15863
  Gene Symbol: SMAD1
  Gene Name: SMAD family member 1
  ENSP ID: ENSP00000427002
MNVTSLFSFTSPAVKRLLGWKQGDEEEKWAEKAVDALVKKLKKKKGAMEELEKALSCPGQPSNCVTIPRSLDGRLQVSHRKGLPHVIYCRVWRWPDLQSHHELKPLECCEFPFGSKQKEVCINPYHYKRVESP

SEQ ID NO: 79651 - protein, 467 aa, Homo sapiens
  Payload ID: 15864
  Gene Symbol: SMAD2
  Gene Name: SMAD family member 2
  Uniprot ID: Q15796
  ENSP ID: ENSP00000262160
MSSILPFTPPVVKRLLGWKKSAGGSGGAGGGEQNGQEEKWCEKAVKSLVKKLKKTGRLDELEKAITTQNCNTKCVTIPSTCSEIWGLSTPNTIDQWDTTGLYSFSEQTRSLDGRLQVSHRKGLPHVIYCRLWRWPDLHSHHELKAIENCEYAFNLKKDEVCVNPYHYQRVETPVLPPVLVPRHTEILTELPPLDDYTHSIPENTNFPAGIEPQSNYIPETPPPGYISEDGETSDQQLNQSMDTGSPAELSPTTLSPVNHSLDLQPVTYSEPAFWCSIAYYELNQRVGETFHASQPSLTVDGFTDPSNSERFCLGLLSNVNRNATVEMTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSVRCSSMS

SEQ ID NO: 79652 - protein, 437 aa, Homo sapiens
  Payload ID: 15864
  Gene Symbol: SMAD2
  Gene Name: SMAD family member 2
  Uniprot ID: Q15796
  ENSP ID: ENSP00000349282
MSSILPFTPPVVKRLLGWKKSAGGSGGAGGGEQNGQEEKWCEKAVKSLVKKLKKTGRLDELEKAITTQNCNTKCVTIPRSLDGRLQVSHRKGLPHVIYCRLWRWPDLHSHHELKAIENCEYAFNLKKDEVCVNPYHYQRVETPVLPPVLVPRHTEILTELPPLDDYTHSIPENTNFPAGIEPQSNYIPETPPPGYISEDGETSDQQLNQSMDTGSPAELSPTTLSPVNHSLDLQPVTYSEPAFWCSIAYYELNQRVGETFHASQPSLTVDGFTDPSNSERFCLGLLSNVNRNATVEMTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSVRCSSMS

SEQ ID NO: 79653 - protein, 467 aa, Homo sapiens; identical to SEQ ID NO: 79651
  Payload ID: 15864
  Gene Symbol: SMAD2
  Gene Name: SMAD family member 2
  Uniprot ID: Q15796
  ENSP ID: ENSP00000384449

SEQ ID NO: 79654 - protein, 217 aa, Homo sapiens
  Payload ID: 15864
  Gene Symbol: SMAD2
  Gene Name: SMAD family member 2
  ENSP ID: ENSP00000465355
MSSILPFTPPVVKRLLGWKKSAGGSGGAGGGEQNGQEEKWCEKAVKSLVKKLKKTGRLDELEKAITTQNCNTKCVTIPSTCSEIWGLSTPNTIDQWDTTGLYSFSEQTRSLDGRLQVSHRKGLPHVIYCRLWRWPDLHSHHELKAIENCEYAFNLKKDEVCVNPYHYQRVETPVLPPVLVPRHTEILTELPPLDDYTHSIPENTNFPAGIEPQSNYI

SEQ ID NO: 79655 - protein, 109 aa, Homo sapiens
  Payload ID: 15864
  Gene Symbol: SMAD2
  Gene Name: SMAD family member 2
  ENSP ID: ENSP00000465971
MSSILPFTPPVVKRLLGWKKSAGGSGGAGGGEQNGQEEKWCEKAVKSLVKKLKKTGRLDELEKAITTQNCNTKCVTIPSTCSEIWGLSTPNTIDQWDTTGLYSFSEQTR

SEQ ID NO: 79656 - protein, 437 aa, Homo sapiens; identical to SEQ ID NO: 79652
  Payload ID: 15864
  Gene Symbol: SMAD2
  Gene Name: SMAD family member 2
  Uniprot ID: Q15796
  ENSP ID: ENSP00000466193

SEQ ID NO: 79657 - protein, 217 aa, Homo sapiens; identical to SEQ ID NO: 79654
  Payload ID: 15864
  Gene Symbol: SMAD2
  Gene Name: SMAD family member 2
  ENSP ID: ENSP00000466254

SEQ ID NO: 79658 - protein, 431 aa, Homo sapiens
  Payload ID: 15864
  Gene Symbol: SMAD2
  Gene Name: SMAD family member 2
  ENSP ID: ENSP00000467075
MSSILPFTPPVVKRLLGWKKSAGGSGGAGGGEQNGQEEKWCEKAVKSLVKKLKKTGRLDELEKAITTQNCNTKCVTIPRSLDGRLQVSHRKGLPHVIYCRLWRWPDLHSHHELKAIENCEYAFNLKKDEVCVNPYHYQRVETPVLPPVLVPRHTEILTELPPLDDYTHSIPENTNFPAGIEPQSNYIPETPPPGYISEDGETSDQQLNQSMDTGSPAELSPTTLSPVNHSLDLQPVTYSEPAFWCSIAYYELNQRVGETFHASQPSLTVDGFTDPSNSERFCLGLLSNVNRNATVEMTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRYEIHIWFLNFHSVIMFHCILAYSGVHLYLFSMRL

SEQ ID NO: 79659 - protein, 137 aa, Homo sapiens
  Payload ID: 15864
  Gene Symbol: SMAD2
  Gene Name: SMAD family member 2
  ENSP ID: ENSP00000468202
MSSILPFTPPVVKRLLGWKKSAGGSGGAGGGEQNGQEEKWCEKAVKSLVKKLKKTGRLDELEKAITTQNCNTKCVTIPSTCSEIWGLSTPNTIDQWDTTGLYSFSEQTRSLDGRLQVSHRKGLPHVIYCRLWRWPDL

SEQ ID NO: 79660 - protein, 108 aa, Homo sapiens
  Payload ID: 15864
  Gene Symbol: SMAD2
  Gene Name: SMAD family member 2
  ENSP ID: ENSP00000468732
MSSILPFTPPVVKRLLGWKKSAGGSGGAGGGEQNGQEEKWCEKAVKSLVKKLKKTGRLDELEKAITTQNCNTKCVTIPSTCSEIWGLSTPNTIDQWDTTGLYSFSEQT

SEQ ID NO: 79661 - protein, 425 aa, Homo sapiens
  Payload ID: 15865
  Gene Symbol: SMAD3
  Gene Name: SMAD family member 3
  Uniprot ID: P84022
  ENSP ID: ENSP00000332973
MSSILPFTPPIVKRLLGWKKGEQNGQEEKWCEKAVKSLVKKLKKTGQLDELEKAITTQNVNTKCITIPRSLDGRLQVSHRKGLPHVIYCRLWRWPDLHSHHELRAMELCEFAFNMKKDEVCVNPYHYQRVETPVLPPVLVPRHTEIPAEFPPLDDYSHSIPENTNFPAGIEPQSNIPETPPPGYLSEDGETSDHQMNHSMDAGSPNLSPNPMSPAHNNLDLQPVTYCEPAFWCSISYYELNQRVGETFHASQPSMTVDGFTDPSNSERFCLGLLSNVNRNAAVELTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 79662 - protein, 381 aa, Homo sapiens
  Payload ID: 15865
  Gene Symbol: SMAD3
  Gene Name: SMAD family member 3
  Uniprot ID: P84022
  ENSP ID: ENSP00000401133
MSCLHPRQTWKGAALVHRKAWWMGRSLDGRLQVSHRKGLPHVIYCRLWRWPDLHSHHELRAMELCEFAFNMKKDEVCVNPYHYQRVETPVLPPVLVPRHTEIPAEFPPLDDYSHSIPENTNFPAGIEPQSNIPETPPPGYLSEDGETSDHQMNHSMDAGSPNLSPNPMSPAHNNLDLQPVTYCEPAFWCSISYYELNQRVGETFHASQPSMTVDGFTDPSNSERFCLGLLSNVNRNAAVELTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 79663 - protein, 320 aa, Homo sapiens
  Payload ID: 15865
  Gene Symbol: SMAD3
  Gene Name: SMAD family member 3
  Uniprot ID: P84022
  ENSP ID: ENSP00000437757
MELCEFAFNMKKDEVCVNPYHYQRVETPVLPPVLVPRHTEIPAEFPPLDDYSHSIPENTNFPAGIEPQSNIPETPPPGYLSEDGETSDHQMNHSMDAGSPNLSPNPMSPAHNNLDLQPVTYCEPAFWCSISYYELNQRVGETFHASQPSMTVDGFTDPSNSERFCLGLLSNVNRNAAVELTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 79664 - protein, 230 aa, Homo sapiens
  Payload ID: 15865
  Gene Symbol: SMAD3
  Gene Name: SMAD family member 3
  Uniprot ID: P84022
  ENSP ID: ENSP00000445348
MNHSMDAGSPNLSPNPMSPAHNNLDLQPVTYCEPAFWCSISYYELNQRVGETFHASQPSMTVDGFTDPSNSERFCLGLLSNVNRNAAVELTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 79665 - protein, 112 aa, Homo sapiens
  Payload ID: 15865
  Gene Symbol: SMAD3
  Gene Name: SMAD family member 3
  ENSP ID: ENSP00000452767
MNHSMDAGSPNLSPNPMSPAHNNLDLQPVTYCEPAFWCSISYYELNQRVGETFHASQPSMTVDGFTDPSNSERFCLGLLSNVNRNAAVELTRRHIGRGVRLYYIGGEVFAEC

SEQ ID NO: 79666 - protein, 92 aa, Homo sapiens
  Payload ID: 15865
  Gene Symbol: SMAD3
  Gene Name: SMAD family member 3
  ENSP ID: ENSP00000453082
MELCEFAFNMKKDEVCVNPYHYQRVETPVLPPVLVPRHTEIPAEFPPLDDYSHSIPENTNFPAGIEPQSNIPETPPPGYLSEDGETSDHQMN

SEQ ID NO: 79667 - protein, 63 aa, Homo sapiens
  Payload ID: 15865
  Gene Symbol: SMAD3
  Gene Name: SMAD family member 3
  ENSP ID: ENSP00000453684
MELCEFAFNMKKDEVCVNPYHYQRVETPVLPPVLVPRHTEIPAEFPPLDDYSHSIPENTNFPA

SEQ ID NO: 79668 - protein, 96 aa, Homo sapiens
  Payload ID: 15865
  Gene Symbol: SMAD3
  Gene Name: SMAD family member 3
  ENSP ID: ENSP00000453788
MGGWTPFLRGPVWRRVRQPMEMGQCSEMLHKCGLLPQTVDRAYVLSEDQLCPWMAGCRCPIGRGSLMSSTAACGDGQTCTATTSYGPWSCVSSPSI

SEQ ID NO: 79669 - protein, 84 aa, Homo sapiens
  Payload ID: 15865
  Gene Symbol: SMAD3
  Gene Name: SMAD family member 3
  ENSP ID: ENSP00000454165
MNHSMDAGSPNLSPNPMSPAHNNLDLQPVTYCEPAFWCSISYYELNQRVGETFHASQPSMTVDGFTDPSNSERFCLGLLSNVNR

SEQ ID NO: 79670 - protein, 114 aa, Homo sapiens
  Payload ID: 15865
  Gene Symbol: SMAD3
  Gene Name: SMAD family member 3
  ENSP ID: ENSP00000455095
MELCEFAFNMKKDEVCVNPYHYQRVETPVLPPVLVPRHTEIPAEFPPLDDYSHSIPENTNFPAGIEPQSNIPETPPPGYLSEDGETSDHQMNHSMDAGSPNLSPNPMSPAHNNL

SEQ ID NO: 79671 - protein, 156 aa, Homo sapiens
  Payload ID: 15865
  Gene Symbol: SMAD3
  Gene Name: SMAD family member 3
  ENSP ID: ENSP00000455540
  MOD_RES (1)..(1): Any amino acid
XLSDSAIFVQSPNCNQRYGWHPATVCKIPPGKAPLSTPSPYFWKPSLQTSPCSGSRSLWASLPSPLAGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 79672 - protein, 213 aa, Homo sapiens
  Payload ID: 15865
  Gene Symbol: SMAD3
  Gene Name: SMAD family member 3
  ENSP ID: ENSP00000458060
MELCEFAFNMKKDEVCVNPYHYQRVETPVLPPVLVPRHTEIPAEFPPLDDYSHSIPENTNFPAGIEPQSNIPETPPPGYLSEDGETSDHQMNHSMDAGSPNLSPNPMSPAHNNLDLQPVTYCEPAFWCSISYYELNQRVGETFHASQPSMTVDGFTDPSNSERFCLGLLSNVNRNAAVELTRRHIGCNLKIFNNQEFAALLAQSVNQGFEAVY

SEQ ID NO: 79673 - protein, 552 aa, Homo sapiens
  Payload ID: 15866
  Gene Symbol: SMAD4
  Gene Name: SMAD family member 4
  Uniprot ID: Q13485
  ENSP ID: ENSP00000341551
MDNMSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDSVCVNPYHYERVVSPGIDLSGLTLQSNAPSSMMVKDEYVHDFEGQPSLSTEGHSIQTIQHPPSNRASTETYSTPALLAPSESNATSTANFPNIPVASTSQPASILGGSHSEGLLQIASGPQPGQQQNGFTGQPATYHHNSTTTWTGSRTAPYTPNLPHHQNGHLQHHPPMPPHPGHYWPVHNELAFQPPISNHPAPEYWCSIAYFEMDVQVGETFKVPSSCPIVTVDGYVDPSGGDRFCLGQLSNVHRTEAIERARLHIGKGVQLECKGEGDVWVRCLSDHAVFVQSYYLDREAGRAPGDAVHKIYPSAYIKVFDLRQCHRQMQQQAATAQAAAAAQAAAVAGNIPGPGSVGGIAPAISLSAAAGIGVDDLRRLCILRMSFVKGWGPDYPRQSIKETPCWIEIHLHRALQLLDEVLHTMPIADPQPLD

SEQ ID NO: 79674 - protein, 552 aa, Homo sapiens; identical to SEQ ID NO: 79673
  Payload ID: 15866
  Gene Symbol: SMAD4
  Gene Name: SMAD family member 4
  Uniprot ID: Q13485
  ENSP ID: ENSP00000381452

SEQ ID NO: 79675 - protein, 140 aa, Homo sapiens
  Payload ID: 15866
  Gene Symbol: SMAD4
  Gene Name: SMAD family member 4
  ENSP ID: ENSP00000464772
MDNMSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDSVCVNPYHYERVVSPG

SEQ ID NO: 79676 - protein, 456 aa, Homo sapiens
  Payload ID: 15866
  Gene Symbol: SMAD4
  Gene Name: SMAD family member 4
  ENSP ID: ENSP00000464901
MDNMSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDSVCVNPYHYERVVSPGIDLSGLTLQSNAPSSMMVKDEYVHDFEGQPSLSTEGHSIQTIQHPPSNRASTETYSTPALLAPSESNATSTANFPNIPVASTTPEYWCSIAYFEMDVQVGETFKVPSSCPIVTVDGYVDPSGGDRFCLGQLSNVHRTEAIERARLHIGKGVQLECKGEGDVWVRCLSDHAVFVQSYYLDREAGRAPGDAVHKIYPSAYIKVFDLRQCHRQMQQQAATAQAAAAAQAAAVAGNIPGPGSVGGIAPAISLSAAAGIGVDDLRRLCILRMSFVKGWGPDYPRQSIKETPCWIEIHLHRALQLLDEVLHTMPIADPQPLD

SEQ ID NO: 79677 - protein, 120 aa, Homo sapiens
  Payload ID: 15866
  Gene Symbol: SMAD4
  Gene Name: SMAD family member 4
  ENSP ID: ENSP00000465874
MDNMSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFD

SEQ ID NO: 79678 - protein, 126 aa, Homo sapiens
  Payload ID: 15866
  Gene Symbol: SMAD4
  Gene Name: SMAD family member 4
  ENSP ID: ENSP00000465878
MDNMSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDSV

SEQ ID NO: 79679 - protein, 82 aa, Homo sapiens
  Payload ID: 15866
  Gene Symbol: SMAD4
  Gene Name: SMAD family member 4
  ENSP ID: ENSP00000466118
YYLDREAGRAPGDAVHKIYPSAYIKVFDLRQCHRQMQQQAATAQAAAAAQAAAVAGNIPGPGSVGGIAPAISKYAFHSFLKV

SEQ ID NO: 79680 - protein, 90 aa, Homo sapiens
  Payload ID: 15866
  Gene Symbol: SMAD4
  Gene Name: SMAD family member 4
  ENSP ID: ENSP00000466934
MDNMSITNTPTSNDACLSIVHSLMCHRQGGESETFAKRAIESLVKKLKEKKDELDSLITAITTNGAHPSKCVTIQRTLDGRLQVAGRKGF

SEQ ID NO: 79681 - protein, 151 aa, Homo sapiens
  Payload ID: 15866
  Gene Symbol: SMAD4
  Gene Name: SMAD family member 4
  ENSP ID: ENSP00000466941
MDNMSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDSVCVNPYHYERVVSPGIDLSGLTLQSN

SEQ ID NO: 79682 - protein, 320 aa, Homo sapiens
  Payload ID: 15866
  Gene Symbol: SMAD4
  Gene Name: SMAD family member 4
  ENSP ID: ENSP00000468611
MDNMSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDSVCVNPYHYERVVSPGIDLSGLTLQSNAPSSMMVKDEYVHDFEGQPSLSTEGHSIQTIQHPPSNRASTETYSTPALLAPSESNATSTANFPNIPVASTSQPASILGGSHSEGLLQIASGPQPGQQQNGFTGQPATYHHNSTTTWTGSRTAPYTPNLPHHQNGHLQHHPPMPPHPGHYWPVHNELAFQPPISNHPGL

SEQ ID NO: 79683 - protein, 220 aa, Homo sapiens
  Payload ID: 15866
  Gene Symbol: SMAD4
  Gene Name: SMAD family member 4
  ENSP ID: ENSP00000478613
  MOD_RES (1)..(1): Any amino acid
XWTGSRTAPYTPNLPHHQNGHLQHHPPMPPHPGHYWPVHNELAFQPPISNHPAPEYWCSIAYFEMDVQVGETFKVPSSCPIVTVDGYVDPSGGDRFCLGQLSNVHRTEAIERARLHIGKGVQLECKGEGDVWVRCLSDHAVFVQSYYLDREAGRAPGDAVHKIYPSAYIKVFDLRQCHRQMQQQAATAQAAAAAQAAAVAGNIPGPGSVGGIAPAIKLNS

SEQ ID NO: 79684 - protein, 80 aa, Homo sapiens
  Payload ID: 15867
  Gene Symbol: SMAD5
  Gene Name: SMAD family member 5
  ENSP ID: ENSP00000422954
MTSMASLFSFTSPAVKRLLGWKQGDEEEKWAEKAVDALVKKLKKKKGAMEELEKALSSPGQPSKCVTIPRSLDGRLQVSH

SEQ ID NO: 79685 - protein, 134 aa, Homo sapiens
  Payload ID: 15867
  Gene Symbol: SMAD5
  Gene Name: SMAD family member 5
  ENSP ID: ENSP00000424279
MTSMASLFSFTSPAVKRLLGWKQGDEEEKWAEKAVDALVKKLKKKKGAMEELEKALSSPGQPSKCVTIPRSLDGRLQVSHRKGLPHVIYCRVWRWPDLQSHHELKPLDICEFPFGSKQKEVCINPYHYKRVESP

SEQ ID NO: 79686 - protein, 128 aa, Homo sapiens
  Payload ID: 15867
  Gene Symbol: SMAD5
  Gene Name: SMAD family member 5
  ENSP ID: ENSP00000425749
MTSMASLFSFTSPAVKRLLGWKQGDEEEKWAEKAVDALVKKLKKKKGAMEELEKALSSPGQPSKCVTIPRSLDGRLQVSHRKGLPHVIYCRVWRWPDLQSHHELKPLDICEFPFGSKQKEVCINPYHY

SEQ ID NO: 79687 - protein, 1 aa, Homo sapiens
  Payload ID: 15867
  Gene Symbol: SMAD5
  Gene Name: SMAD family member 5
  ENSP ID: ENSP00000426696
M

SEQ ID NO: 79688 - protein, 1 aa, Homo sapiens
  Payload ID: 15867
  Gene Symbol: SMAD5
  Gene Name: SMAD family member 5
  ENSP ID: ENSP00000427330
M

SEQ ID NO: 79689 - protein, 174 aa, Homo sapiens
  Payload ID: 15867
  Gene Symbol: SMAD5
  Gene Name: SMAD family member 5
  ENSP ID: ENSP00000427474
  MOD_RES (1)..(1): Any amino acid
XQPNNTPFPLSPNSPYPPSPASSTYPNSPASSGPGSPFQLPADTPPPAYMPPDDQMGQDNSQPMDTSNNMIPQIMPSISSRDVQPVAYEEPKHWCSIVYYELNNRVGEAFHASSTSVLVDGFTDPSNNKSRFCLGLLSNVNRNSTIENTRRHIGKGNLVIFLHLIEFNHLLYLP

SEQ ID NO: 79690 - protein, 60 aa, Homo sapiens
  Payload ID: 15867
  Gene Symbol: SMAD5
  Gene Name: SMAD family member 5
  ENSP ID: ENSP00000427650
  MOD_RES (1)..(1): Any amino acid
XGFHPTTVCKIPSSCSLKIFNNQEFAQLLAQSVNHGFEAVYELTKMCTIRMSFVKSLQEI

SEQ ID NO: 79691 - protein, 465 aa, Homo sapiens
  Payload ID: 15867
  Gene Symbol: SMAD5
  Gene Name: SMAD family member 5
  Uniprot ID: Q99717
  ENSP ID: ENSP00000441954
MTSMASLFSFTSPAVKRLLGWKQGDEEEKWAEKAVDALVKKLKKKKGAMEELEKALSSPGQPSKCVTIPRSLDGRLQVSHRKGLPHVIYCRVWRWPDLQSHHELKPLDICEFPFGSKQKEVCINPYHYKRVESPVLPPVLVPRHNEFNPQHSLLVQFRNLSHNEPHMPQNATFPDSFHQPNNTPFPLSPNSPYPPSPASSTYPNSPASSGPGSPFQLPADTPPPAYMPPDDQMGQDNSQPMDTSNNMIPQIMPSISSRDVQPVAYEEPKHWCSIVYYELNNRVGEAFHASSTSVLVDGFTDPSNNKSRFCLGLLSNVNRNSTIENTRRHIGKGVHLYYVGGEVYAECLSDSSIFVQSRNCNFHHGFHPTTVCKIPSSCSLKIFNNQEFAQLLAQSVNHGFEAVYELTKMCTIRMSFVKGWGAEYHRQDVTSTPCWIEIHLHGPLQWLDKVLTQMGSPLNPISSVS

SEQ ID NO: 79692 - protein, 465 aa, Homo sapiens; identical to SEQ ID NO: 79691
  Payload ID: 15867
  Gene Symbol: SMAD5
  Gene Name: SMAD family member 5
  Uniprot ID: Q99717
  ENSP ID: ENSP00000446474

SEQ ID NO: 79693 - protein, 496 aa, Homo sapiens
  Payload ID: 15868
  Gene Symbol: SMAD6
  Gene Name: SMAD family member 6
  Uniprot ID: O43541
  ENSP ID: ENSP00000288840
MFRSKRSGLVRRLWRSRVVPDREEGGSGGGGGGDEDGSLGSRAEPAPRAREGGGCGRSEVRPVAPRRPRDAVGQRGAQGAGRRRRAGGPPRPMSEPGAGAGSSLLDVAEPGGPGWLPESDCETVTCCLFSERDAAGAPRDASDPLAGAALEPAGGGRSREARSRLLLLEQELKTVTYSLLKRLKERSLDTLLEAVESRGGVPGGCVLVPRADLRLGGQPAPPQLLLGRLFRWPDLQHAVELKPLCGCHSFAAAADGPTVCCNPYHFSRLCGPESPPPPYSRLSPRDEYKPLDLSDSTLSYTETEATNSLITAPGEFSDASMSPDATKPSHWCSVAYWEHRTRVGRLYAVYDQAVSIFYDLPQGSGFCLGQLNLEQRSESVRRTRSKIGFGILLSKEPDGVWAYNRGEHPIFVNSPTLDAPGGRALVVRKVPPGYSIKVFDFERSGLQHAPEPDAADGPYDPNSVRISFAKGWGPCYSRQFITSCPCWLEILLNNPR

SEQ ID NO: 79694 - protein, 55 aa, Homo sapiens
  Payload ID: 15868
  Gene Symbol: SMAD6
  Gene Name: SMAD family member 6
  ENSP ID: ENSP00000452694
SPRDEYKPLDLSDSTLSYTETEATNSLITAPGEFSADAGIGSRGNRGLESSVPCS

SEQ ID NO: 79695 - protein, 338 aa, Homo sapiens
  Payload ID: 15868
  Gene Symbol: SMAD6
  Gene Name: SMAD family member 6
  Uniprot ID: O43541
  ENSP ID: ENSP00000452955
MFRSKRSGLVRRLWRSRVVPDREEGGSGGGGGGDEDGSLGSRAEPAPRAREGGGCGRSEVRPVAPRRPRDAVGQRGAQGAGRRRRAGGPPRPMSEPGAGAGSSLLDVAEPGGPGWLPESDCETVTCCLFSERDAAGAPRDASDPLAGAALEPAGGGRSREARSRLLLLEQELKTVTYSLLKRLKERSLDTLLEAVESRGGVPGGCVLVPRADLRLGGQPAPPQLLLGRLFRWPDLQHAVELKPLCGCHSFAAAADGPTVCCNPYHFSRLCGPESPPPPYSRLSPRDEYKPLDLSDSTLSYTETEATNSLITAPGEFSAADAGIGSRGNRGLESSVPCS

SEQ ID NO: 79696 - protein, 62 aa, Homo sapiens
  Payload ID: 15868
  Gene Symbol: SMAD6
  Gene Name: SMAD family member 6
  ENSP ID: ENSP00000453446
PPPYSRLSPRDEYKPLDLSDSTLSYTETEATNSLITAPGEFSADAGIGSRGNRGLESSVPCS

SEQ ID NO: 79697 - protein, 426 aa, Homo sapiens
  Payload ID: 15869
  Gene Symbol: SMAD7
  Gene Name: SMAD family member 7
  Uniprot ID: O15105
  ENSP ID: ENSP00000262158
MFRTKRSALVRRLWRSRAPGGEDEEEGAGGGGGGGELRGEGATDSRAHGAGGGGPGRAGCCLGKAVRGAKGHHHPHPPAAGAGAAGGAEADLKALTHSVLKKLKERQLELLLQAVESRGGTRTACLLLPGRLDCRLGPGAPAGAQPAQPPSSYSLPLLLCKVFRWPDLRHSSEVKRLCCCESYGKINPELVCCNPHHLSRLCELESPPPPYSRYPMDFLKPTADCPDAVPSSAETGGTNYLAPGGLSDSQLLLEPGDRSHWCVVAYWEEKTRVGRLYCVQEPSLDIFYDLPQGNGFCLGQLNSDNKSQLVQKVRSKIGCGIQLTREVDGVWVYNRSSYPIFIKSATLDNPDSRTLLVHKVFPGFSIKAFDYEKAYSLQRPNDHEFMQQPWTGFTVQISFVKGWGQCYTRQFISSCPCWLEVIFNSR

SEQ ID NO: 79698 - protein, 158 aa, Homo sapiens
  Payload ID: 15869
  Gene Symbol: SMAD7
  Gene Name: SMAD family member 7
  ENSP ID: ENSP00000465590
MDFLKPTADCPDAVPSSAETGGTNYLAPGGLSDSQLLLEPGDRSHWCVVAYWEEKTRVGRLYCVQEPSLDIFYDLPQGNGFCLGQLNSDNKSQLVQKVRSKIGCGIQLTREVDGVWVYNRSSYPIFIKSATLDNPDSRTLLVHKVFPGFSIKAFDYEK

SEQ ID NO: 79699 - protein, 211 aa, Homo sapiens
  Payload ID: 15869
  Gene Symbol: SMAD7
  Gene Name: SMAD family member 7
  Uniprot ID: O15105
  ENSP ID: ENSP00000466902
MDFLKPTADCPDAVPSSAETGGTNYLAPGGLSDSQLLLEPGDRSHWCVVAYWEEKTRVGRLYCVQEPSLDIFYDLPQGNGFCLGQLNSDNKSQLVQKVRSKIGCGIQLTREVDGVWVYNRSSYPIFIKSATLDNPDSRTLLVHKVFPGFSIKAFDYEKAYSLQRPNDHEFMQQPWTGFTVQISFVKGWGQCYTRQFISSCPCWLEVIFNSR

SEQ ID NO: 79700 - protein, 425 aa, Homo sapiens
  Payload ID: 15869
  Gene Symbol: SMAD7
  Gene Name: SMAD family member 7
  Uniprot ID: O15105
  ENSP ID: ENSP00000467621
MFRTKRSALVRRLWRSRAPGGEDEEEGAGGGGGGGELRGEGATDSRAHGAGGGGPGRAGCCLGKAVRGAKGHHHPHPPAAGAGAAGGAEADLKALTHSVLKKLKERQLELLLQAVESRGGTRTACLLLPGRLDCRLGPGAPAGAQPAQPPSSYSLPLLLCKVFRWPDLRHSSEVKRLCCCESYGKINPELVCCNPHHLSRLCELESPPPPYSRYPMDFLKPTDCPDAVPSSAETGGTNYLAPGGLSDSQLLLEPGDRSHWCVVAYWEEKTRVGRLYCVQEPSLDIFYDLPQGNGFCLGQLNSDNKSQLVQKVRSKIGCGIQLTREVDGVWVYNRSSYPIFIKSATLDNPDSRTLLVHKVFPGFSIKAFDYEKAYSLQRPNDHEFMQQPWTGFTVQISFVKGWGQCYTRQFISSCPCWLEVIFNSR

SEQ ID NO: 79701 - protein, 430 aa, Homo sapiens
  Payload ID: 15870
  Gene Symbol: SMAD9
  Gene Name: SMAD family member 9
  Uniprot ID: O15198
  ENSP ID: ENSP00000239885
MHSTTPISSLFSFTSPAVKRLLGWKQGDEEEKWAEKAVDSLVKKLKKKKGAMDELERALSCPGQPSKCVTIPRSLDGRLQVSHRKGLPHVIYCRVWRWPDLQSHHELKPLECCEFPFGSKQKEVCINPYHYRRVETPVLPPVLVPRHSEYNPQLSLLAKFRSASLHSEPLMPHNATYPDSFQQPPCSALPPSPSHAFSQSPCTASYPHSPGSPSEPESPYQHSDFRPVCYEEPQHWCSVAYYELNNRVGETFQASSRSVLIDGFTDPSNNRNRFCLGLLSNVNRNSTIENTRRHIGKGVHLYYVGGEVYAECVSDSSIFVQSRNCNYQHGFHPATVCKIPSGCSLKVFNNQLFAQLLAQSVHHGFEVVYELTKMCTIRMSFVKGWGAEYHRQDVTSTPCWIEIHLHGPLQWLDKVLTQMGSPHNPISSVS

SEQ ID NO: 79702 - protein, 467 aa, Homo sapiens
  Payload ID: 15870
  Gene Symbol: SMAD9
  Gene Name: SMAD family member 9
  Uniprot ID: O15198
  ENSP ID: ENSP00000369154
MHSTTPISSLFSFTSPAVKRLLGWKQGDEEEKWAEKAVDSLVKKLKKKKGAMDELERALSCPGQPSKCVTIPRSLDGRLQVSHRKGLPHVIYCRVWRWPDLQSHHELKPLECCEFPFGSKQKEVCINPYHYRRVETPVLPPVLVPRHSEYNPQLSLLAKFRSASLHSEPLMPHNATYPDSFQQPPCSALPPSPSHAFSQSPCTASYPHSPGSPSEPESPYQHSVDTPPLPYHATEASETQSGQPVDATADRHVVLSIPNGDFRPVCYEEPQHWCSVAYYELNNRVGETFQASSRSVLIDGFTDPSNNRNRFCLGLLSNVNRNSTIENTRRHIGKGVHLYYVGGEVYAECVSDSSIFVQSRNCNYQHGFHPATVCKIPSGCSLKVFNNQLFAQLLAQSVHHGFEVVYELTKMCTIRMSFVKGWGAEYHRQDVTSTPCWIEIHLHGPLQWLDKVLTQMGSPHNPISSVS

SEQ ID NO: 79703 - protein, 467 aa, Homo sapiens; identical to SEQ ID NO: 79702
  Payload ID: 15870
  Gene Symbol: SMAD9
  Gene Name: SMAD family member 9
  Uniprot ID: O15198
  ENSP ID: ENSP00000382216

SEQ ID NO: 79704 - protein, 396 aa, Homo sapiens
  Payload ID: 15871
  Gene Symbol: SNIP1
  Gene Name: Smad nuclear interacting protein 1
  Uniprot ID: Q8TAD8
  ENSP ID: ENSP00000296215
MKAVKSERERGSRRRHRDGDVVLPAGVVVKQERLSPEVAPPAHRRPDHSGGSPSPPTSEPARSGHRGNRARGVSRSPPKKKNKASGRRSKSPRSKRNRSPHHSTVKVKQEREDHPRRGREDRQHREPSEQEHRRARNSDRDRHRGHSHQRRTSNERPGSGQGQGRDRDTQNLQAQEEEREFYNARRREHRQRNDVGGGGSESQELVPRPGGNNKEKEVPAKEKPSFELSGALLEDTNTFRGVVIKYSEPPEARIPKKRWRLYPFKNDEVLPVMYIHRQSAYLLGRHRRIADIPIDHPSCSKQHAVFQYRLVEYTRADGTVGRRVKPYIIDLGSGNGTFLNNKRIEPQRYYELKEKDVLKFGFSSREYVLLHESSDTSEIDRKDDEDEEEEEEVSDS

SEQ ID NO: 79705 - protein, 757 aa, Homo sapiens
  Payload ID: 15872
  Gene Symbol: SMURF1
  Gene Name: SMAD specific E3 ubiquitin protein ligase 1
  Uniprot ID: Q9HCE7
  ENSP ID: ENSP00000354621
MSNPGTRRNGSSIKIRLTVLCAKNLAKKDFFRLPDPFAKIVVDGSGQCHSTDTVKNTLDPKWNQHYDLYVGKTDSITISVWNHKKIHKKQGAGFLGCVRLLSNAISRLKDTGYQRLDLCKLNPSDTDAVRGQIVVSLQTRDRIGTGGSVVDCRGLLENEGTVYEDSGPGRPLSCFMEEPAPYTDSTGAAAGGGNCRFVESPSQDQRLQAQRLRNPDVRGSLQTPQNRPHGHQSPELPEGYEQRTTVQGQVYFLHTQTGVSTWHDPRIPSPSGTIPGGDAAFLYEFLLQGHTSEPRDLNSVNCDELGPLPPGWEVRSTVSGRIYFVDHNNRTTQFTDPRLHHIMNHQCQLKEPSQPLPLPSEGSLEDEELPAQRYERDLVQKLKVLRHELSLQQPQAGHCRIEVSREEIFEESYRQIMKMRPKDLKKRLMVKFRGEEGLDYGGVAREWLYLLCHEMLNPYYGLFQYSTDNIYMLQINPDSSINPDHLSYFHFVGRIMGLAVFHGHYINGGFTVPFYKQLLGKPIQLSDLESVDPELHKSLVWILENDITPVLDHTFCVEHNAFGRILQHELKPNGRNVPVTEENKKEYVRLYVNWRFMRGIEAQFLALQKGFNELIPQHLLKPFDQKELELIIGGLDKIDLNDWKSNTRLKHCVADSNIVRWFWQAVETFDEERRARLLQFVTGSTRVPLQGFKALQGSTGAAGPRLFTIHLIDANTDNLPKAHTCFNRIDIPPYESYEKLYEKLLTAVEETCGFAVE

SEQ ID NO: 79706 - protein, 731 aa, Homo sapiens
  Payload ID: 15872
  Gene Symbol: SMURF1
  Gene Name: SMAD specific E3 ubiquitin protein ligase 1
  Uniprot ID: Q9HCE7
  ENSP ID: ENSP00000355326
MSNPGTRRNGSSIKIRLTVLCAKNLAKKDFFRLPDPFAKIVVDGSGQCHSTDTVKNTLDPKWNQHYDLYVGKTDSITISVWNHKKIHKKQGAGFLGCVRLLSNAISRLKDTGYQRLDLCKLNPSDTDAVRGQIVVSLQTRDRIGTGGSVVDCRGLLENEGTVYEDSGPGRPLSCFMEEPAPYTDSTGAAAGGGNCRFVESPSQDQRLQAQRLRNPDVRGSLQTPQNRPHGHQSPELPEGYEQRTTVQGQVYFLHTQTGVSTWHDPRIPRDLNSVNCDELGPLPPGWEVRSTVSGRIYFVDHNNRTTQFTDPRLHHIMNHQCQLKEPSQPLPLPSEGSLEDEELPAQRYERDLVQKLKVLRHELSLQQPQAGHCRIEVSREEIFEESYRQIMKMRPKDLKKRLMVKFRGEEGLDYGGVAREWLYLLCHEMLNPYYGLFQYSTDNIYMLQINPDSSINPDHLSYFHFVGRIMGLAVFHGHYINGGFTVPFYKQLLGKPIQLSDLESVDPELHKSLVWILENDITPVLDHTFCVEHNAFGRILQHELKPNGRNVPVTEENKKEYVRLYVNWRFMRGIEAQFLALQKGFNELIPQHLLKPFDQKELELIIGGLDKIDLNDWKSNTRLKHCVADSNIVRWFWQAVETFDEERRARLLQFVTGSTRVPLQGFKALQGSTGAAGPRLFTIHLIDANTDNLPKAHTCFNRIDIPPYESYEKLYEKLLTAVEETCGFAVE

SEQ ID NO: 79707 - protein, 748 aa, Homo sapiens
  Payload ID: 15873
  Gene Symbol: SMURF2
  Gene Name: SMAD specific E3 ubiquitin protein ligase 2
  Uniprot ID: Q9HAU4
  ENSP ID: ENSP00000262435
MSNPGGRRNGPVKLRLTVLCAKNLVKKDFFRLPDPFAKVVVDGSGQCHSTDTVKNTLDPKWNQHYDLYIGKSDSVTISVWNHKKIHKKQGAGFLGCVRLLSNAINRLKDTGYQRLDLCKLGPNDNDTVRGQIVVSLQSRDRIGTGGQVVDCSRLFDNDLPDGWEERRTASGRIQYLNHITRTTQWERPTRPASEYSSPGRPLSCFVDENTPISGTNGATCGQSSDPRLAERRVRSQRHRNYMSRTHLHTPPDLPEGYEQRTTQQGQVYFLHTQTGVSTWHDPRVPRDLSNINCEELGPLPPGWEIRNTATGRVYFVDHNNRTTQFTDPRLSANLHLVLNRQNQLKDQQQQQVVSLCPDDTECLTVPRYKRDLVQKLKILRQELSQQQPQAGHCRIEVSREEIFEESYRQVMKMRPKDLWKRLMIKFRGEEGLDYGGVAREWLYLLSHEMLNPYYGLFQYSRDDIYTLQINPDSAVNPEHLSYFHFVGRIMGMAVFHGHYIDGGFTLPFYKQLLGKSITLDDMELVDPDLHNSLVWILENDITGVLDHTFCVEHNAYGEIIQHELKPNGKSIPVNEENKKEYVRLYVNWRFLRGIEAQFLALQKGFNEVIPQHLLKTFDEKELELIICGLGKIDVNDWKVNTRLKHCTPDSNIVKWFWKAVEFFDEERRARLLQFVTGSSRVPLQGFKALQGAAGPRLFTIHQIDACTNNLPKAHTCFNRIDIPPYESYEKLYEKLLTAIEETCGFAVE

SEQ ID NO: 79708 - protein, 55 aa, Homo sapiens
  Payload ID: 15873
  Gene Symbol: SMURF2
  Gene Name: SMAD specific E3 ubiquitin protein ligase 2
  ENSP ID: ENSP00000463531
MSNPGGRRNGPVKLRLTGLPDPFAKVVVDGSGQCHSTDTVKNTLDPKWNQHYDLQ

SEQ ID NO: 79709 - protein, 561 aa, Homo sapiens
  Payload ID: 15873
  Gene Symbol: SMURF2
  Gene Name: SMAD specific E3 ubiquitin protein ligase 2
  ENSP ID: ENSP00000463804
MSNPGGRRNGPVKLRLTGLPDPFAKVVVDGSGQCHSTDTVKNTLDPKWNQHYDLYIGKSDSVTISVWNHKKIHKKQGAGFLGCVRLLSNAINRLKDTGYQRLDLCKLGPNDNDTVRGQIVVSLQSRDRIGTGGQVVDCSRLFDNDLPDGWEERRTASGRIQYLNHITRTTQWERPTRPASEYSSPGRPLSCFVDENTPISGTNGATCGQSSDPRLAERRVRSQRHRNYMSRTHLHTPPDLPEGYEQRTTQQGQVYFLHTQTGVSTWHDPRVPRDLSNINCEELGPLPPGWEIRNTATGRVYFVDHNNRTTQFTDPRLSANLHLVLNRQNQLKDQQQQQVVSLCPDDTECLTVPRYKRDLVQKLKILRQELSQQQPQAGHCRIEVSREEIFEESYRQVMKMRPKDLWKRLMIKFRGEEGLDYGGVAREWLYLLSHEMLNPYYGLFQYSRDDIYTLQINPDSAVNPEHLSYFHFVGRIMGMAVFHGHYIDGGFTLPFYKQLLGKSITLDDMELVDPDLHNSLVWILENDITGVLDHTFCVEHNAYGEIIQHELKPNGKSIPVN

SEQ ID NO: 79710 - protein, 68 aa, Homo sapiens
  Payload ID: 15873
  Gene Symbol: SMURF2
  Gene Name: SMAD specific E3 ubiquitin protein ligase 2
  ENSP ID: ENSP00000464432
MSNPGGRRNGPVKLRLTVLCAKNLVKKDFFRLPDPFAKVVVDGSGQCHSTDTVKNTLDPKWNQHYDLQ

SEQ ID NO: 79711 - protein, 440 aa, Homo sapiens
  Payload ID: 15874
  Gene Symbol: SMAP1
  Gene Name: small ArfGAP 1
  Uniprot ID: Q8IYB5
  ENSP ID: ENSP00000313382
MATRSCREKAQKLNEQHQLILSKLLREEDNKYCADCEAKGPRWASWNIGVFICIRCAGIHRNLGVHISRVKSVNLDQWTAEQIQCMQDMGNTKARLLYEANLPENFRRPQTDQAVEFFIRDKYEKKKYYDKNAIAITNKEKEKKKEEKKREKEPEKPAKPLTAEKLQKKDQQLEPKKSTSPKKAAEPTVDLLGLDGPAVAPVTNGNTTVPPLNDDLDIFGPMISNPLPATVMPPAQGTPSAPAAATLSTVTSGDLDLFTEQTTKSEEVAKKQLSKDSILSLYGTGTIQQQSTPGVFMGPTNIPFTSQAPAAFQGFPSMGVPVPAAPGLIGNVMGQSPSMMVGMPMPNGFMGNAQTGVMPLPQNVVGPQGGMVGQMGAPQSKFGLPQAQQPQWSLSQMNQQMAGMSISSATPTAGFGQPSSTTAGWSGSSSGQTLSTQLWK

SEQ ID NO: 79712 - protein, 436 aa, Homo sapiens
  Payload ID: 15874
  Gene Symbol: SMAP1
  Gene Name: small ArfGAP 1
  Uniprot ID: Q8IYB5
  ENSP ID: ENSP00000359481
MATRSCREKAQKLNEQHQLILSKLLREEDNKYCADCEAKGPRWASWNIGVFICIRCAGIHRNLGVHISRVKSVNLDQWTAEQIQCMQDMGNTKARLLYEANLPENFRRPQTDQAVEFFIRDKYEKKKYYDKNAIAITNKEKEKKKEEKKREKEPEKPAKPLTAEKLQKKDQQLEPKKSTSPKKAAEPTVDLLGLDGPAVAPVTNGNTTVPPLNDDLDIFGPMISNPLPATVMPPAQGTPSAPAAATLSTVTSGDLDLFTEQTTKSEEVAKKQLSKDSILSLYGTGTIQQQSTPGVFMGPTNIPFTSQAPAAFQGFPSMGVPVPAAPGLIGNVMGQSPSMMVGMPMPNGFMGNAQTGVMPLPQNVVGPQGGMVGQMGAPQSKFGLPQAQQPQWSLSQIMQKGDAVLQHSISAIYWPMTRWLKCPLVDESADGWHEYQ

SEQ ID NO: 79713 - protein, 467 aa, Homo sapiens
  Payload ID: 15874
  Gene Symbol: SMAP1
  Gene Name: small ArfGAP 1
  Uniprot ID: Q8IYB5
  ENSP ID: ENSP00000359484
MATRSCREKAQKLNEQHQLILSKLLREEDNKYCADCEAKGPRWASWNIGVFICIRCAGIHRNLGVHISRVKSVNLDQWTAEQIQCMQDMGNTKARLLYEANLPENFRRPQTDQAVEFFIRDKYEKKKYYDKNAIAITNISSSDAPLQPLVSSPSLQAAVDKNKLEKEKEKKKEEKKREKEPEKPAKPLTAEKLQKKDQQLEPKKSTSPKKAAEPTVDLLGLDGPAVAPVTNGNTTVPPLNDDLDIFGPMISNPLPATVMPPAQGTPSAPAAATLSTVTSGDLDLFTEQTTKSEEVAKKQLSKDSILSLYGTGTIQQQSTPGVFMGPTNIPFTSQAPAAFQGFPSMGVPVPAAPGLIGNVMGQSPSMMVGMPMPNGFMGNAQTGVMPLPQNVVGPQGGMVGQMGAPQSKFGLPQAQQPQWSLSQMNQQMAGMSISSATPTAGFGQPSSTTAGWSGSSSGQTLSTQLWK

SEQ ID NO: 79714 - protein, 125 aa, Homo sapiens
  Payload ID: 15874
  Gene Symbol: SMAP1
  Gene Name: small ArfGAP 1
  ENSP ID: ENSP00000398306
  MOD_RES (1)..(1): Any amino acid
XKYYDKNAIAITNISSSDAPLQPLVSSPSLQAAVDKNKLEKEKEKKKEEKKREKEPEKPAKPLTAEKLQKKDQQLEPKKSTSPKKAAEPTVDLLGLVWRKIEKEKSERQLVEVEELTFMYCFPKN

SEQ ID NO: 79715 - protein, 62 aa, Homo sapiens
  Payload ID: 15874
  Gene Symbol: SMAP1
  Gene Name: small ArfGAP 1
  ENSP ID: ENSP00000415426
MLFLKLSVFRAVEFFIRDKYEKKKYYDKNAIAITNISSSDAPLQPLVSSPSLQAAVDKNKLE

SEQ ID NO: 79716 - protein, 457 aa, Homo sapiens
  Payload ID: 15874
  Gene Symbol: SMAP1
  Gene Name: small ArfGAP 1
  ENSP ID: ENSP00000484538
MEPYLPAHLTAFVQGFYLCFLKKSMVVFFGPRWASWNIGVFICIRCAGIHRNLGVHISRVKSVNLDQWTAEQIQCMQDMGNTKARLLYEANLPENFRRPQTDQAVEFFIRDKYEKKKYYDKNAIAITNISSSDAPLQPLVSSPSLQAAVDKNKLEKEKEKKKEEKKREKEPEKPAKPLTAEKLQKKDQQLEPKKSTSPKKAAEPTVDLLGLDGPAVAPVTNGNTTVPPLNDDLDIFGPMISNPLPATVMPPAQGTPSAPAAATLSTVTSGDLDLFTEQTTKSEEVAKKQLSKDSILSLYGTGTIQQQSTPGVFMGPTNIPFTSQAPAAFQGFPSMGVPVPAAPGLIGNVMGQSPSMMVGMPMPNGFMGNAQTGVMPLPQNVVGPQGGMVGQMGAPQSKFGLPQAQQPQWSLSQMNQQMAGMSISSATPTAGFGQPSSTTAGWSGSSSGQTLSTQLWK

SEQ ID NO: 79717 - protein, 399 aa, Homo sapiens
  Payload ID: 15875
  Gene Symbol: SMAP2
  Gene Name: small ArfGAP2
  Uniprot ID: Q8WU79
  ENSP ID: ENSP00000361793
MIFKGPRWASWNIGVFICIRCAGIHRNLGVHISRVKSVNLDQWTQEQIQCMQEMGNGKANRLYEAYLPETFRRPQIDPAVEGFIRDKYEKKKYMDRSLDINAFRKEKDDKWKRGSEPVPEKKLEPVVFEKVKMPQKKEDPQLPRKSSPKSTAPVMDLLGLDAPVACSIANSKTSNTLEKDLDLLASVPSPSSSGSRKVVGSMPTAGSAGSVPENLNLFPEPGSKSEEIGKKQLSKDSILSLYGSQTPQMPTQAMFMAPAQMAYPTAYPSFPGVTPPNSIMGSMMPPPVGMVAQPGASGMVAPMAMPAGYMGGMQASMMGVPNGMMTTQQAGYMAGMAAMPQTVYGVQPAQQLQWNLTQMTQQMAGMNFYGANGMMNYGQSMSGGNGQAANQTLSPQMWK

SEQ ID NO: 79718 - protein, 429 aa, Homo sapiens
  Payload ID: 15875
  Gene Symbol: SMAP2
  Gene Name: small ArfGAP2
  Uniprot ID: Q8WU79
  ENSP ID: ENSP00000361803
MTGKSVKDVDRYQAVLANLLLEEDNKFCADCQSKGPRWASWNIGVFICIRCAGIHRNLGVHISRVKSVNLDQWTQEQIQCMQEMGNGKANRLYEAYLPETFRRPQIDPAVEGFIRDKYEKKKYMDRSLDINAFRKEKDDKWKRGSEPVPEKKLEPVVFEKVKMPQKKEDPQLPRKSSPKSTAPVMDLLGLDAPVACSIANSKTSNTLEKDLDLLASVPSPSSSGSRKVVGSMPTAGSAGSVPENLNLFPEPGSKSEEIGKKQLSKDSILSLYGSQTPQMPTQAMFMAPAQMAYPTAYPSFPGVTPPNSIMGSMMPPPVGMVAQPGASGMVAPMAMPAGYMGGMQASMMGVPNGMMTTQQAGYMAGMAAMPQTVYGVQPAQQLQWNLTQMTQQMAGMNFYGANGMMNYGQSMSGGNGQAANQTLSPQMWK

SEQ ID NO: 79719 - protein, 174 aa, Homo sapiens
  Payload ID: 15875
  Gene Symbol: SMAP2
  Gene Name: small ArfGAP2
  ENSP ID: ENSP00000389895
MWKPMEHSQRRRQDFEIYGPRWASWNIGVFICIRCAGIHRNLGVHISRVKSVNLDQWTQEQIQCMQEMGNGKANRLYEAYLPETFRRPQIDPAVEGFIRDKYEKKKYMDRSLDINAFRKEKDDKWKRGSEPVPEKKLEPVVFEKVKMPQKKEDPQLPRKSSPKSTAPVMDLLGL

SEQ ID NO: 79720 - protein, 349 aa, Homo sapiens
  Payload ID: 15875
  Gene Symbol: SMAP2
  Gene Name: small ArfGAP2
  Uniprot ID: Q8WU79
  ENSP ID: ENSP00000442835
MQEMGNGKANRLYEAYLPETFRRPQIDPAVEGFIRDKYEKKKYMDRSLDINAFRKEKDDKWKRGSEPVPEKKLEPVVFEKVKMPQKKEDPQLPRKSSPKSTAPVMDLLGLDAPVACSIANSKTSNTLEKDLDLLASVPSPSSSGSRKVVGSMPTAGSAGSVPENLNLFPEPGSKSEEIGKKQLSKDSILSLYGSQTPQMPTQAMFMAPAQMAYPTAYPSFPGVTPPNSIMGSMMPPPVGMVAQPGASGMVAPMAMPAGYMGGMQASMMGVPNGMMTTQQAGYMAGMAAMPQTVYGVQPAQQLQWNLTQMTQQMAGMNFYGANGMMNYGQSMSGGNGQAANQTLSPQMWK

SEQ ID NO: 79721 - protein, 424 aa, Homo sapiens
  Payload ID: 15875
  Gene Symbol: SMAP2
  Gene Name: small ArfGAP2
  ENSP ID: ENSP00000479285
MGKVGRARFAQKDVLQIEEIGPVKLFVRDWPRWASWNIGVFICIRCAGIHRNLGVHISRVKSVNLDQWTQEQIQCMQEMGNGKANRLYEAYLPETFRRPQIDPAVEGFIRDKYEKKKYMDRSLDINAFRKEKDDKWKRGSEPVPEKKLEPVVFEKVKMPQKKEDPQLPRKSSPKSTAPVMDLLGLDAPVACSIANSKTSNTLEKDLDLLASVPSPSSSGSRKVVGSMPTAGSAGSVPENLNLFPEPGSKSEEIGKKQLSKDSILSLYGSQTPQMPTQAMFMAPAQMAYPTAYPSFPGVTPPNSIMGSMMPPPVGMVAQPGASGMVAPMAMPAGYMGGMQASMMGVPNGMMTTQQAGYMAGMAAMPQTVYGVQPAQQLQWNLTQMTQQMAGMNFYGANGMMNYGQSMSGGNGQAANQTLSPQMWK

SEQ ID NO: 79722 - protein, 37 aa, Homo sapiens
  Payload ID: 15876
  Gene Symbol: SMAGP
  Gene Name: small cell adhesion glycoprotein
  ENSP ID: ENSP00000369446
MTSLLTTPSPRGSHSVTQTRVQWHNHSSLQPGPPGLQ

SEQ ID NO: 79723 - protein, 97 aa, Homo sapiens
  Payload ID: 15876
  Gene Symbol: SMAGP
  Gene Name: small cell adhesion glycoprotein
  Uniprot ID: Q0VAQ4
  ENSP ID: ENSP00000381471
MTSLLTTPSPREELMTTPILQPTEALSPEDGASTALIAVVITVVFLTLLSVVILIFFYLYKNKGSYVTYEPTEGEPSAIVQMESDLAKGSEKEEYFI

SEQ ID NO: 79724 - protein, 50 aa, Homo sapiens
  Payload ID: 15876
  Gene Symbol: SMAGP
  Gene Name: small cell adhesion glycoprotein
  ENSP ID: ENSP00000474212
MTSLLTTPSPREELMTTPILQPTEALSPEDGASTALIAVVITVVFLTLLS

SEQ ID NO: 79725 - protein, 42 aa, Homo sapiens
  Payload ID: 15876
  Gene Symbol: SMAGP
  Gene Name: small cell adhesion glycoprotein
  ENSP ID: ENSP00000474426
MTSLLTTPSPREELMTTPILQPTEALSPEDGASTALIAGNRL

SEQ ID NO: 79726 - protein, 97 aa, Homo sapiens; identical to SEQ ID NO: 79723
  Payload ID: 15876
  Gene Symbol: SMAGP
  Gene Name: small cell adhesion glycoprotein
  Uniprot ID: Q0VAQ4
  ENSP ID: ENSP00000474892

SEQ ID NO: 79727 - protein, 42 aa, Homo sapiens; identical to SEQ ID NO: 79725
  Payload ID: 15876
  Gene Symbol: SMAGP
  Gene Name: small cell adhesion glycoprotein
  ENSP ID: ENSP00000474930

SEQ ID NO: 79728 - protein, 97 aa, Homo sapiens; identical to SEQ ID NO: 79723
  Payload ID: 15876
  Gene Symbol: SMAGP
  Gene Name: small cell adhesion glycoprotein
  Uniprot ID: Q0VAQ4
  ENSP ID: ENSP00000475068

SEQ ID NO: 79729 - protein, 83 aa, Homo sapiens
  Payload ID: 15876
  Gene Symbol: SMAGP
  Gene Name: small cell adhesion glycoprotein
  ENSP ID: ENSP00000475135
MTTPILQPTEALSPEDGASTALIAVVITVVFLTLLSVVILIFFYLYKNKGSYVTYEPTEGEPSAIVQMESDLAKGSEKEEYFI

SEQ ID NO: 79730 - protein, 62 aa, Homo sapiens
  Payload ID: 15877
  Gene Symbol: SERF1A
  Gene Name: small EDRK-rich factor 1A (telomeric)
  Uniprot ID: O75920
  ENSP ID: ENSP00000321791
MARGNQRELARQKNMKKTQEISKGKRKEDSLTASQRKQRDSEIMQEKQKAANEKKSMQTREK

SEQ ID NO: 79731 - protein, 110 aa, Homo sapiens
  Payload ID: 15877
  Gene Symbol: SERF1A
  Gene Name: small EDRK-rich factor 1A (telomeric)
  Uniprot ID: O75920
  ENSP ID: ENSP00000346892
MARGNQRELARQKNMKKTQEISKGKRKEDSLTASQRKQSSGGQKSESKMSAGPHLPLKAPRENPCFPLPAAGGSRYYLAYGSITPISAFVFVVFFSVFFPSFYEDFCCWI

SEQ ID NO: 79732 - protein, 81 aa, Homo sapiens
  Payload ID: 15877
  Gene Symbol: SERF1A
  Gene Name: small EDRK-rich factor 1A (telomeric)
  ENSP ID: ENSP00000422339
MARGNQRELARQKNMKKTQEISKGKRKEDSLTASQRKQSSGGQKSESKMSAGPHLPLKAPRENPCFPLPAAGGSRFHSNLG

SEQ ID NO: 79733 - protein, 75 aa, Homo sapiens
  Payload ID: 15877
  Gene Symbol: SERF1A
  Gene Name: small EDRK-rich factor 1A (telomeric)
  ENSP ID: ENSP00000426322
MARGNQRELARQKNMKKTQEISKGKRKEDSLTASQRKQRYGVLLCDPDWSAVPQSRFTASSASQAQVTLPPQPSE

SEQ ID NO: 79734 - protein, 48 aa, Homo sapiens
  Payload ID: 15877
  Gene Symbol: SERF1A
  Gene Name: small EDRK-rich factor 1A (telomeric)
  ENSP ID: ENSP00000428386
MKKTQEISKGKRKEDSLTASQRKQRDSEIMQEKQKAANEKKSMQTREK

SEQ ID NO: 79735 - protein, 20 aa, Homo sapiens
  Payload ID: 15877
  Gene Symbol: SERF1A
  Gene Name: small EDRK-rich factor 1A (telomeric)
  ENSP ID: ENSP00000429293
MKKTQEISKGKRKEDSLTAS

SEQ ID NO: 79736 - protein, 89 aa, Homo sapiens
  Payload ID: 15877
  Gene Symbol: SERF1A
  Gene Name: small EDRK-rich factor 1A (telomeric)
  ENSP ID: ENSP00000429748
MKKTQEISKGKRKEDSLTASQRKQSSGGQKSESKMSAGPHLPLKAPRENPCFPLPAAGGSRYYLAYGSITPISAFVFVVFFSVFFPSFY

SEQ ID NO: 79737 - protein, 96 aa, Homo sapiens
  Payload ID: 15877
  Gene Symbol: SERF1A
  Gene Name: small EDRK-rich factor 1A (telomeric)
  ENSP ID: ENSP00000430582
MKKTQEISKGKRKEDSLTASQRKQSSGGQKSESKMSAGPHLPLKAPRENPCFPLPAAGGSRYYLAYGSITPISAFVFVVFFSVFFPSFYEDFCCWI

SEQ ID NO: 79738 - protein, 110 aa, Homo sapiens; identical to SEQ ID NO: 79731
  Payload ID: 15877
  Gene Symbol: SERF1A
  Gene Name: small EDRK-rich factor 1A (telomeric)
  Uniprot ID: O75920
  ENSP ID: ENSP00000479724

SEQ ID NO: 79739 - protein, 48 aa, Homo sapiens; identical to SEQ ID NO: 79734
  Payload ID: 15877
  Gene Symbol: SERF1A
  Gene Name: small EDRK-rich factor 1A (telomeric)
  ENSP ID: ENSP00000482995

SEQ ID NO: 79740 - protein, 75 aa, Homo sapiens; identical to SEQ ID NO: 79733
  Payload ID: 15877
  Gene Symbol: SERF1A
  Gene Name: small EDRK-rich factor 1A (telomeric)
  ENSP ID: ENSP00000485774

SEQ ID NO: 79741 - protein, 48 aa, Homo sapiens; identical to SEQ ID NO: 79734
  Payload ID: 15877
  Gene Symbol: SERF1A
  Gene Name: small EDRK-rich factor 1A (telomeric)
  ENSP ID: ENSP00000486307

SEQ ID NO: 79742 - protein, 89 aa, Homo sapiens; identical to SEQ ID NO: 79736
  Payload ID: 15877
  Gene Symbol: SERF1A
  Gene Name: small EDRK-rich factor 1A (telomeric)
  ENSP ID: ENSP00000486813

SEQ ID NO: 79743 - protein, 96 aa, Homo sapiens; identical to SEQ ID NO: 79737
  Payload ID: 15877
  Gene Symbol: SERF1A
  Gene Name: small EDRK-rich factor 1A (telomeric)
  ENSP ID: ENSP00000487054

SEQ ID NO: 79744 - protein, 62 aa, Homo sapiens; identical to SEQ ID NO: 79730
  Payload ID: 15877
  Gene Symbol: SERF1A
  Gene Name: small EDRK-rich factor 1A (telomeric)
  Uniprot ID: O75920
  ENSP ID: ENSP00000487374

SEQ ID NO: 79745 - protein, 81 aa, Homo sapiens; identical to SEQ ID NO: 79732
  Payload ID: 15877
  Gene Symbol: SERF1A
  Gene Name: small EDRK-rich factor 1A (telomeric)
  ENSP ID: ENSP00000487461

SEQ ID NO: 79746 - protein, 110 aa, Homo sapiens; identical to SEQ ID NO: 79731
  Payload ID: 15877
  Gene Symbol: SERF1A
  Gene Name: small EDRK-rich factor 1A (telomeric)
  Uniprot ID: O75920
  ENSP ID: ENSP00000487531

SEQ ID NO: 79747 - protein, 110 aa, Homo sapiens; identical to SEQ ID NO: 79731
  Payload ID: 15878
  Gene Symbol: SERF1B
  Gene Name: small EDRK-rich factor 1B (centromeric)
  Uniprot ID: O75920
  ENSP ID: ENSP00000370126

SEQ ID NO: 79748 - protein, 62 aa, Homo sapiens; identical to SEQ ID NO: 79730
  Payload ID: 15878
  Gene Symbol: SERF1B
  Gene Name: small EDRK-rich factor 1B (centromeric)
  Uniprot ID: O75920
  ENSP ID: ENSP00000370127

SEQ ID NO: 79749 - protein, 81 aa, Homo sapiens; identical to SEQ ID NO: 79732
  Payload ID: 15878
  Gene Symbol: SERF1B
  Gene Name: small EDRK-rich factor 1B (centromeric)
  ENSP ID: ENSP00000421563

SEQ ID NO: 79750 - protein, 75 aa, Homo sapiens; identical to SEQ ID NO: 79733
  Payload ID: 15878
  Gene Symbol: SERF1B
  Gene Name: small EDRK-rich factor 1B (centromeric)
  ENSP ID: ENSP00000423882

SEQ ID NO: 79751 - protein, 96 aa, Homo sapiens; identical to SEQ ID NO: 79737
  Payload ID: 15878
  Gene Symbol: SERF1B
  Gene Name: small EDRK-rich factor 1B (centromeric)
  ENSP ID: ENSP00000427181

SEQ ID NO: 79752 - protein, 81 aa, Homo sapiens; identical to SEQ ID NO: 79732
  Payload ID: 15878
  Gene Symbol: SERF1B
  Gene Name: small EDRK-rich factor 1B (centromeric)
  ENSP ID: ENSP00000478335

SEQ ID NO: 79753 - protein, 96 aa, Homo sapiens; identical to SEQ ID NO: 79737
  Payload ID: 15878
  Gene Symbol: SERF1B
  Gene Name: small EDRK-rich factor 1B (centromeric)
  ENSP ID: ENSP00000479417

SEQ ID NO: 79754 - protein, 110 aa, Homo sapiens; identical to SEQ ID NO: 79731
  Payload ID: 15878
  Gene Symbol: SERF1B
  Gene Name: small EDRK-rich factor 1B (centromeric)
  Uniprot ID: O75920
  ENSP ID: ENSP00000480543

SEQ ID NO: 79755 - protein, 62 aa, Homo sapiens; identical to SEQ ID NO: 79730
  Payload ID: 15878
  Gene Symbol: SERF1B
  Gene Name: small EDRK-rich factor 1B (centromeric)
  Uniprot ID: O75920
  ENSP ID: ENSP00000481118

SEQ ID NO: 79756 - protein, 24 aa, Homo sapiens
  Payload ID: 15878
  Gene Symbol: SERF1B
  Gene Name: small EDRK-rich factor 1B (centromeric)
  ENSP ID: ENSP00000482045
MKKTQEISKGKRKEDSLTASQRKQ

SEQ ID NO: 79757 - protein, 62 aa, Homo sapiens; identical to SEQ ID NO: 79730
  Payload ID: 15878
  Gene Symbol: SERF1B
  Gene Name: small EDRK-rich factor 1B (centromeric)
  Uniprot ID: O75920
  ENSP ID: ENSP00000482392

SEQ ID NO: 79758 - protein, 48 aa, Homo sapiens; identical to SEQ ID NO: 79734
  Payload ID: 15878
  Gene Symbol: SERF1B
  Gene Name: small EDRK-rich factor 1B (centromeric)
  ENSP ID: ENSP00000483645

SEQ ID NO: 79759 - protein, 110 aa, Homo sapiens; identical to SEQ ID NO: 79731
  Payload ID: 15878
  Gene Symbol: SERF1B
  Gene Name: small EDRK-rich factor 1B (centromeric)
  Uniprot ID: O75920
  ENSP ID: ENSP00000484795

SEQ ID NO: 79760 - protein, 48 aa, Homo sapiens; identical to SEQ ID NO: 79734
  Payload ID: 15878
  Gene Symbol: SERF1B
  Gene Name: small EDRK-rich factor 1B (centromeric)
  ENSP ID: ENSP00000484864

SEQ ID NO: 79761 - protein, 75 aa, Homo sapiens; identical to SEQ ID NO: 79733
  Payload ID: 15878
  Gene Symbol: SERF1B
  Gene Name: small EDRK-rich factor 1B (centromeric)
  ENSP ID: ENSP00000484959

SEQ ID NO: 79762 - protein, 20 aa, Homo sapiens
  Payload ID: 15878
  Gene Symbol: SERF1B
  Gene Name: small EDRK-rich factor 1B (centromeric)
  ENSP ID: ENSP00000485822
MKKTQEISKGKRKEDSLTAS

SEQ ID NO: 79763 - protein, 81 aa, Homo sapiens; identical to SEQ ID NO: 79732
  Payload ID: 15878
  Gene Symbol: SERF1B
  Gene Name: small EDRK-rich factor 1B (centromeric)
  ENSP ID: ENSP00000485848

SEQ ID NO: 79764 - protein, 48 aa, Homo sapiens; identical to SEQ ID NO: 79734
  Payload ID: 15878
  Gene Symbol: SERF1B
  Gene Name: small EDRK-rich factor 1B (centromeric)
  ENSP ID: ENSP00000486174

SEQ ID NO: 79765 - protein, 75 aa, Homo sapiens; identical to SEQ ID NO: 79733
  Payload ID: 15878
  Gene Symbol: SERF1B
  Gene Name: small EDRK-rich factor 1B (centromeric)
  ENSP ID: ENSP00000486523

SEQ ID NO: 79766 - protein, 89 aa, Homo sapiens; identical to SEQ ID NO: 79736
  Payload ID: 15878
  Gene Symbol: SERF1B
  Gene Name: small EDRK-rich factor 1B (centromeric)
  ENSP ID: ENSP00000486741

SEQ ID NO: 79767 - protein, 96 aa, Homo sapiens; identical to SEQ ID NO: 79737
  Payload ID: 15878
  Gene Symbol: SERF1B
  Gene Name: small EDRK-rich factor 1B (centromeric)
  ENSP ID: ENSP00000487004

SEQ ID NO: 79768 - protein, 59 aa, Homo sapiens
  Payload ID: 15879
  Gene Symbol: SERF2
  Gene Name: small EDRK-rich factor 2
  Uniprot ID: P84101
  ENSP ID: ENSP00000249786
MTRGNQRELARQKNMKKQSDSVKGKRRDDGLSAAARKQRDSEIMQQKQKKANEKKEEPK

SEQ ID NO: 79769 - protein, 133 aa, Homo sapiens
  Payload ID: 15879
  Gene Symbol: SERF2
  Gene Name: small EDRK-rich factor 2
  Uniprot ID: P84101
  ENSP ID: ENSP00000339647
MTRGNQRELARQKNMKKQSDSVKGKRRDDGLSAAARKQSAPSSLPPGTRRSCSRSRKRQTRRRRNPSSFVASCPTLLPFACVPGASPTTLAFPPVVLTGPSTDGIPFALSLQRVPFVLPSPQVASLPLGHSRG

SEQ ID NO: 79770 - protein, 59 aa, Homo sapiens; identical to SEQ ID NO: 79768
  Payload ID: 15879
  Gene Symbol: SERF2
  Gene Name: small EDRK-rich factor 2
  Uniprot ID: P84101
  ENSP ID: ENSP00000370764

SEQ ID NO: 79771 - protein, 45 aa, Homo sapiens
  Payload ID: 15879
  Gene Symbol: SERF2
  Gene Name: small EDRK-rich factor 2
  Uniprot ID: P84101
  ENSP ID: ENSP00000384300
MKKQSDSVKGKRRDDGLSAAARKQRDSEIMQQKQKKANEKKEEPK

SEQ ID NO: 79772 - protein, 45 aa, Homo sapiens; identical to SEQ ID NO: 79771
  Payload ID: 15879
  Gene Symbol: SERF2
  Gene Name: small EDRK-rich factor 2
  Uniprot ID: P84101
  ENSP ID: ENSP00000386044

SEQ ID NO: 79773 - protein, 40 aa, Homo sapiens
  Payload ID: 15879
  Gene Symbol: SERF2
  Gene Name: small EDRK-rich factor 2
  ENSP ID: ENSP00000386290
MTRGNQRELARQKNMKKQSDSVKGKRRDDGLSAAARKQSF

SEQ ID NO: 79774 - protein, 83 aa, Homo sapiens
  Payload ID: 15879
  Gene Symbol: SERF2
  Gene Name: small EDRK-rich factor 2
  ENSP ID: ENSP00000386316
MTRGNQRELARQKNMKKQSDSVKGKRRDDGLSAAARKQRKYTQTYYAAVPAGWWGSGGGPATQPAAGGRWRFLHILGTQPQSH

SEQ ID NO: 79775 - protein, 45 aa, Homo sapiens; identical to SEQ ID NO: 79771
  Payload ID: 15879
  Gene Symbol: SERF2
  Gene Name: small EDRK-rich factor 2
  Uniprot ID: P84101
  ENSP ID: ENSP00000386783

SEQ ID NO: 79776 - protein, 42 aa, Homo sapiens
  Payload ID: 15879
  Gene Symbol: SERF2
  Gene Name: small EDRK-rich factor 2
  ENSP ID: ENSP00000387041
MKKQSDSVKGKRRDDGLSAAARKQRFCFKLIPAIWDCRPLTT

SEQ ID NO: 79777 - protein, 170 aa, Homo sapiens
  Payload ID: 15879
  Gene Symbol: SERF2
  Gene Name: small EDRK-rich factor 2
  Uniprot ID: P84101
  ENSP ID: ENSP00000387187
MTRGNQRELARQKNMKKQSDSVKGKRRDDGLSAAARKQRVGVQQPNAELSPIHFHLILCALHPPASCPFCPLVPPSAPSSLPPGTRRSCSRSRKRQTRRRRNPSSFVASCPTLLPFACVPGASPTTLAFPPVVLTGPSTDGIPFALSLQRVPFVLPSPQVASLPLGHSRG

SEQ ID NO: 79778 - protein, 108 aa, Homo sapiens
  Payload ID: 15879
  Gene Symbol: SERF2
  Gene Name: small EDRK-rich factor 2
  ENSP ID: ENSP00000391027
MTRGNQRELARQKNMKKQSDSVKGKRRDDGLSAAARKQSAITSSRNFLYPAYVYFPSSVPSPPRKYTQTYYAAVPAGWWGSGGGPATQPAAGGRWRFLHILGTQPQSH

SEQ ID NO: 79779 - protein, 71 aa, Homo sapiens
  Payload ID: 15879
  Gene Symbol: SERF2
  Gene Name: small EDRK-rich factor 2
  ENSP ID: ENSP00000394660
MKKQSDSVKGKRRDDGLSAAARKQSAITSSRNFLYPAYVYFPSSVPSPPRKYTQTYYAAVPAGWWGSGGGP

SEQ ID NO: 79780 - protein, 59 aa, Homo sapiens; identical to SEQ ID NO: 79768
  Payload ID: 15879
  Gene Symbol: SERF2
  Gene Name: small EDRK-rich factor 2
  Uniprot ID: P84101
  ENSP ID: ENSP00000400178

SEQ ID NO: 79781 - protein, 108 aa, Homo sapiens; identical to SEQ ID NO: 79778
  Payload ID: 15879
  Gene Symbol: SERF2
  Gene Name: small EDRK-rich factor 2
  ENSP ID: ENSP00000486542

SEQ ID NO: 79782 - protein, 1093 aa, Homo sapiens
  Payload ID: 15880
  Gene Symbol: SGSM1
  Gene Name: small G protein signaling modulator 1
  Uniprot ID: Q2NKQ1
  ENSP ID: ENSP00000383211
MASAPAEAETRQRLLRTVKKEVKQIMEEAVTRKFVHEDSSHIISFCAAVEACVLHGLRRRAAGFLRSNKIAALFMKVGKNFPPAEDLSRKVQDLEQLIESARNQIQGLQENVRKLPKLPNLSPLAIKHLWIRTALFEKVLDKIVHYLVENSSKYYEKEALLMDPVDGPILASLLVGPCALEYTKMKTADHFWTDPSADELVQRHRIHSSHVRQDSPTKRPALCIQKRHSSGSMDDRPSLSARDYVESLHQNSRATLLYGKNNVLVQPRDDMEAVPGYLSLHQTADVMTLKWTPNQLMNGSVGDLDYEKSVYWDYAMTIRLEEIVYLHCHQQVDSGGTVVLVSQDGIQRPPFRFPKGGHLLQFLSCLENGLLPHGQLDPPLWSQRGKGKVFPKLRKRSPQGSAESTSSDKDDDEATDYVFRIIYPGMQSEFVPQDLMDVSVSNLPSLWQPSPRKSSCSSCSQSGSADGSSTNGCNHERAPLKLLCDNMKYQILSRAFYGWLAYCRHLSTVRTHLSALVNHMIVSPDLPCDAGQGLTARIWEQYLHDSTSYEEQELLRLIYYGGIQPEIRKAVWPFLLGHYQFGMTETERKEVDEQIHACYAQTMAEWLGCEAIVRQRERESHAAALAKCSSGASLDSHLHRMLHRDSTISNESSQSCSSGRQNIRLHSDSSSSTQVFESVDEVEQVEAEGRLEEKQPKIPNGNLVNGTCSPDSGHPSSHNFSSGLSEHSEPSLSTEDSVLDAQRNTPTVLRPRDGSVDDRQSSEATTSQDEAPREELAVQDSLESDLLANESMDEFMSITGSLDMALPEKDDVVMEGWRSSETEKHGQADSEDNLSEEPEMESLFPALASLAVTTSANEVSPVSSSGVTYSPELLDLYTVNLHRIEKDVQRCDRNYWYFTPANLEKLRNIMCSYIWQHIEIGYVQGMCDLLAPLLVILDDEALAFSCFTELMKRMNQNFPHGGAMDTHFANMRSLIQILDSELFELMHQNGDYTHFYFCYRWFLLDFKRELVYDDVFLVWETIWAAKHVSSAHYVLFIALALVEVYRDIILENNMDFTDIIKFFNEMAERHNTKQVLKLARDLVYKVQTLIENK

SEQ ID NO: 79783 - protein, 1148 aa, Homo sapiens
  Payload ID: 15880
  Gene Symbol: SGSM1
  Gene Name: small G protein signaling modulator 1
  Uniprot ID: Q2NKQ1
  ENSP ID: ENSP00000383212
MASAPAEAETRQRLLRTVKKEVKQIMEEAVTRKFVHEDSSHIISFCAAVEACVLHGLRRRAAGFLRSNKIAALFMKVGKNFPPAEDLSRKVQDLEQLIESARNQIQGLQENVRKLPKLPNLSPLAIKHLWIRTALFEKVLDKIVHYLVENSSKYYEKEALLMDPVDGPILASLLVGPCALEYTKMKTADHFWTDPSADELVQRHRIHSSHVRQDSPTKRPALCIQKRHSSGSMDDRPSLSARDYVESLHQNSRATLLYGKNNVLVQPRDDMEAVPGYLSLHQTADVMTLKWTPNQLMNGSVGDLDYEKSVYWDYAMTIRLEEIVYLHCHQQVDSGGTVVLVSQDGIQRPPFRFPKGGHLLQFLSCLENGLLPHGQLDPPLWSQRGKGKVFPKLRKRSPQGSAESTSSDKDDDEATDYVFRIIYPGMQSEFVAPDFLGSTSSVSVGPAWMMVPAGRSMLVVARGSQWEPARWDTTLPTPSPKEQPPMPQDLMDVSVSNLPSLWQPSPRKSSCSSCSQSGSADGSSTNGCNHERAPLKLLCDNMKYQILSRAFYGWLAYCRHLSTVRTHLSALVNHMIVSPDLPCDAGQGLTARIWEQYLHDSTSYEEQELLRLIYYGGIQPEIRKAVWPFLLGHYQFGMTETERKEVDEQIHACYAQTMAEWLGCEAIVRQRERESHAAALAKCSSGASLDSHLHRMLHRDSTISNESSQSCSSGRQNIRLHSDSSSSTQVFESVDEVEQVEAEGRLEEKQPKIPNGNLVNGTCSPDSGHPSSHNFSSGLSEHSEPSLSTEDSVLDAQRNTPTVLRPRDGSVDDRQSSEATTSQDEAPREELAVQDSLESDLLANESMDEFMSITGSLDMALPEKDDVVMEGWRSSETEKHGQADSEDNLSEEPEMESLFPALASLAVTTSANEVSPVSSSGVTYSPELLDLYTVNLHRIEKDVQRCDRNYWYFTPANLEKLRNIMCSYIWQHIEIGYVQGMCDLLAPLLVILDDEALAFSCFTELMKRMNQNFPHGGAMDTHFANMRSLIQILDSELFELMHQNGDYTHFYFCYRWFLLDFKRELVYDDVFLVWETIWAAKHVSSAHYVLFIALALVEVYRDIILENNMDFTDIIKFFNEMAERHNTKQVLKLARDLVYKVQTLIENK

SEQ ID NO: 79784 - protein, 1087 aa, Homo sapiens
  Payload ID: 15880
  Gene Symbol: SGSM1
  Gene Name: small G protein signaling modulator 1
  ENSP ID: ENSP00000484682
MASAPAEAETRQRLLRTVKKEVKQIMEEAVTRKFVHEDSSHIISFCAAVEACVLHGLRRRAAGFLRSNKIAALFMKVGKNFPPAEDLSRKVQDLEQLIESARNQIQGLQENVRKLPKLPNLSPLAIKHLWIRTALFEKVLDKIVHYLVENSSKYYEKEALLMDPVDGPILASLLVGPCALEYTKMKTADHFWTDPSADELVQRHRIHSSHVRQDSPTKRPALCIQKRHSSGSMDDRPSLSARDYVESLHQNSRATLLYGKNNVLVQPRDDMEAVPGYLSLHQTADVMTLKWTPNQLMNGSVGDLDYEKSVYWDYAMTIRLEEIVYLHCHQQVDSGGTVVLVSQDGIQRPPFRFPKGGHLLQFLSCLENGLLPHGQLDPPLWSQRGKGKVFPKLRKRSPQGSAESTSSDKDDDEATDYVFRIIYPGMQSEFVAPDFLGSTSSVSVGPAWMMVPAGRSMLVVARGSQWEPARWDTTLPTPSPKEQPPMPQDLMDVSVSNLPSLWQPSPRKSSCSSCSQSGSADGSSTNGCNHERAPLKLLCDNMKYQILSRAFYGWLAYCRHLSTVRTHLSALVNHMIVSPDLPCDAGQGLTARIWEQYLHDSTSYEEQELLRLIYYGGIQPEIRKAVWPFLLGHYQFGMTETERKESSQSCSSGRQNIRLHSDSSSSTQVFESVDEVEQVEAEGRLEEKQPKIPNGNLVNGTCSPDSGHPSSHNFSSGLSEHSEPSLSTEDSVLDAQRNTPTVLRPRDGSVDDRQSSEATTSQDEAPREELAVQDSLESDLLANESMDEFMSITGSLDMALPEKDDVVMEGWRSSETEKHGQADSEDNLSEEPEMESLFPALASLAVTTSANEVSPVSSSGVTYSPELLDLYTVNLHRIEKDVQRCDRNYWYFTPANLEKLRNIMCSYIWQHIEIGYVQGMCDLLAPLLVILDDEALAFSCFTELMKRMNQNFPHGGAMDTHFANMRSLIQILDSELFELMHQNGDYTHFYFCYRWFLLDFKRELVYDDVFLVWETIWAAKHVSSAHYVLFIALALVEVYRDIILENNMDFTDIIKFFNEMAERHNTKQVLKLARDLVYKVQTLIENK

SEQ ID NO: 79785 - protein, 1051 aa, Homo sapiens
  Payload ID: 15881
  Gene Symbol: SGSM2
  Gene Name: small G protein signaling modulator 2
  Uniprot ID: O43147
  ENSP ID: ENSP00000268989
MGSAEDAVKEKLLWNVKKEVKQIMEEAVTRKFVHEDSSHIIALCGAVEACLLHQLRRRAAGFLRSDKMAALFTKVGKTCPVAGEICHKVQELQQQAEGRKPSGVSQEALRRQGSASGKAPALSPQALKHVWVRTALIEKVLDKVVQYLAENCSKYYEKEALLADPVFGPILASLLVGPCALEYTKLKTADHYWTDPSADELVQRHRIRGPPTRQDSPAKRPALGIRKRHSSGSASEDRLAACARECVESLHQNSRTRLLYGKNHVLVQPKEDMEAVPGYLSLHQSAESLTLKWTPNQLMNGTLGDSELEKSVYWDYALVVPFSQVVCIHCHQQKSGGTLVLVSQDGIQRPPLHFPQGGHLLSFLSCLENGLLPRGQLEPPLWTQQGKGKVFPKLRKRSSIRSVDMEEMGTGRATDYVFRIIYPGHRHEHITINYHHLAASRAASVDDDEEEEDKLHAMLSMICSRNLTAPNPMKDAGDMIEMQGFGPSLPAWHLEPLCSQGSSCLSCSSSSSPHATPSHCSCIPDRLPLRLLCESMKRQIVSRAFYGWLAHCRHLSTVRTHLSALVHHSVIPPDRPPGASAGLTKDVWSKYQKDKKNYKELELLRQVYYGGIEHEIRKDVWPFLLGHYKFGMSKKEMEQVDAVVAARYQQVLAEWKACEVVVRQREREAHPATRTKFSSGSSIDSHVQRLIHRDSTISNDVFISVDDLEPPEPQDPEDSRPKPEQEAGPGTPGTAVVEQQHSVEFDSPDSGLPSSRNYSVASGIQSSLDEGQSVGFEEEDGGGEEGSSGPGPAAHTLREPQDPSQEKPQAGELEAGEELAAVCAAAYTIELLDTVALNLHRIDKDVQRCDRNYWYFTPPNLERLRDVMCSYVWEHLDVGYVQGMCDLLAPLLVTLDNDQLAYSCFSHLMKRMSQNFPNGGAMDTHFANMRSLIQILDSELFELMHQNGDYTHFYFCYRWFLLDFKRELLYEDVFAVWEVIWAARHISSEHFVLFIALALVEAYREIIRDNNMDFTDIIKFFNERAEHHDAQEILRIARDLVHKVQMLIENK

SEQ ID NO: 79786 - protein, 1006 aa, Homo sapiens
  Payload ID: 15881
  Gene Symbol: SGSM2
  Gene Name: small G protein signaling modulator 2
  Uniprot ID: O43147
  ENSP ID: ENSP00000415107
MGSAEDAVKEKLLWNVKKEVKQIMEEAVTRKFVHEDSSHIIALCGAVEACLLHQLRRRAAGFLRSDKMAALFTKVGKTCPVAGEICHKVQELQQQAEGRKPSGVSQEALRRQGSASGKAPALSPQALKHVWVRTALIEKVLDKVVQYLAENCSKYYEKEALLADPVFGPILASLLVGPCALEYTKLKTADHYWTDPSADELVQRHRIRGPPTRQDSPAKRPALGIRKRHSSGSASEDRLAACARECVESLHQNSRTRLLYGKNHVLVQPKEDMEAVPGYLSLHQSAESLTLKWTPNQLMNGTLGDSELEKSVYWDYALVVPFSQVVCIHCHQQKSGGTLVLVSQDGIQRPPLHFPQGGHLLSFLSCLENGLLPRGQLEPPLWTQQGKGKVFPKLRKRSSIRSVDMEEMGTGRATDYVFRIIYPGHRHEHNAGDMIEMQGFGPSLPAWHLEPLCSQGSSCLSCSSSSSPHATPSHCSCIPDRLPLRLLCESMKRQIVSRAFYGWLAHCRHLSTVRTHLSALVHHSVIPPDRPPGASAGLTKDVWSKYQKDKKNYKELELLRQVYYGGIEHEIRKDVWPFLLGHYKFGMSKKEMEQVDAVVAARYQQVLAEWKACEVVVRQREREAHPATRTKFSSGSSIDSHVQRLIHRDSTISNDVFISVDDLEPPEPQDPEDSRPKPEQEAGPGTPGTAVVEQQHSVEFDSPDSGLPSSRNYSVASGIQSSLDEGQSVGFEEEDGGGEEGSSGPGPAAHTLREPQDPSQEKPQAGELEAGEELAAVCAAAYTIELLDTVALNLHRIDKDVQRCDRNYWYFTPPNLERLRDVMCSYVWEHLDVGYVQGMCDLLAPLLVTLDNDQLAYSCFSHLMKRMSQNFPNGGAMDTHFANMRSLIQILDSELFELMHQNGDYTHFYFCYRWFLLDFKRELLYEDVFAVWEVIWAARHISSEHFVLFIALALVEAYREIIRDNNMDFTDIIKFFNERAEHHDAQEILRIARDLVHKVQMLIENK

SEQ ID NO: 79787 - protein, 987 aa, Homo sapiens
  Payload ID: 15881
  Gene Symbol: SGSM2
  Gene Name: small G protein signaling modulator 2
  Uniprot ID: O43147
  ENSP ID: ENSP00000459126
MGSAEDAVKEKLLWNVKKEVKQIMEEAVTRKFVHEDSSHIIALCGAVEACLLHQLRRRAAGFLRSDKMAALFTKVGKTCPVAGEICHKVQELQQQAEGRKPSGVSQEALRRQGSASGKAPALSPQALKHVWVRTALIEKVLDKVVQYLAENCSKYYEKEALLADPVFGPILASLLVGPCALEYTKLKTADHYWTDPSADELVQRHRIRGPPTRQDSPAKRPALGIRKRHSSGSASEDRLAACARECVESLHQNSRTRLLYGKNHVLVQPKEDMEAVPGYLSLHQSAESLTLKWTPNQLMNGTLGDSELEKSVYWDYALVVPFSQVVCIHCHQQKSGGTLVLVSQDGIQRPPLHFPQGGHLLSFLSCLENGLLPRGQLEPPLWTQQGKGKVFPKLRKRSSIRSVDMEEMGTGRATDYVFRIIYPGHRHEHNAGDMIEMQGFGPSLPAWHLEPLCSQGSSCLSCSSSSSPHATPSHCSCIPDRLPLRLLCESMKRQIVSRAFYGWLAHCRHLSTVRTHLSALVHHSVIPPDRPPGASAGLTKDVWSKYQKDKKNYKELELLRQVYYGGIEHEIRKDVWPFLLGHYKFGMSKKEMEQVDAVVAARYQQVLAEWKACEVVVRQREREAHPATRTKFSSGSSIDSHVQRLIHRDSTISNDVFISVDDLEPPEPQDPEDSRPKPEQEAGPGTPGTAVVEQQHSVEFDSPDSGLPSSRNYSVASGIQSSLDEGQSVGFEEEDGGGEEGSSGPGPAAHTLREPQDPSQEKPQAGELEAGEELAAVCAAAYTIELLDTVALNLHRIDKDVQRCDRNYWYFTPPNLERLRDVMCSYVWEHLDVGYVQGMCDLLAPLLVTLDNDQLAYSCFSHLMKRMSQNFPNGGAMDTHFANMRSLIQILDSELFELMHQNGDYTHFYFCYRWFLLDFKRELLYEDVFAVWEVIWAARHISSEHFVLFIALALVEAYREIIRDNNMDFTDIIKFFNGTSLKTTCKK

SEQ ID NO: 79788 - protein, 29 aa, Homo sapiens
  Payload ID: 15881
  Gene Symbol: SGSM2
  Gene Name: small G protein signaling modulator 2
  ENSP ID: ENSP00000459218
MGSAEDAVKEKLLWNVKKEVQWRLASCIS

SEQ ID NO: 79789 - protein, 95 aa, Homo sapiens
  Payload ID: 15881
  Gene Symbol: SGSM2
  Gene Name: small G protein signaling modulator 2
  ENSP ID: ENSP00000460205
MEAVPGYLSLHQSAESLTLKWTPNQLMNGTLGDSELEKSVYWDYALVVPFSQVVCIHCHQQKSGGTLVLVSQDGIQRPPLHFPQGGHLLSFLSCL

SEQ ID NO: 79790 - protein, 36 aa, Homo sapiens
  Payload ID: 15881
  Gene Symbol: SGSM2
  Gene Name: small G protein signaling modulator 2
  ENSP ID: ENSP00000461820
  MOD_RES (1)..(1): Any amino acid
XMDFTDIIKFFNERAEHHDAQEILRIARDLVHKVLP

SEQ ID NO: 79791 - protein, 114 aa, Homo sapiens
  Payload ID: 15881
  Gene Symbol: SGSM2
  Gene Name: small G protein signaling modulator 2
  ENSP ID: ENSP00000464593
  MOD_RES (1)..(1): Any amino acid
XYFCYRWFLLDFKRELLYEDVFAVWEVIWAARHISSEHFVLFIALALVEAYREIIRDNNMDFTDIIKFFNGTSWSSHPGCPEQRCGGPHLCPAHSWRVLRNPGGPSPKAGMSRI

SEQ ID NO: 79792 - protein, 70 aa, Homo sapiens
  Payload ID: 15881
  Gene Symbol: SGSM2
  Gene Name: small G protein signaling modulator 2
  ENSP ID: ENSP00000476637
LQQQAEGRKPSGVSQEALRRQGSASGKAPALSPQALKHVWVRTALIEKVLDKVVQYLAENCSGTLCLGIH

SEQ ID NO: 79793 - protein, 316 aa, Homo sapiens
  Payload ID: 15881
  Gene Symbol: SGSM2
  Gene Name: small G protein signaling modulator 2
  ENSP ID: ENSP00000476800
MGSAEDAVKEKLLWNVKKEVKQIMEEAVTRKFVHEDSSHIIALCGAVEACLLHQLRRRAAGFLRSDKMAALFTKVGKTCPVAGEICHKVQELQQQAEGRKPSGVSQEALRRQGSASGKAPALSPQALKHVWVRTALIEKVLDKVVQYLAENCSKYYEKEALLADPVFGPILASLLGEPESTGTVGTGQVLREHRLGWLSLSPQWDPVPWNTLSSRQPITTGLTPLLMSWSSGTASGVHLLARTPLQSAQPWGSGNGTQAAARRRTGWLPVPASVWSPCTRTHGRGCSMARTTCWCSRRRIWRRSLATSPCTSLQRA

SEQ ID NO: 79794 - protein, 749 aa, Homo sapiens
  Payload ID: 15882
  Gene Symbol: SGSM3
  Gene Name: small G protein signaling modulator 3
  Uniprot ID: Q96HU1
  ENSP ID: ENSP00000248929
MSGSHTPACGPFSALTPSIWPQEILAKYTQKEESAEQPEFYYDEFGFRVYKEEGDEPGSSLLANSPLMEDAPQRLRWQAHLEFTHNHDVGDLTWDKIAVSLPRSEKLRSLVLAGIPHGMRPQLWMRLSGALQKKRNSELSYREIVKNSSNDETIAAKQIEKDLLRTMPSNACFASMGSIGVPRLRRVLRALAWLYPEIGYCQGTGMVAACLLLFLEEEDAFWMMSAIIEDLLPASYFSTTLLGVQTDQRVLRHLIVQYLPRLDKLLQEHDIELSLITLHWFLTAFASVVDIKLLLRIWDLFFYEGSRVLFQLTLGMLHLKEEELIQSENSASIFNTLSDIPSQMEDAELLLGVAMRLAGSLTDVAVETQRRKHLAYLIADQGQLLGAGTLTNLSQVVRRRTQRRKSTITALLFGEDDLEALKAKNIKQTELVADLREAILRVARHFQCTDPKNCSVELTPDYSMESHQRDHENYVACSRSHRRRAKALLDFERHDDDELGFRKNDIITIVSQKDEHCWVGELNGLRGWFPAKFVEVLDERSKEYSIAGDDSVTEGVTDLVRGTLCPALKALFEHGLKKPSLLGGACHPWLFIEEAAGREVERDFASVYSRLVLCKTFRLDEDGKVLTPEELLYRAVQSVNVTHDAVHAQMDVKLRSLICVGLNEQVLHLWLEVLCSSLPTVEKWYQPWSFLRSPGWVQIKCELRVLCCFAFSLSQDWELPAKREAQQPLKEGVRDMLVKHHLFSWDVDG

SEQ ID NO: 79795 - protein, 253 aa, Homo sapiens
  Payload ID: 15882
  Gene Symbol: SGSM3
  Gene Name: small G protein signaling modulator 3
  ENSP ID: ENSP00000399249
MEDAPQRLRWQAHLEFTHNHDVGDLTWDKIAVSLPRSEKLRSLVLAGIPHGMRPQLWMRLSGALQKKRNSELSYREIVKNSSNDETIAAKQIEKDLLRTMPSNACFASMGSIGVPRLRRVLRALAWLYPEIGYCQGTGMVAACLLLFLEEEDAFWMMSAIIEDLLPASYFSTTLLGVQTDQRVLRHLIVQYLPRLDKLLQEHDIELSLITLHWFLTAFASVVDIKLLLRIWDLFFYEGSRVLFQLTLGMLHLK

SEQ ID NO: 79796 - protein, 212 aa, Homo sapiens
  Payload ID: 15882
  Gene Symbol: SGSM3
  Gene Name: small G protein signaling modulator 3
  ENSP ID: ENSP00000407286
VTDLVRGTLCPALKALFEHGLKKPSLLGGACHPWLFIEEAAGREVERDFASVYSRLVLCKTFRLDEDGKVLTPEELLYRAVQSVNVTHDAVHAQMDVKLRSLICVGLNEQVLHLWLEVLCSSLPTVEKWYQPWSFLRSPGWVQIKCELRVLCCFAFSLSQDWELPAKREVGGVGLVGPALMELPKPFAGWLRWEPEVLVSAVRNYPSHAQGL

SEQ ID NO: 79797 - protein, 102 aa, Homo sapiens
  Payload ID: 15882
  Gene Symbol: SGSM3
  Gene Name: small G protein signaling modulator 3
  ENSP ID: ENSP00000415323
  MOD_RES (1)..(1): Any amino acid
XLDEDGKVLTPEELLYRAVQSVNVTHDAVHAQMDVKLRSLICVGLNPGWVQIKCELRVLCCFAFSLSQDWELPAKREAQQPLKEGVRDMLVKHHLFSWDVDG

SEQ ID NO: 79798 - protein, 313 aa, Homo sapiens
  Payload ID: 15883
  Gene Symbol: SGTA
  Gene Name: small glutamine-rich tetratricopeptide repeat (TPR)-containing, alpha
  Uniprot ID: O43765
  ENSP ID: ENSP00000221566
MDNKKRLAYAIIQFLHDQLRHGGLSSDAQESLEVAIQCLETAFGVTVEDSDLALPQTLPEIFEAAATGKEMPQDLRSPARTPPSEEDSAEAERLKTEGNEQMKVENFEAAVHFYGKAIELNPANAVYFCNRAAAYSKLGNYAGAVQDCERAICIDPAYSKAYGRMGLALSSLNKHVEAVAYYKKALELDPDNETYKSNLKIAELKLREAPSPTGGVGSFDIAGLLNNPGFMSMASNLMNNPQIQQLMSGMISGGNNPLGTPGTSPSQNDLASLIQAGQQFAQQMQQQNPELIEQLRSQIRSRTPSASNDDQQE

SEQ ID NO: 79799 - protein, 162 aa, Homo sapiens
  Payload ID: 15883
  Gene Symbol: SGTA
  Gene Name: small glutamine-rich tetratricopeptide repeat (TPR)-containing, alpha
  ENSP ID: ENSP00000466461
MDNKKRLAYAIIQFLHDQLRHGGLSSDAQESLEVAIQCLETAFGVTVEDSDLALPQTLPEIFEAAATGKEMPQDLRSPARTPPSEEDSAEAERLKTEGNEQMKVENFEAAVHFYGKAIELNPANAVYFCNRAAAYSKLGNYAGAVQDCERAICIDPAYSKAY

SEQ ID NO: 79800 - protein, 68 aa, Homo sapiens
  Payload ID: 15883
  Gene Symbol: SGTA
  Gene Name: small glutamine-rich tetratricopeptide repeat (TPR)-containing, alpha
  ENSP ID: ENSP00000468443
MDNKKRLAYAIIQFLHDQLRHGGLSSDAQESLEVAIQCLETAFGVTVEDSDLALPQTLPEIFEAAATG

SEQ ID NO: 79801 - protein, 304 aa, Homo sapiens
  Payload ID: 15884
  Gene Symbol: SGTB
  Gene Name: small glutamine-rich tetratricopeptide repeat (TPR)-containing, beta
  Uniprot ID: Q96EQ0
  ENSP ID: ENSP00000370395
MSSIKHLVYAVIRFLREQSQMDTYTSDEQESLEVAIQCLETVFKISPEDTHLAVSQPLTEMFTSSFCKNDVLPLSNSVPEDVGKADQLKDEGNNHMKEENYAAAVDCYTQAIELDPNNAVYYCNRAAAQSKLGHYTDAIKDCEKAIAIDSKYSKAYGRMGLALTALNKFEEAVTSYQKALDLDPENDSYKSNLKIAEQKLREVSSPTGTGLSFDMASLINNPAFISMAASLMQNPQVQQLMSGMMTNAIGGPAAGVGGLTDLSSLIQAGQQFAQQIQQQNPELIEQLRNHIRSRSFSSSAEEHS

SEQ ID NO: 79802 - protein, 195 aa, Homo sapiens
  Payload ID: 15884
  Gene Symbol: SGTB
  Gene Name: small glutamine-rich tetratricopeptide repeat (TPR)-containing, beta
  ENSP ID: ENSP00000421447
MSSIKHLVYAVIRFLREQSQMDTYTSDEQESLEVAIQCLETVFKISPEDTHLAVSQPLTEMFTSSFCKNDVLPLSNSVPEDVGKADQLKDEGNNHMKEENYAAAVDCYTQAIELDPNNAVYYCNRAAAQSKLGHYTDAIKDCEKAIAIDSKYSKAYGRMGLALTALNKFEEAVTSYQKALDLDPENDSYKSNLKI

SEQ ID NO: 79803 - protein, 37 aa, Homo sapiens
  Payload ID: 15885
  Gene Symbol: SMIM1
  Gene Name: small integral membrane protein 1 (Vel blood group)
  ENSP ID: ENSP00000456559
MQPQESHVHYSRWEDGSRDGVSLGAVSSTEEASRCRR

SEQ ID NO: 79804 - protein, 78 aa, Homo sapiens
  Payload ID: 15885
  Gene Symbol: SMIM1
  Gene Name: small integral membrane protein 1 (Vel blood group)
  Uniprot ID: B2RUZ4
  ENSP ID: ENSP00000457386
MQPQESHVHYSRWEDGSRDGVSLGAVSSTEEASRCRRISQRLCTGKLGIAMKVLGGVALFWIIFILGYLTGYYVHKCK

SEQ ID NO: 79805 - protein, 5 aa, Homo sapiens
  Payload ID: 15885
  Gene Symbol: SMIM1
  Gene Name: small integral membrane protein 1 (Vel blood group)
  ENSP ID: ENSP00000457674
MQPQE

SEQ ID NO: 79806 - protein, 83 aa, Homo sapiens
  Payload ID: 15886
  Gene Symbol: SMIM10
  Gene Name: small integral membrane protein 10
  Uniprot ID: Q96HG1
  ENSP ID: ENSP00000328335
MEALGSGHYVGGSIRSMAAAALSGLAVRLSRPQGTRGSYGAFCKTLTRTLLTFFDLAWRLRKNFFYFYILASVILNVHLQVYI

SEQ ID NO: 79807 - protein, 68 aa, Homo sapiens
  Payload ID: 15887
  Gene Symbol: SMIM10L1
  Gene Name: small integral membrane protein 10 like 1
  ENSP ID: ENSP00000488907
MAPAAAPSSLAVRASSPAATPTSYGVFCKGLSRTLLAFFELAWQLRMNFPYFYVAGSVILNIRLQVHI

SEQ ID NO: 79808 - protein, 78 aa, Homo sapiens
  Payload ID: 15888
  Gene Symbol: SMIM10L2A
  Gene Name: small integral membrane protein 10 like 2A
  Uniprot ID: P0DMW4
  ENSP ID: ENSP00000488643
MAASAALSAAAAAAALSGLAVRLSRSAAARGSYGAFCKGLTRTLLTFFDLAWRLRMNFPYFYIVASVMLNVRLQVRIE

SEQ ID NO: 79809 - protein, 78 aa, Homo sapiens; identical to SEQ ID NO: 79808
  Payload ID: 15889
  Gene Symbol: SMIM10L2B
  Gene Name: small integral membrane protein 10 like 2B
  Uniprot ID: P0DMW5
  ENSP ID: ENSP00000487709

SEQ ID NO: 79810 - protein, 58 aa, Homo sapiens
  Payload ID: 15890
  Gene Symbol: SMIM11A
  Gene Name: small integral membrane protein 11A
  Uniprot ID: P58511
  ENSP ID: ENSP00000382231
MNWKVLEHVPLLLYILAAKTLILCLTFAGVKMYQRKRLEAKQQKLEAERKKQSEKKDN

SEQ ID NO: 79811 - protein, 58 aa, Homo sapiens; identical to SEQ ID NO: 79810
  Payload ID: 15890
  Gene Symbol: SMIM11A
  Gene Name: small integral membrane protein 11A
  Uniprot ID: P58511
  ENSP ID: ENSP00000382234

SEQ ID NO: 79812 - protein, 68 aa, Homo sapiens
  Payload ID: 15890
  Gene Symbol: SMIM11A
  Gene Name: small integral membrane protein 11A
  ENSP ID: ENSP00000382238
MNWKVLTGTTYSPWRVRMEFPLCGCLSLILHHFADKEGRTIGRRESCLATIWTISRPWQAGSLWITLS

SEQ ID NO: 79813 - protein, 58 aa, Homo sapiens; identical to SEQ ID NO: 79810
  Payload ID: 15891
  Gene Symbol: SMIM11B
  Gene Name: small integral membrane protein 11B
  Uniprot ID: P58511
  ENSP ID: ENSP00000482011

SEQ ID NO: 79814 - protein, 68 aa, Homo sapiens; identical to SEQ ID NO: 79812
  Payload ID: 15891
  Gene Symbol: SMIM11B
  Gene Name: small integral membrane protein 11B
  ENSP ID: ENSP00000483089

SEQ ID NO: 79815 - protein, 58 aa, Homo sapiens; identical to SEQ ID NO: 79810
  Payload ID: 15891
  Gene Symbol: SMIM11B
  Gene Name: small integral membrane protein 11B
  Uniprot ID: P58511
  ENSP ID: ENSP00000485233

SEQ ID NO: 79816 - protein, 58 aa, Homo sapiens; identical to SEQ ID NO: 79810
  Payload ID: 15891
  Gene Symbol: SMIM11B
  Gene Name: small integral membrane protein 11B
  Uniprot ID: P58511
  ENSP ID: ENSP00000485484

SEQ ID NO: 79817 - protein, 58 aa, Homo sapiens; identical to SEQ ID NO: 79810
  Payload ID: 15891
  Gene Symbol: SMIM11B
  Gene Name: small integral membrane protein 11B
  Uniprot ID: P58511
  ENSP ID: ENSP00000485596

SEQ ID NO: 79818 - protein, 58 aa, Homo sapiens; identical to SEQ ID NO: 79810
  Payload ID: 15891
  Gene Symbol: SMIM11B
  Gene Name: small integral membrane protein 11B
  Uniprot ID: P58511
  ENSP ID: ENSP00000485606

SEQ ID NO: 79819 - protein, 92 aa, Homo sapiens
  Payload ID: 15892
  Gene Symbol: SMIM12
  Gene Name: small integral membrane protein 12
  Uniprot ID: Q96EX1
  ENSP ID: ENSP00000428541
MWPVFWTVVRTYAPYVTFPVAFVVGAVGYHLEWFIRGKDPQPVEEEKSISERREDRKLDELLGKDHTQVVSLKDKLEFAPKAVLNRNRPEKN

SEQ ID NO: 79820 - protein, 92 aa, Homo sapiens; identical to SEQ ID NO: 79819
  Payload ID: 15892
  Gene Symbol: SMIM12
  Gene Name: small integral membrane protein 12
  Uniprot ID: Q96EX1
  ENSP ID: ENSP00000428585

SEQ ID NO: 79821 - protein, 92 aa, Homo sapiens; identical to SEQ ID NO: 79819
  Payload ID: 15892
  Gene Symbol: SMIM12
  Gene Name: small integral membrane protein 12
  Uniprot ID: Q96EX1
  ENSP ID: ENSP00000428984

SEQ ID NO: 79822 - protein, 74 aa, Homo sapiens
  Payload ID: 15892
  Gene Symbol: SMIM12
  Gene Name: small integral membrane protein 12
  ENSP ID: ENSP00000429902
MWPVFWTVVRTYAPYVTFPVAFVVGAVGYHLEWFIRGKDPQPVEEEKSISERREDRKLDELLGKDHTQVAGMRL

SEQ ID NO: 79823 - protein, 92 aa, Homo sapiens; identical to SEQ ID NO: 79819
  Payload ID: 15892
  Gene Symbol: SMIM12
  Gene Name: small integral membrane protein 12
  Uniprot ID: Q96EX1
  ENSP ID: ENSP00000430198

SEQ ID NO: 79824 - protein, 92 aa, Homo sapiens; identical to SEQ ID NO: 79819
  Payload ID: 15892
  Gene Symbol: SMIM12
  Gene Name: small integral membrane protein 12
  Uniprot ID: Q96EX1
  ENSP ID: ENSP00000430285

SEQ ID NO: 79825 - protein, 91 aa, Homo sapiens
  Payload ID: 15893
  Gene Symbol: SMIM13
  Gene Name: small integral membrane protein 13
  Uniprot ID: P0DJ93
  ENSP ID: ENSP00000451866
MWHSVGLTLLVFVATLLIVLLLMVCGWYFVWHLFLSKFKFLRELVGDTGSQEGDHEPSGSETEEDTSSSPHRIRSARQRRAPADEGHRPLT

SEQ ID NO: 79826 - protein, 91 aa, Homo sapiens; identical to SEQ ID NO: 79825
  Payload ID: 15893
  Gene Symbol: SMIM13
  Gene Name: small integral membrane protein 13
  Uniprot ID: P0DJ93
  ENSP ID: ENSP00000452219

SEQ ID NO: 79827 - protein, 99 aa, Homo sapiens
  Payload ID: 15894
  Gene Symbol: SMIM14
  Gene Name: small integral membrane protein 14
  Uniprot ID: Q96QK8
  ENSP ID: ENSP00000295958
MAEGGFDPCECVCSHEHAMRRLINLLRQSQSYCTDTECLQELPGPSGDNGISVTMILVAWMVIALILFLLRPPNLRGSSLPGKPTSPHNGQDPPAPPVD

SEQ ID NO: 79828 - protein, 54 aa, Homo sapiens
  Payload ID: 15894
  Gene Symbol: SMIM14
  Gene Name: small integral membrane protein 14
  ENSP ID: ENSP00000421087
MAEGGFDPCECVCSHEHAMRRLINLLRQSQSYCTDTECLQEWTRSTSSSCGLTL

SEQ ID NO: 79829 - protein, 89 aa, Homo sapiens
  Payload ID: 15894
  Gene Symbol: SMIM14
  Gene Name: small integral membrane protein 14
  ENSP ID: ENSP00000422904
MAEGGFDPCECVCSHEHAMRRLINLLRQSQSYCTDTECLQELPGPSGDNGISVTMILVAWMVIALILFLLRPPNLRGSSLPGKPTSPHN

SEQ ID NO: 79830 - protein, 38 aa, Homo sapiens
  Payload ID: 15894
  Gene Symbol: SMIM14
  Gene Name: small integral membrane protein 14
  ENSP ID: ENSP00000425371
MAEGGFDPCECVCSHEHAMRRLINLYRDPLVIMASVLQ

SEQ ID NO: 79831 - protein, 74 aa, Homo sapiens
  Payload ID: 15895
  Gene Symbol: SMIM15
  Gene Name: small integral membrane protein 15
  Uniprot ID: Q7Z3B0
  ENSP ID: ENSP00000339324
MFDIKAWAEYVVEWAAKDPYGFLTTVILALTPLFLASAVLSWKLAKMIEAREKEQKKKQKRQENIAKAKRLKKD

SEQ ID NO: 79832 - protein, 74 aa, Homo sapiens; identical to SEQ ID NO: 79831
  Payload ID: 15895
  Gene Symbol: SMIM15
  Gene Name: small integral membrane protein 15
  Uniprot ID: Q7Z3B0
  ENSP ID: ENSP00000421336

SEQ ID NO: 79833 - protein, 118 aa, Homo sapiens
  Payload ID: 15896
  Gene Symbol: SMIM17
  Gene Name: small integral membrane protein 17
  Uniprot ID: P0DL12
  ENSP ID: ENSP00000471126
MQSLRPEQTRGLLEPERTKTLLPRESRAWEKPPHPACTKDWEAVEVGASSHDSDEKDLSSQETGLSQEWSSVEEDDESEGSQGFVEWSKAPQQTTIVLVVCVLFLFLVLTGMPMMFHI

SEQ ID NO: 79834 - protein, 103 aa, Homo sapiens
  Payload ID: 15896
  Gene Symbol: SMIM17
  Gene Name: small integral membrane protein 17
  ENSP ID: ENSP00000472019
MQSLRPEQTRGLLEPERTKTLLPRESRAWEKPPHPACTKDWEAVEVGASSHDSDEKGLCGVVKSSTTNNHSLGSVRAFFVPGFNGDAYDVSHLTIMVAVVLKV

SEQ ID NO: 79835 - protein, 95 aa, Homo sapiens
  Payload ID: 15897
  Gene Symbol: SMIM18
  Gene Name: small integral membrane protein 18
  Uniprot ID: P0DKX4
  ENSP ID: ENSP00000428858
MASSHWNETTTSVYQYLGFQVQKIYPFHDNWNTACFVILLLFIFTVVSLVVLAFLYEVLDCCCCVKNKTVKDLKSEPNPLRSMMDNIRKRETEVV

SEQ ID NO: 79836 - protein, 38 aa, Homo sapiens
  Payload ID: 15897
  Gene Symbol: SMIM18
  Gene Name: small integral membrane protein 18
  ENSP ID: ENSP00000486237
NPFLLKIQKLARRRRLQSPVIEKMNKISESSSTSSEKK

SEQ ID NO: 79837 - protein, 107 aa, Homo sapiens
  Payload ID: 15898
  Gene Symbol: SMIM19
  Gene Name: small integral membrane protein 19
  Uniprot ID: Q96E16
  ENSP ID: ENSP00000390750
MAGGYGVMGDDGSIDYTVHEAWNEATNVYLIVILVSFGLFMYAKRNKRRIMRIFSVPPTEETLSEPNFYDTISKIRLRQQLEMYSISRKYDYQQPQNQADSVQLSLE

SEQ ID NO: 79838 - protein, 107 aa, Homo sapiens; identical to SEQ ID NO: 79837
  Payload ID: 15898
  Gene Symbol: SMIM19
  Gene Name: small integral membrane protein 19
  Uniprot ID: Q96E16
  ENSP ID: ENSP00000391549

SEQ ID NO: 79839 - protein, 107 aa, Homo sapiens; identical to SEQ ID NO: 79837
  Payload ID: 15898
  Gene Symbol: SMIM19
  Gene Name: small integral membrane protein 19
  Uniprot ID: Q96E16
  ENSP ID: ENSP00000405694

SEQ ID NO: 79840 - protein, 107 aa, Homo sapiens; identical to SEQ ID NO: 79837
  Payload ID: 15898
  Gene Symbol: SMIM19
  Gene Name: small integral membrane protein 19
  Uniprot ID: Q96E16
  ENSP ID: ENSP00000408997

SEQ ID NO: 79841 - protein, 107 aa, Homo sapiens; identical to SEQ ID NO: 79837
  Payload ID: 15898
  Gene Symbol: SMIM19
  Gene Name: small integral membrane protein 19
  Uniprot ID: Q96E16
  ENSP ID: ENSP00000429586

SEQ ID NO: 79842 - protein, 36 aa, Homo sapiens
  Payload ID: 15898
  Gene Symbol: SMIM19
  Gene Name: small integral membrane protein 19
  ENSP ID: ENSP00000430387
MRIFSVPPTEETLSEPNFYDTISKIRLRQQLEMYSI

SEQ ID NO: 79843 - protein, 86 aa, Homo sapiens
  Payload ID: 15898
  Gene Symbol: SMIM19
  Gene Name: small integral membrane protein 19
  ENSP ID: ENSP00000430708
MAGGYGVMGDDGSIDYTVHEAWNEATNVYLIVILVSFGLFMYAKRIFGFWRIEENHNGGTSLCCVKWMCSATFLTASYFLVKERIL

SEQ ID NO: 79844 - protein, 85 aa, Homo sapiens
  Payload ID: 15899
  Gene Symbol: SMIM2
  Gene Name: small integral membrane protein 2
  Uniprot ID: Q9BVW6
  ENSP ID: ENSP00000383270
MEAGERIDASQLPHRVLETRGHAISILFGFWTSFICDTYIVLAWISKIKGSPDVSASSDEPYARIQQSRRQCHAEEDQSQVPEAG

SEQ ID NO: 79845 - protein, 85 aa, Homo sapiens; identical to SEQ ID NO: 79844
  Payload ID: 15899
  Gene Symbol: SMIM2
  Gene Name: small integral membrane protein 2
  Uniprot ID: Q9BVW6
  ENSP ID: ENSP00000483761

SEQ ID NO: 79846 - protein, 67 aa, Homo sapiens
  Payload ID: 15900
  Gene Symbol: SMIM20
  Gene Name: small integral membrane protein 20
  Uniprot ID: Q8N5G0
  ENSP ID: ENSP00000427407
MSRNLRTALIFGGFISLIGAAFYPIYFRPLMRLEEYKKEQAINRAGIVQEDVQPPGLKVWSDPFGRK

SEQ ID NO: 79847 - protein, 48 aa, Homo sapiens
  Payload ID: 15900
  Gene Symbol: SMIM20
  Gene Name: small integral membrane protein 20
  ENSP ID: ENSP00000429820
MSRNLRTALIFGGFISLIGAAFYPIYFRPLMRLEEYRLKVWSDPFGRK

SEQ ID NO: 79848 - protein, 168 aa, Homo sapiens
  Payload ID: 15900
  Gene Symbol: SMIM20
  Gene Name: small integral membrane protein 20
  Uniprot ID: Q8N5G0
  ENSP ID: ENSP00000483831
MVKEVWRVLREEPGRRKESRQNRARGNRVQQNSSNLNPTPAPGPHSTESRGRRRAGSEAPPRPGSESLSTSSERGHGPAVGNLVSESAGRSAGQGSPGPDAMSRNLRTALIFGGFISLIGAAFYPIYFRPLMRLEEYKKEQAINRAGIVQEDVQPPGLKVWSDPFGRK

SEQ ID NO: 79849 - protein, 77 aa, Homo sapiens
  Payload ID: 15901
  Gene Symbol: SMIM21
  Gene Name: small integral membrane protein 21
  ENSP ID: ENSP00000372083
MDQYVSTAPPRFPIAQLGTFKQDSAGMGRIFKGNLLQKKALTTLSTFEVIQEHSRSRINDTTFLSHGLHTMDFPCSR

SEQ ID NO: 79850 - protein, 101 aa, Homo sapiens
  Payload ID: 15901
  Gene Symbol: SMIM21
  Gene Name: small integral membrane protein 21
  Uniprot ID: Q3B7S5
  ENSP ID: ENSP00000462106
MDQYVSTAPPRFPIAQLGTFKQDSAGMGRIFKGNLLQKKALTTFENEHHIRFFTLLVLFHVMVLLRNHSRIQGVSEDWKRANSIFRNFLRLKSSRNTAEAE

SEQ ID NO: 79851 - protein, 87 aa, Homo sapiens
  Payload ID: 15901
  Gene Symbol: SMIM21
  Gene Name: small integral membrane protein 21
  ENSP ID: ENSP00000462572
MDQYVSTAPPRFPIAQLGTFKQDSAGMGRIFKGNLLQKKALTTFENEHHIRFFTLLVLFHVMVLLRNHSRIQGVSEDWKRANSIFRK

SEQ ID NO: 79852 - protein, 83 aa, Homo sapiens
  Payload ID: 15902
  Gene Symbol: SMIM22
  Gene Name: small integral membrane protein 22
  Uniprot ID: K7EJ46
  ENSP ID: ENSP00000464737
MAVSTEELEATVQEVLGRLKSHQFFQSTWDTVAFIVFLTFMGTVLLLLLLVVAHCCCCSSPGPRRESPRKERPKGVDNLALEP

SEQ ID NO: 79853 - protein, 88 aa, Homo sapiens
  Payload ID: 15902
  Gene Symbol: SMIM22
  Gene Name: small integral membrane protein 22
  Uniprot ID: K7EJ46
  ENSP ID: ENSP00000464748
MAVSTEELEATVQEVLGRLKSHQFFQSTWDTVAFIVFLTFMGTVLLLLLLVVAHCCCCSSPGPRRESPRKVSPWKERPKGVDNLALEP

SEQ ID NO: 79854 - protein, 135 aa, Homo sapiens
  Payload ID: 15902
  Gene Symbol: SMIM22
  Gene Name: small integral membrane protein 22
  Uniprot ID: K7EJ46
  ENSP ID: ENSP00000465021
MAVSTEELEATVQEVLGRLKSHQFFQSTWDTVAFIVFLTFMGTVLLLLLLVVAHCCCCSSPGPRRESPRKVSPWKVSPAGLWDLHGTVLGVEAEGEGSGGKGAHPPREQRANLLGPAVLLVQERPKGVDNLALEP

SEQ ID NO: 79855 - protein, 88 aa, Homo sapiens; identical to SEQ ID NO: 79853
  Payload ID: 15902
  Gene Symbol: SMIM22
  Gene Name: small integral membrane protein 22
  Uniprot ID: K7EJ46
  ENSP ID: ENSP00000465037

SEQ ID NO: 79856 - protein, 83 aa, Homo sapiens; identical to SEQ ID NO: 79852
  Payload ID: 15902
  Gene Symbol: SMIM22
  Gene Name: small integral membrane protein 22
  Uniprot ID: K7EJ46
  ENSP ID: ENSP00000465660

SEQ ID NO: 79857 - protein, 83 aa, Homo sapiens; identical to SEQ ID NO: 79852
  Payload ID: 15902
  Gene Symbol: SMIM22
  Gene Name: small integral membrane protein 22
  Uniprot ID: K7EJ46
  ENSP ID: ENSP00000467010

SEQ ID NO: 79858 - protein, 88 aa, Homo sapiens; identical to SEQ ID NO: 79853
  Payload ID: 15902
  Gene Symbol: SMIM22
  Gene Name: small integral membrane protein 22
  Uniprot ID: K7EJ46
  ENSP ID: ENSP00000468237

SEQ ID NO: 79859 - protein, 88 aa, Homo sapiens; identical to SEQ ID NO: 79853
  Payload ID: 15902
  Gene Symbol: SMIM22
  Gene Name: small integral membrane protein 22
  Uniprot ID: K7EJ46
  ENSP ID: ENSP00000481592

SEQ ID NO: 79860 - protein, 135 aa, Homo sapiens; identical to SEQ ID NO: 79854
  Payload ID: 15902
  Gene Symbol: SMIM22
  Gene Name: small integral membrane protein 22
  Uniprot ID: K7EJ46
  ENSP ID: ENSP00000482700

SEQ ID NO: 79861 - protein, 156 aa, Homo sapiens
  Payload ID: 15903
  Gene Symbol: SMIM23
  Gene Name: small integral membrane protein 23
  Uniprot ID: A6NLE4
  ENSP ID: ENSP00000331214
MATQQVDSRRQVAAEQVAAQLLERRRGSHCDDEKQTLLALLILVLYLSTEIWGSSWEVSERIRECNYYQNLAVPQGLEYQTNEPSEEPIKTIRNWLKEKLHVFSEKLEEEVQQLEQLAWDLELWLDALLGEPHQEEHCSTYKSHLHLEHEVSIRDH

SEQ ID NO: 79862 - protein, 122 aa, Homo sapiens
  Payload ID: 15903
  Gene Symbol: SMIM23
  Gene Name: small integral membrane protein 23
  ENSP ID: ENSP00000430818
  MOD_RES (1)..(1): Any amino acid
XVDSRRQVAAEQVAAQLLERRRGSHCDDEKQTLLALLILVLYLSTEIWGSSWEVSERIRECNYYQNLAVPQGLEYQTNEPSEEPIKTIRNWLKEKLHVFSEKLEEEVQQLEQLAWDLELWLD

SEQ ID NO: 79863 - protein, 130 aa, Homo sapiens
  Payload ID: 15904
  Gene Symbol: SMIM24
  Gene Name: small integral membrane protein 24
  Uniprot ID: O75264
  ENSP ID: ENSP00000215531
METLGALLVLEFLLLSPVEAQQATEHRLKPWLVGLAAVVGFLFIVYLVLLANRLWCSKARAEDEEETTFRMESNLYQDQSEDKREKKEAKEKEEKRKKEKKTAKEGESNLGLDLEEKEPGDHERAKSTVM

SEQ ID NO: 79864 - protein, 60 aa, Homo sapiens
  Payload ID: 15904
  Gene Symbol: SMIM24
  Gene Name: small integral membrane protein 24
  ENSP ID: ENSP00000465692
MESNLYQDQSEDKREKKEAKEKEEKRKKEKKTAKEGESNLGLDLEEKEPGDHERAKSTVM

SEQ ID NO: 79865 - protein, 60 aa, Homo sapiens; identical to SEQ ID NO: 79864
  Payload ID: 15904
  Gene Symbol: SMIM24
  Gene Name: small integral membrane protein 24
  ENSP ID: ENSP00000467484

SEQ ID NO: 79866 - protein, 60 aa, Homo sapiens
  Payload ID: 15905
  Gene Symbol: SMIM3
  Gene Name: small integral membrane protein 3
  Uniprot ID: Q9BZL3
  ENSP ID: ENSP00000436897
MDAVSQVPMEVVLPKHILDIWVIVLIILATIVIMTSLLLCPATAVIIYRMRTHPILSGAV

SEQ ID NO: 79867 - protein, 37 aa, Homo sapiens
  Payload ID: 15906
  Gene Symbol: SMIM4
  Gene Name: small integral membrane protein 4
  ENSP ID: ENSP00000305661
MFTRAQMMSTVEKPQKDSIREGWKMNETELQQSIKSI

SEQ ID NO: 79868 - protein, 70 aa, Homo sapiens
  Payload ID: 15906
  Gene Symbol: SMIM4
  Gene Name: small integral membrane protein 4
  Uniprot ID: Q8WVI0
  ENSP ID: ENSP00000417806
MFTRAQVRRILQRVPGKQRFGIYRFLPFFFVLGGTMEWIMIKVRVGQETFYDVYRRKASERQYQRRLEDE

SEQ ID NO: 79869 - protein, 59 aa, Homo sapiens
  Payload ID: 15906
  Gene Symbol: SMIM4
  Gene Name: small integral membrane protein 4
  ENSP ID: ENSP00000418000
MFTRAQVRRILQRVPGKQRFGIYRFLPFFFVLGGTMEWIMIKVRVGQETFYSTSSSLIQ

SEQ ID NO: 79870 - protein, 77 aa, Homo sapiens
  Payload ID: 15907
  Gene Symbol: SMIM5
  Gene Name: small integral membrane protein 5
  Uniprot ID: Q71RC9
  ENSP ID: ENSP00000364363
MAATDFVQEMRAVGERLLLKLQRLPQAEPVEIVAFSVIILFTATVLLLLLIACSCCCTHCCCPERRGRKVQVQPTPP

SEQ ID NO: 79871 - protein, 77 aa, Homo sapiens; identical to SEQ ID NO: 79870
  Payload ID: 15907
  Gene Symbol: SMIM5
  Gene Name: small integral membrane protein 5
  Uniprot ID: Q71RC9
  ENSP ID: ENSP00000477017

SEQ ID NO: 79872 - protein, 62 aa, Homo sapiens
  Payload ID: 15908
  Gene Symbol: SMIM6
  Gene Name: small integral membrane protein 6
  Uniprot ID: P0DI80
  ENSP ID: ENSP00000450581
MDQLVFKETIWNDAFWQNPWDQGGLAVIILFITAVLLLILFAIVFGLLTSTENTQCEAGEEE

SEQ ID NO: 79873 - protein, 62 aa, Homo sapiens; identical to SEQ ID NO: 79872
  Payload ID: 15908
  Gene Symbol: SMIM6
  Gene Name: small integral membrane protein 6
  Uniprot ID: P0DI80
  ENSP ID: ENSP00000463361

SEQ ID NO: 79874 - protein, 103 aa, Homo sapiens
  Payload ID: 15909
  Gene Symbol: SMIM7
  Gene Name: small integral membrane protein 7
  ENSP ID: ENSP00000351569
MIGDILLFGTLLMNAGAVLNFKLKKKDTQGFGEESREPSTGDNIREFLLSLRYFRIFIALWNIFMMFCMIVLRKLKQIAFPSSTGAITLILLLTNCEICCKWI

SEQ ID NO: 79875 - protein, 75 aa, Homo sapiens
  Payload ID: 15909
  Gene Symbol: SMIM7
  Gene Name: small integral membrane protein 7
  Uniprot ID: Q9BQ49
  ENSP ID: ENSP00000417147
MIGDILLFGTLLMNAGAVLNFKLKKKDTQGFGEESREPSTGDNIREFLLSLRYFRIFIALWNIFMMFCMIVLFGS

SEQ ID NO: 79876 - protein, 49 aa, Homo sapiens; identical to SEQ ID NO: 20350
  Payload ID: 15909
  Gene Symbol: SMIM7
  Gene Name: small integral membrane protein 7
  ENSP ID: ENSP00000432842

SEQ ID NO: 79877 - protein, 75 aa, Homo sapiens; identical to SEQ ID NO: 79875
  Payload ID: 15909
  Gene Symbol: SMIM7
  Gene Name: small integral membrane protein 7
  Uniprot ID: Q9BQ49
  ENSP ID: ENSP00000433833

SEQ ID NO: 79878 - protein, 56 aa, Homo sapiens
  Payload ID: 15909
  Gene Symbol: SMIM7
  Gene Name: small integral membrane protein 7
  ENSP ID: ENSP00000435127
MIGDILLFGTLLMNAGAVLNFKLKKKDTQGFGEESREPSTGWSAVVRSWLTADSTS

SEQ ID NO: 79879 - protein, 47 aa, Homo sapiens
  Payload ID: 15909
  Gene Symbol: SMIM7
  Gene Name: small integral membrane protein 7
  ENSP ID: ENSP00000436448
MIGDILLFGTLLMNAGAVLNFKLKKKDTQGFGEESREPSTGLERESD

SEQ ID NO: 79880 - protein, 103 aa, Homo sapiens; identical to SEQ ID NO: 79874
  Payload ID: 15909
  Gene Symbol: SMIM7
  Gene Name: small integral membrane protein 7
  ENSP ID: ENSP00000437332

SEQ ID NO: 79881 - protein, 75 aa, Homo sapiens; identical to SEQ ID NO: 79875
  Payload ID: 15909
  Gene Symbol: SMIM7
  Gene Name: small integral membrane protein 7
  Uniprot ID: Q9BQ49
  ENSP ID: ENSP00000469440

SEQ ID NO: 79882 - protein, 75 aa, Homo sapiens; identical to SEQ ID NO: 79875
  Payload ID: 15909
  Gene Symbol: SMIM7
  Gene Name: small integral membrane protein 7
  Uniprot ID: Q9BQ49
  ENSP ID: ENSP00000469918

SEQ ID NO: 79883 - protein, 75 aa, Homo sapiens; identical to SEQ ID NO: 79875
  Payload ID: 15909
  Gene Symbol: SMIM7
  Gene Name: small integral membrane protein 7
  Uniprot ID: Q9BQ49
  ENSP ID: ENSP00000469962

SEQ ID NO: 79884 - protein, 49 aa, Homo sapiens; identical to SEQ ID NO: 20350
  Payload ID: 15909
  Gene Symbol: SMIM7
  Gene Name: small integral membrane protein 7
  ENSP ID: ENSP00000470601

SEQ ID NO: 79885 - protein, 49 aa, Homo sapiens; identical to SEQ ID NO: 20350
  Payload ID: 15909
  Gene Symbol: SMIM7
  Gene Name: small integral membrane protein 7
  ENSP ID: ENSP00000470899

SEQ ID NO: 79886 - protein, 63 aa, Homo sapiens; identical to SEQ ID NO: 20353
  Payload ID: 15909
  Gene Symbol: SMIM7
  Gene Name: small integral membrane protein 7
  ENSP ID: ENSP00000471293

SEQ ID NO: 79887 - protein, 75 aa, Homo sapiens; identical to SEQ ID NO: 79875
  Payload ID: 15909
  Gene Symbol: SMIM7
  Gene Name: small integral membrane protein 7
  Uniprot ID: Q9BQ49
  ENSP ID: ENSP00000471355

SEQ ID NO: 79888 - protein, 63 aa, Homo sapiens; identical to SEQ ID NO: 20353
  Payload ID: 15909
  Gene Symbol: SMIM7
  Gene Name: small integral membrane protein 7
  ENSP ID: ENSP00000471391

SEQ ID NO: 79889 - protein, 49 aa, Homo sapiens; identical to SEQ ID NO: 20350
  Payload ID: 15909
  Gene Symbol: SMIM7
  Gene Name: small integral membrane protein 7
  ENSP ID: ENSP00000472562

SEQ ID NO: 79890 - protein, 103 aa, Homo sapiens; identical to SEQ ID NO: 79874
  Payload ID: 15909
  Gene Symbol: SMIM7
  Gene Name: small integral membrane protein 7
  ENSP ID: ENSP00000486146

SEQ ID NO: 79891 - protein, 97 aa, Homo sapiens
  Payload ID: 15910
  Gene Symbol: SMIM8
  Gene Name: small integral membrane protein 8
  Uniprot ID: Q96KF7
  ENSP ID: ENSP00000229570
MSSAPEPPTFKKEPPKEKEFQSPGLRGVRTTTLFRAVNPELFIKPNKPVMAFGLVTLSLCVAYIGYLHAIQENKKDLYEAIDSEGHSYMRRKTSKWD

SEQ ID NO: 79892 - protein, 97 aa, Homo sapiens; identical to SEQ ID NO: 79891
  Payload ID: 15910
  Gene Symbol: SMIM8
  Gene Name: small integral membrane protein 8
  Uniprot ID: Q96KF7
  ENSP ID: ENSP00000376603

SEQ ID NO: 79893 - protein, 76 aa, Homo sapiens
  Payload ID: 15910
  Gene Symbol: SMIM8
  Gene Name: small integral membrane protein 8
  ENSP ID: ENSP00000476709
MSSAPEPPTFKKEPPKEKEFQSPGLRGVRTTTLFRAVNPELFIKPNVSYSLKHQHFEVSFMEVGTEMGVKMSVNKA

SEQ ID NO: 79894 - protein, 58 aa, Homo sapiens
  Payload ID: 15910
  Gene Symbol: SMIM8
  Gene Name: small integral membrane protein 8
  ENSP ID: ENSP00000476881
MSSAPEPPTFKKEPPKEKEFQSPGLRGVRTTTLFRAVNPELFIKPELSILPTFWTLRP

SEQ ID NO: 79895 - protein, 97 aa, Homo sapiens; identical to SEQ ID NO: 79891
  Payload ID: 15910
  Gene Symbol: SMIM8
  Gene Name: small integral membrane protein 8
  Uniprot ID: Q96KF7
  ENSP ID: ENSP00000476945

SEQ ID NO: 79896 - protein, 97 aa, Homo sapiens; identical to SEQ ID NO: 79891
  Payload ID: 15910
  Gene Symbol: SMIM8
  Gene Name: small integral membrane protein 8
  Uniprot ID: Q96KF7
  ENSP ID: ENSP00000477133

SEQ ID NO: 79897 - protein, 99 aa, Homo sapiens
  Payload ID: 15911
  Gene Symbol: SMIM9
  Gene Name: small integral membrane protein 9
  Uniprot ID: A6NGZ8
  ENSP ID: ENSP00000358542
MEPQKLLIIGFLLCSLTCLLLETVASSPLPLSALGIQEKTGSKPRSGGNHRSWLNNFRDYLWQLIKSALPPAAIVAFLLTSALMGILCCFTILVVDPVH

SEQ ID NO: 79898 - protein, 107 aa, Homo sapiens
  Payload ID: 15912
  Gene Symbol: SMLR1
  Gene Name: small leucine-rich protein 1
  Uniprot ID: H3BR10
  ENSP ID: ENSP00000456026
MLSKGRSPRRKQVQTQRKAALVLSVTPMVPVGSVWLAMSSVLSAFMRELPGWFLFFGVFLPVTLLLLLLIAYFRIKLIEVNEELSQNCDRQHNPKDGSSLYQRMKWT

SEQ ID NO: 79899 - protein, 65 aa, Homo sapiens
  Payload ID: 15913
  Gene Symbol: SMKR1
  Gene Name: small lysine-rich protein 1
  Uniprot ID: H3BMG3
  ENSP ID: ENSP00000454370
MPAKGKKGKGQGKSHGKKQKKPEVDILSPAAMLNLYYIAHNVADCLHLRGFHWPGAPKGKKGRSK

SEQ ID NO: 79900 - protein, 88 aa, Homo sapiens
  Payload ID: 15914
  Gene Symbol: SMPX
  Gene Name: small muscle protein, X-linked
  Uniprot ID: Q9UHP9
  ENSP ID: ENSP00000368808
MNMSKQPVSNVRAIQANINIPMGAFRPGAGQPPRRKECTPEVEEGVPPTSDEEKKPIPGAKKLPGPAVNLSEIQNIKSELKYVPKAEQ

SEQ ID NO: 79901 - protein, 2136 aa, Homo sapiens
  Payload ID: 15915
  Gene Symbol: SNRNP200
  Gene Name: small nuclear ribonucleoprotein 200kDa (U5)
  Uniprot ID: O75643
  ENSP ID: ENSP00000317123
MADVTARSLQYEYKANSNLVLQADRSLIDRTRRDEPTGEVLSLVGKLEGTRMGDKAQRTKPQMQEERRAKRRKRDEDRHDINKMKGYTLLSEGIDEMVGIIYKPKTKETRETYEVLLSFIQAALGDQPRDILCGAADEVLAVLKNEKLRDKERRKEIDLLLGQTDDTRYHVLVNLGKKITDYGGDKEIQNMDDNIDETYGVNVQFESDEEEGDEDVYGEVREEASDDDMEGDEAVVRCTLSANLVASGELMSSKKKDLHPRDIDAFWLQRQLSRFYDDAIVSQKKADEVLEILKTASDDRECENQLVLLLGFNTFDFIKVLRQHRMMILYCTLLASAQSEAEKERIMGKMEADPELSKFLYQLHETEKEDLIREERSRRERVRQSRMDTDLETMDLDQGGEALAPRQVLDLEDLVFTQGSHFMANKRCQLPDGSFRRQRKGYEEVHVPALKPKPFGSEEQLLPVEKLPKYAQAGFEGFKTLNRIQSKLYRAALETDENLLLCAPTGAGKTNVALMCMLREIGKHINMDGTINVDDFKIIYIAPMRSLVQEMVGSFGKRLATYGITVAELTGDHQLCKEEISATQIIVCTPEKWDIITRKGGERTYTQLVRLIILDEIHLLHDDRGPVLEALVARAIRNIEMTQEDVRLIGLSATLPNYEDVATFLRVDPAKGLFYFDNSFRPVPLEQTYVGITEKKAIKRFQIMNEIVYEKIMEHAGKNQVLVFVHSRKETGKTARAIRDMCLEKDTLGLFLREGSASTEVLRTEAEQCKNLELKDLLPYGFAIHHAGMTRVDRTLVEDLFADKHIQVLVSTATLAWGVNLPAHTVIIKGTQVYSPEKGRWTELGALDILQMLGRAGRPQYDTKGEGILITSHGELQYYLSLLNQQLPIESQMVSKLPDMLNAEIVLGNVQNAKDAVNWLGYAYLYIRMLRSPTLYGISHDDLKGDPLLDQRRLDLVHTAALMLDKNNLVKYDKKTGNFQVTELGRIASHYYITNDTVQTYNQLLKPTLSEIELFRVFSLSSEFKNITVREEEKLELQKLLERVPIPVKESIEEPSAKINVLLQAFISQLKLEGFALMADMVYVTQSAGRLMRAIFEIVLNRGWAQLTDKTLNLCKMIDKRMWQSMCPLRQFRKLPEEVVKKIEKKNFPFERLYDLNHNEIGELIRMPKMGKTIHKYVHLFPKLELSVHLQPITRSTLKVELTITPDFQWDEKVHGSSEAFWILVEDVDSEVILHHEYFLLKAKYAQDEHLITFFVPVFEPLPPQYFIRVVSDRWLSCETQLPVSFRHLILPEKYPPPTELLDLQPLPVSALRNSAFESLYQDKFPFFNPIQTQVFNTVYNSDDNVFVGAPTGSGKTICAEFAILRMLLQSSEGRCVYITPMEALAEQVYMDWYEKFQDRLNKKVVLLTGETSTDLKLLGKGNIIISTPEKWDILSRRWKQRKNVQNINLFVVDEVHLIGGENGPVLEVICSRMRYISSQIERPIRIVALSSSLSNAKDVAHWLGCSATSTFNFHPNVRPVPLELHIQGFNISHTQTRLLSMAKPVYHAITKHSPKKPVIVFVPSRKQTRLTAIDILTTCAADIQRQRFLHCTEKDLIPYLEKLSDSTLKETLLNGVGYLHEGLSPMERRLVEQLFSSGAIQVVVASRSLCWGMNVAAHLVIIMDTQYYNGKIHAYVDYPIYDVLQMVGHANRPLQDDEGRCVIMCQGSKKDFFKKFLYEPLPVESHLDHCMHDHFNAEIVTKTIENKQDAVDYLTWTFLYRRMTQNPNYYNLQGISHRHLSDHLSELVEQTLSDLEQSKCISIEDEMDVAPLNLGMIAAYYYINYTTIELFSMSLNAKTKVRGLIEIISNAAEYENIPIRHHEDNLLRQLAQKVPHKLNNPKFNDPHVKTNLLLQAHLSRMQLSAELQSDTEEILSKAIRLIQACVDVLSSNGWLSPALAAMELAQMVTQAMWSKDSYLKQLPHFTSEHIKRCTDKGVESVFDIMEMEDEERNALLQLTDSQIADVARFCNRYPNIELSYEVVDKDSIRSGGPVVVLVQLEREEEVTGPVIAPLFPQKREEGWWVVIGDAKSNSLISIKRLTLQQKAKVKLDFVAPATGAHNYTLYFMSDAYMGCDQEYKFSVDVKEAETDSDSD

SEQ ID NO: 79902 - protein, 595 aa, Homo sapiens
  Payload ID: 15915
  Gene Symbol: SNRNP200
  Gene Name: small nuclear ribonucleoprotein 200kDa (U5)
  ENSP ID: ENSP00000387870
MRYISSQIERPIRIVALSSSLSNAKDVAHWLGCSATSTFNFHPNVRPVPLELHIQGFNISHTQTRLLSMAKPVYHAITKHSPKKPVIVFVPSRKQTRLTAIDILTTCAADIQRQRFLHCTEKDLIPYLEKLSDSTLKETLLNGVGYLHEGLSPMERRLVEQLFSSGAIQVVVASRSLCWGMNVAAHLVIIMDTQYYNGKIHAYVDYPIYDVLQMVGHANRPLQDDEGRCVIMCQGSKKDFFKKFLYEPLPVESHLDHCMHDHFNAEIVTKTIENKQDAVDYLTWTFLYRRMTQNPNYYNLQGISHRHLSDHLSELVEQTLSDLEQSKCISIEDEMDVAPLNLGMIAAYYYINYTTIELFSMSLNAKTKVRGLIEIISNAAEYENIPIRHHEDNLLRQLAQKVPHKLNNPKFNDPHVKTNLLLQAHLSRMQLSAELQSDTEEILSKAIRLIQACVDVLSSNGWLSPALAAMELAQMVTQAMWSKDSYLKQLPHFTSEHIKRCTDKGVESVFDIMEMEDEERNALLQLTDSQIADVARFCNRYPNIELSYEVVDKDSIRSGGPVVVLVQLEREEEVTGPVIAPLFPQFRAGRSGSRL

SEQ ID NO: 79903 - protein, 123 aa, Homo sapiens
  Payload ID: 15916
  Gene Symbol: SNRNP25
  Gene Name: small nuclear ribonucleoprotein 25kDa (U11/U12)
  ENSP ID: ENSP00000293861
MVVQDPLLCDLPIQVTLEEVNSQIALEYGQAMTVRVCKMDGEVMPVVVVQSATVLDLKKAIQRYVQLKQEREGGIQHISWSYVWRTYHLTSAGEKLTEDRKKLRDYGIRNRDEVSFIKKLRQK

SEQ ID NO: 79904 - protein, 132 aa, Homo sapiens
  Payload ID: 15916
  Gene Symbol: SNRNP25
  Gene Name: small nuclear ribonucleoprotein 25kDa (U11/U12)
  Uniprot ID: Q9BV90
  ENSP ID: ENSP00000372482
MDVFQEGLAMVVQDPLLCDLPIQVTLEEVNSQIALEYGQAMTVRVCKMDGEVMPVVVVQSATVLDLKKAIQRYVQLKQEREGGIQHISWSYVWRTYHLTSAGEKLTEDRKKLRDYGIRNRDEVSFIKKLRQK

SEQ ID NO: 79905 - protein, 92 aa, Homo sapiens
  Payload ID: 15916
  Gene Symbol: SNRNP25
  Gene Name: small nuclear ribonucleoprotein 25kDa (U11/U12)
  ENSP ID: ENSP00000380974
MVVQDPLLCDLPIQVTLEEVNSQIALEYGQAMTVRVCKMDGEVMPVVVVQSATVLDLKKAIQRYVQLKQEREGGIQHISCKVCLAKPPQTAL

SEQ ID NO: 79906 - protein, 96 aa, Homo sapiens
  Payload ID: 15916
  Gene Symbol: SNRNP25
  Gene Name: small nuclear ribonucleoprotein 25kDa (U11/U12)
  ENSP ID: ENSP00000391289
MVVQDPLLCDLPIQVTLEEVNSQIALEYGQAMTVRVCKMDGESATVLDLKKAIQRYVQLKQEREGGIQHISWSYVWRTYHLTSAGEKLTEDRKKLR

SEQ ID NO: 79907 - protein, 155 aa, Homo sapiens
  Payload ID: 15917
  Gene Symbol: SNRNP27
  Gene Name: small nuclear ribonucleoprotein 27kDa (U4/U6.U5)
  Uniprot ID: Q8WVK2
  ENSP ID: ENSP00000244227
MGRSRSRSPRRERRRSRSTSRERERRRRERSRSRERDRRRSRSRSPHRRRSRSPRRHRSTSPSPSRLKERRDEEKKETKETKSKERQITEEDLEGKTEEEIEMMKLMGFASFDSTKGKKVDGSVNAYAINVSQKRKYRQYMNRKGGFNRPLDFIA

SEQ ID NO: 79908 - protein, 158 aa, Homo sapiens
  Payload ID: 15917
  Gene Symbol: SNRNP27
  Gene Name: small nuclear ribonucleoprotein 27kDa (U4/U6.U5)
  ENSP ID: ENSP00000386608
MGRSRSRSPRRERRRSRSTSRERERRRRERSRSRERDRRRSRSRSPHRRRSRSPRRHRSTSPSPSRLKERRDEEKKETKETKSKERQITEEDLEGKTEEEIEMMKLMGFASFDSTKAVHESKRWIQQTFGFHCMRIEVLKDDFFSPHLGQRVDFVFCI

SEQ ID NO: 79909 - protein, 155 aa, Homo sapiens; identical to SEQ ID NO: 79907
  Payload ID: 15917
  Gene Symbol: SNRNP27
  Gene Name: small nuclear ribonucleoprotein 27kDa (U4/U6.U5)
  Uniprot ID: Q8WVK2
  ENSP ID: ENSP00000395144

SEQ ID NO: 79910 - protein, 18 aa, Homo sapiens
  Payload ID: 15917
  Gene Symbol: SNRNP27
  Gene Name: small nuclear ribonucleoprotein 27kDa (U4/U6.U5)
  ENSP ID: ENSP00000430449
  MOD_RES (1)..(1): Any amino acid
XQYMNRKGGFNRPLDFIA

SEQ ID NO: 79911 - protein, 246 aa, Homo sapiens
  Payload ID: 15918
  Gene Symbol: SNRNP35
  Gene Name: small nuclear ribonucleoprotein 35kDa (U11/U12)
  Uniprot ID: Q16560
  ENSP ID: ENSP00000340774
MNDWMPIAKEYDPLKAGSIDGTDEDPHDRAVWRAMLARYVPNKGVIGDPLLTLFVARLNLQTKEDKLKEVFSRYGDIRRLRLVRDLVTGFSKGYAFIEYKEERAVIKAYRDADGLVIDQHEIFVDYELERTLKGWIPRRLGGGLGGKKESGQLRFGGRDRPFRKPINLPVVKNDLYREGKRERRERSRSRERHWDSRTRDRDHDRGREKRWQEREPTRVWPDNDWERERDFRDDRIKGREKKERGK

SEQ ID NO: 79912 - protein, 251 aa, Homo sapiens
  Payload ID: 15918
  Gene Symbol: SNRNP35
  Gene Name: small nuclear ribonucleoprotein 35kDa (U11/U12)
  Uniprot ID: Q16560
  ENSP ID: ENSP00000403310
MKPANMNDWMPIAKEYDPLKAGSIDGTDEDPHDRAVWRAMLARYVPNKGVIGDPLLTLFVARLNLQTKEDKLKEVFSRYGDIRRLRLVRDLVTGFSKGYAFIEYKEERAVIKAYRDADGLVIDQHEIFVDYELERTLKGWIPRRLGGGLGGKKESGQLRFGGRDRPFRKPINLPVVKNDLYREGKRERRERSRSRERHWDSRTRDRDHDRGREKRWQEREPTRVWPDNDWERERDFRDDRIKGREKKERGK

SEQ ID NO: 79913 - protein, 246 aa, Homo sapiens; identical to SEQ ID NO: 79911
  Payload ID: 15918
  Gene Symbol: SNRNP35
  Gene Name: small nuclear ribonucleoprotein 35kDa (U11/U12)
  Uniprot ID: Q16560
  ENSP ID: ENSP00000432595

SEQ ID NO: 79914 - protein, 357 aa, Homo sapiens
  Payload ID: 15919
  Gene Symbol: SNRNP40
  Gene Name: small nuclear ribonucleoprotein 40kDa (U5)
  Uniprot ID: Q96DI7
  ENSP ID: ENSP00000263694
MIEQQKRKGPELPLVPVKRQRHELLLGAGSGPGAGQQQATPGALLQAGPPRCSSLQAPIMLLSGHEGEVYCCKFHPNGSTLASAGFDRLILLWNVYGDCDNYATLKGHSGAVMELHYNTDGSMLFSASTDKTVAVWDSETGERVKRLKGHTSFVNSCYPARRGPQLVCTGSDDGTVKLWDIRKKAAIQTFQNTYQVLAVTFNDTSDQIISGGIDNDIKVWDLRQNKLTYTMRGHADSVTGLSLSSEGSYLLSNAMDNTVRVWDVRPFAPKERCVKIFQGNVHNFEKNLLRCSWSPDGSKIAAGSADRFVYVWDTTSRRILYKLPGHAGSINEVAFHPDEPIIISASSDKRLYMGEIQ

SEQ ID NO: 79915 - protein, 127 aa, Homo sapiens
  Payload ID: 15919
  Gene Symbol: SNRNP40
  Gene Name: small nuclear ribonucleoprotein 40kDa (U5)
  ENSP ID: ENSP00000362825
MILISAGCPGGLWPIVVLVGLFIWICFAVRVWDVRPFAPKERCVKIFQGNVHNFEKNLLRCSWSPDGSKIAAGSADRFVYVWDTTSRRILYKLPGHAGSINEVAFHPDEPIIISASSDKRLYMGEIQ

SEQ ID NO: 79916 - protein, 339 aa, Homo sapiens
  Payload ID: 15920
  Gene Symbol: SNRNP48
  Gene Name: small nuclear ribonucleoprotein 48kDa (U11/U12)
  Uniprot ID: Q6IEG0
  ENSP ID: ENSP00000339834
MEGEPPPVEERRRLQEELNEFVESGCRTLEEVTASLGWDLDSLDPGEEEAAEDEVVICPYDSNHHMPKSSLAKHMASCRLRKMGYTKEEEDEMYNPEFFYENVKIPSITLNKDSQFQIIKQARTAVGKDSDCYNQRIYSSLPVEVPLNHKRFVCDLTQADRLALYDFVVEETKKKRSDSQIIENDSDLFVDLAAKINQDNSRKSPKSYLEILAEVRDYKRRRQSYRAKNVHITKKSYTEVIRDVINVHMEELSNHWQEEQEKAEDDAEKNEERRSASVDSRQSGGSYLDAECSRHRRDRSRSPHKRKRNKDKDKNCESRRRKERDGERHHSHKRRKQKI

SEQ ID NO: 79917 - protein, 149 aa, Homo sapiens
  Payload ID: 15920
  Gene Symbol: SNRNP48
  Gene Name: small nuclear ribonucleoprotein 48kDa (U11/U12)
  ENSP ID: ENSP00000489245
MEGEPPPVEERRRLQEELNEFVESGCRTLEEVTASLGWDLDSLDPGEEEAAEDEVVICPYDSNHHMPKSSLAKHMASCRLRKMGYTKEEEDEMYNPEFFYENVKIPSITLNKDSQFQIIKQARTAVGKDSDCYNQIIGEFILHCLLKFL

SEQ ID NO: 79918 - protein, 428 aa, Homo sapiens
  Payload ID: 15921
  Gene Symbol: SNRNP70
  Gene Name: small nuclear ribonucleoprotein 70kDa (U1)
  Uniprot ID: P08621
  ENSP ID: ENSP00000221448
MTQFLPPNLLALFAPRDPIPYLPPLEKLPHEKHHNQPYCGIAPYIREFEDPRDAPPPTRAETREERMERKRREKIERRQQEVETELKMWDPHNDPNAQGDAFKTLFVARVNYDTTESKLRREFEVYGPIKRIHMVYSKRSGKPRGYAFIEYEHERDMHSAYKHADGKKIDGRRVLVDVERGRTVKGWRPRRLGGGLGGTRRGGADVNIRHSGRDDTSRYDERDRDRDRERERRERSRERDKERERRRSRSRDRRRRSRSRDKEERRRSRERSKDKDRDRKRRSSRSRERARRERERKEELRGGGGDMAEPSEAGDAPPDDGPPGELGPDGPDGPEEKGRDRDRERRRSHRSERERRRDRDRDRDRDREHKRGERGSERGRDEARGGGGGQDNGLEGLGNDSRDMYMESEGGDGYLAPENGYLMEAAPE

SEQ ID NO: 79919 - protein, 166 aa, Homo sapiens
  Payload ID: 15921
  Gene Symbol: SNRNP70
  Gene Name: small nuclear ribonucleoprotein 70kDa (U1)
  Uniprot ID: P08621
  ENSP ID: ENSP00000385077
MTQFLPPNLLALFAPRDPIPYLPPLEKLPHEKHHNQPYCGIAPYIREFEDPRDAPPPTRAETREERMERKRREKIERRQQEVETELKMWDPHNDPNAQGDAFKTLFVARVNYDTTESKLRREFEVYGPIKRIHMVYSKRSGKPRGYAFIEYEHERDMHSTTQLACS

SEQ ID NO: 79920 - protein, 33 aa, Homo sapiens
  Payload ID: 15921
  Gene Symbol: SNRNP70
  Gene Name: small nuclear ribonucleoprotein 70kDa (U1)
  ENSP ID: ENSP00000468828
MERKRREKIERRQQEVETELKMWDPHNDPNAQG

SEQ ID NO: 79921 - protein, 166 aa, Homo sapiens; identical to SEQ ID NO: 79919
  Payload ID: 15921
  Gene Symbol: SNRNP70
  Gene Name: small nuclear ribonucleoprotein 70kDa (U1)
  Uniprot ID: P08621
  ENSP ID: ENSP00000468952

SEQ ID NO: 79922 - protein, 94 aa, Homo sapiens
  Payload ID: 15921
  Gene Symbol: SNRNP70
  Gene Name: small nuclear ribonucleoprotein 70kDa (U1)
  ENSP ID: ENSP00000470023
MERKRREKIERRQQEVETELKMWDPHNDPNAQGDAFKTLFVARVNYDTTESKLRREFEVYGPIKRIHMVYSKRSGKPRGYAFIEYEHERDMHST

SEQ ID NO: 79923 - protein, 166 aa, Homo sapiens; identical to SEQ ID NO: 79919
  Payload ID: 15921
  Gene Symbol: SNRNP70
  Gene Name: small nuclear ribonucleoprotein 70kDa (U1)
  Uniprot ID: P08621
  ENSP ID: ENSP00000471006

SEQ ID NO: 79924 - protein, 437 aa, Homo sapiens
  Payload ID: 15921
  Gene Symbol: SNRNP70
  Gene Name: small nuclear ribonucleoprotein 70kDa (U1)
  Uniprot ID: P08621
  ENSP ID: ENSP00000472998
MTQFLPPNLLALFAPRDPIPYLPPLEKLPHEKHHNQPYCGIAPYIREFEDPRDAPPPTRAETREERMERKRREKIERRQQEVETELKMWDPHNDPNAQGDAFKTLFVARVNYDTTESKLRREFEVYGPIKRIHMVYSKRSGKPRGYAFIEYEHERDMHSAYKHADGKKIDGRRVLVDVERGRTVKGWRPRRLGGGLGGTRRGGADVNIRHSGRDDTSRYDERPGPSPLPHRDRDRDRERERRERSRERDKERERRRSRSRDRRRRSRSRDKEERRRSRERSKDKDRDRKRRSSRSRERARRERERKEELRGGGGDMAEPSEAGDAPPDDGPPGELGPDGPDGPEEKGRDRDRERRRSHRSERERRRDRDRDRDRDREHKRGERGSERGRDEARGGGGGQDNGLEGLGNDSRDMYMESEGGDGYLAPENGYLMEAAPE

SEQ ID NO: 79925 - protein, 119 aa, Homo sapiens
  Payload ID: 15922
  Gene Symbol: SNRPD1
  Gene Name: small nuclear ribonucleoprotein D1 polypeptide 16kDa
  Uniprot ID: P62314
  ENSP ID: ENSP00000300413
MKLVRFLMKLSHETVTIELKNGTQVHGTITGVDVSMNTHLKAVKMTLKNREPVQLETLSIRGNNIRYFILPDSLPLDTLLVDVEPKVKSKKREAVAGRGRGRGRGRGRGRGRGRGGPRR

SEQ ID NO: 79926 - protein, 75 aa, Homo sapiens
  Payload ID: 15922
  Gene Symbol: SNRPD1
  Gene Name: small nuclear ribonucleoprotein D1 polypeptide 16kDa
  ENSP ID: ENSP00000463568
MTLKNREPVQLETLSIRGNNIRYFILPDSLPLDTLLVDVEPKVKSKKREAVAGRGRGRGRGRGRGRGRGRGGPRR

SEQ ID NO: 79927 - protein, 44 aa, Homo sapiens
  Payload ID: 15922
  Gene Symbol: SNRPD1
  Gene Name: small nuclear ribonucleoprotein D1 polypeptide 16kDa
  ENSP ID: ENSP00000463676
MKLVRFLMKLSHETVTIELKNGTQVHGTITVYLWIHYLWMLNLR

SEQ ID NO: 79928 - protein, 118 aa, Homo sapiens
  Payload ID: 15923
  Gene Symbol: SNRPD2
  Gene Name: small nuclear ribonucleoprotein D2 polypeptide 16.5kDa
  Uniprot ID: P62316
  ENSP ID: ENSP00000342374
MSLLNKPKSEMTPEELQKREEEEFNTGPLSVLTQSVKNNTQVLINCRNNKKLLGRVKAFDRHCNMVLENVKEMWTEVPKSGKGKKKSKPVNKDRYISKMFLRGDSVIVVLRNPLIAGK

SEQ ID NO: 79929 - protein, 108 aa, Homo sapiens
  Payload ID: 15923
  Gene Symbol: SNRPD2
  Gene Name: small nuclear ribonucleoprotein D2 polypeptide 16.5kDa
  Uniprot ID: P62316
  ENSP ID: ENSP00000375798
MTPEELQKREEEEFNTGPLSVLTQSVKNNTQVLINCRNNKKLLGRVKAFDRHCNMVLENVKEMWTEVPKSGKGKKKSKPVNKDRYISKMFLRGDSVIVVLRNPLIAGK

SEQ ID NO: 79930 - protein, 54 aa, Homo sapiens
  Payload ID: 15923
  Gene Symbol: SNRPD2
  Gene Name: small nuclear ribonucleoprotein D2 polypeptide 16.5kDa
  ENSP ID: ENSP00000465101
MVLENVKEMWTEVPKSGKGKKKSKPVNKDRYISKMFLRGDSVIVVLRNPLIAGK

SEQ ID NO: 79931 - protein, 118 aa, Homo sapiens; identical to SEQ ID NO: 79928
  Payload ID: 15923
  Gene Symbol: SNRPD2
  Gene Name: small nuclear ribonucleoprotein D2 polypeptide 16.5kDa
  Uniprot ID: P62316
  ENSP ID: ENSP00000465216

SEQ ID NO: 79932 - protein, 108 aa, Homo sapiens; identical to SEQ ID NO: 79929
  Payload ID: 15923
  Gene Symbol: SNRPD2
  Gene Name: small nuclear ribonucleoprotein D2 polypeptide 16.5kDa
  Uniprot ID: P62316
  ENSP ID: ENSP00000465952

SEQ ID NO: 79933 - protein, 108 aa, Homo sapiens; identical to SEQ ID NO: 79929
  Payload ID: 15923
  Gene Symbol: SNRPD2
  Gene Name: small nuclear ribonucleoprotein D2 polypeptide 16.5kDa
  Uniprot ID: P62316
  ENSP ID: ENSP00000466152

SEQ ID NO: 79934 - protein, 78 aa, Homo sapiens
  Payload ID: 15923
  Gene Symbol: SNRPD2
  Gene Name: small nuclear ribonucleoprotein D2 polypeptide 16.5kDa
  ENSP ID: ENSP00000468247
MSLLNKPKSEMTPEELQKREEEEFNTGPLSVLTQSVKNNTQVLINCRNNKKLLGRVKAFDSASPPCSPPGTATWCWRT

SEQ ID NO: 79935 - protein, 126 aa, Homo sapiens
  Payload ID: 15924
  Gene Symbol: SNRPD3
  Gene Name: small nuclear ribonucleoprotein D3 polypeptide 18kDa
  Uniprot ID: P62318
  ENSP ID: ENSP00000215829
MSIGVPIKVLHEAEGHIVTCETNTGEVYRGKLIEAEDNMNCQMSNITVTYRDGRVAQLEQVYIRGSKIRFLILPDMLKNAPMLKSMKNKNQGSGAGRGKAAILKAQVAARGRGRGMGRGNIFQKRR

SEQ ID NO: 79936 - protein, 120 aa, Homo sapiens
  Payload ID: 15924
  Gene Symbol: SNRPD3
  Gene Name: small nuclear ribonucleoprotein D3 polypeptide 18kDa
  Uniprot ID: P62318
  ENSP ID: ENSP00000385266
MSIGVPIKVLHEAEGHIVTCETNTGEVYRGKLIEAEDNMNCQMSNITVTYRDGRVAQLEQVYIRGSKIRFLILPDMLKNAPMLKSMKNKNQGSGAGRGKAAILKAQGYLSSLEWVLVHIC

SEQ ID NO: 79937 - protein, 126 aa, Homo sapiens; identical to SEQ ID NO: 79935
  Payload ID: 15924
  Gene Symbol: SNRPD3
  Gene Name: small nuclear ribonucleoprotein D3 polypeptide 18kDa
  Uniprot ID: P62318
  ENSP ID: ENSP00000456090

SEQ ID NO: 79938 - protein, 62 aa, Homo sapiens
  Payload ID: 15924
  Gene Symbol: SNRPD3
  Gene Name: small nuclear ribonucleoprotein D3 polypeptide 18kDa
  ENSP ID: ENSP00000456969
MSIGVPIKVLHEAEGHIVTCETNTGEVYRGKLIEAEDNMNCQMSNITVTYRDGRVAQLEQVI

SEQ ID NO: 79939 - protein, 282 aa, Homo sapiens
  Payload ID: 15925
  Gene Symbol: SNRPA
  Gene Name: small nuclear ribonucleoprotein polypeptide A
  Uniprot ID: P09012
  ENSP ID: ENSP00000243563
MAVPETRPNHTIYINNLNEKIKKDELKKSLYAIFSQFGQILDILVSRSLKMRGQAFVIFKEVSSATNALRSMQGFPFYDKPMRIQYAKTDSDIIAKMKGTFVERDRKREKRKPKSQETPATKKAVQGGGATPVVGAVQGPVPGMPPMTQAPRIMHHMPGQPPYMPPPGMIPPPGLAPGQIPPGAMPPQQLMPGQMPPAQPLSENPPNHILFLTNLPEETNELMLSMLFNQFPGFKEVRLVPGRHDIAFVEFDNEVQAGAARDALQGFKITQNNAMKISFAKK

SEQ ID NO: 79940 - protein, 128 aa, Homo sapiens
  Payload ID: 15925
  Gene Symbol: SNRPA
  Gene Name: small nuclear ribonucleoprotein polypeptide A
  ENSP ID: ENSP00000469224
MAVPETRPNHTIYINNLNEKIKKDELKKSLYAIFSQFGQILDILVSRSLKMRGQAFVIFKEVSSATNALRSMQGFPFYDKPMYAKTDSDIIAKMKGTFVERDRKREKRKPKSQETPATKKAVQGGGAT

SEQ ID NO: 79941 - protein, 184 aa, Homo sapiens
  Payload ID: 15925
  Gene Symbol: SNRPA
  Gene Name: small nuclear ribonucleoprotein polypeptide A
  ENSP ID: ENSP00000470534
MRGQAFVIFKEVSSATNALRSMQGFPFYDKPMRIQYAKTDSDIIAKMKGTFVERDRKREKRKPKSQETPATKKAVQGGGATPVVGAVQGPVPGMPPMTQAPRIMHHMPGQPPYMPPPGMIPPPGLAPGQIPPGAMPPQQLMPGQMPPAQPLSENPPNHILFLTNLPEETNELMLSMLFNQFPGF

SEQ ID NO: 79942 - protein, 87 aa, Homo sapiens
  Payload ID: 15925
  Gene Symbol: SNRPA
  Gene Name: small nuclear ribonucleoprotein polypeptide A
  ENSP ID: ENSP00000471230
MAVPETRPNHTIYINNLNEKIKKDELKKSLYAIFSQFGQILDILVSRSLKMRGQAFVIFKEVSSATNALRSMQGFPFYDKPMWCHLS

SEQ ID NO: 79943 - protein, 142 aa, Homo sapiens
  Payload ID: 15925
  Gene Symbol: SNRPA
  Gene Name: small nuclear ribonucleoprotein polypeptide A
  ENSP ID: ENSP00000472258
MAVPETRPNHTIYINNLNEKIKKDELKKSLYAIFSQFGQILDILVSRSLKMRGQAFVIFKEVSSATNALRSMQGFPFYDKPMRIQYAKTDSDIIAKMKGTFVERDRKREKRKPKSQETPATKKAVQGGGATPVVGAVQGPVP

SEQ ID NO: 79944 - protein, 256 aa, Homo sapiens
  Payload ID: 15925
  Gene Symbol: SNRPA
  Gene Name: small nuclear ribonucleoprotein polypeptide A
  ENSP ID: ENSP00000472355
MAVPETRPNHTIYINNLNEKIKKDELKKSLYAIFSQFGQILDILVSRSLKMRGQAFVIFKERIQYAKTDSDIIAKMKGTFVERDRKREKRKPKSQETPATKKAVQGGGATPVVGAVQGPVPGMPPMTQAPRIMHHMPGQPPYMPPPGMIPPPGLAPGQIPPGAMPPQQLMPGQMPPAQPLSENPPNHILFLTNLPEETNELMLSMLFNQFPGFKEVRLVPGRHDIAFVEFDNEVQAGAARDALQGFKITQNNAMKI

SEQ ID NO: 79945 - protein, 148 aa, Homo sapiens
  Payload ID: 15925
  Gene Symbol: SNRPA
  Gene Name: small nuclear ribonucleoprotein polypeptide A
  ENSP ID: ENSP00000472449
MAVPETRPNHTIYINNLNEKIKKDELKKSLYAIFSQFGQILDILVSRSLKMRGQAFVIFKEVSSATNALRSMQGFPFYDKPMRIQYAKTDSDIIAKMKGTFVERDRKREKRKPKSQETPATKKAVQGGGATPVVGAVQGPVPGMPPMT

SEQ ID NO: 79946 - protein, 255 aa, Homo sapiens
  Payload ID: 15926
  Gene Symbol: SNRPA1
  Gene Name: small nuclear ribonucleoprotein polypeptide A'
  Uniprot ID: P09661
  ENSP ID: ENSP00000254193
MVKLTAELIEQAAQYTNAVRDRELDLRGYKIPVIENLGATLDQFDAIDFSDNEIRKLDGFPLLRRLKTLLVNNNRICRIGEGLDQALPCLTELILTNNSLVELGDLDPLASLKSLTYLSILRNPVTNKKHYRLYVIYKVPQVRVLDFQKVKLKERQEAEKMFKGKRGAQLAKDIARRSKTFNPGAGLPTDKKKGGPSPGDVEAIKNAIANASTLAEVERLKGLLQSGQIPGRERRSGPTDDGEEEMEEDTVTNGS

SEQ ID NO: 79947 - protein, 154 aa, Homo sapiens
  Payload ID: 15926
  Gene Symbol: SNRPA1
  Gene Name: small nuclear ribonucleoprotein polypeptide A'
  ENSP ID: ENSP00000452836
MVKLTAELIEQAAQYTNAVRDRELDLRGYKIPVIENLGATLDQFDAIDFSDNEIRKLDGFPLLRRLKTLLVNNNRICRIGEGLDQALPCLTELILTNNSLVELGDLDPLASLKSLTYLSILRNPVTNKKHYRLYVIYKVPQVRVLDFQKVKLKF

SEQ ID NO: 79948 - protein, 89 aa, Homo sapiens
  Payload ID: 15926
  Gene Symbol: SNRPA1
  Gene Name: small nuclear ribonucleoprotein polypeptide A'
  ENSP ID: ENSP00000453309
MFKGKRGAQLAKDIARRSKTFNPGAGLPTDKKKGGPSPGDVEAIKNAIANASTLAEVERLKGLLQSGQIPGRERRSGPTDDGEEEMEED

SEQ ID NO: 79949 - protein, 142 aa, Homo sapiens
  Payload ID: 15926
  Gene Symbol: SNRPA1
  Gene Name: small nuclear ribonucleoprotein polypeptide A'
  ENSP ID: ENSP00000453521
LDPLASLKSLTYLSILRNPVTNKKHYRLYVIYKVPQVRVLDFQKVKLKERQEAEKMFKGKRGAQLAKDIARRSKTFNPGAGLPTDKKKGGPSPGDVEAIKNAIANASTLAEVERLKGLLQSGQIPGRERRSGEQMVFFVCSN

SEQ ID NO: 79950 - protein, 154 aa, Homo sapiens; identical to SEQ ID NO: 79947
  Payload ID: 15926
  Gene Symbol: SNRPA1
  Gene Name: small nuclear ribonucleoprotein polypeptide A'
  ENSP ID: ENSP00000486896

SEQ ID NO: 79951 - protein, 225 aa, Homo sapiens
  Payload ID: 15927
  Gene Symbol: SNRPB2
  Gene Name: small nuclear ribonucleoprotein polypeptide B
  Uniprot ID: P08579
  ENSP ID: ENSP00000246071
MDIRPNHTIYINNMNDKIKKEELKRSLYALFSQFGHVVDIVALKTMKMRGQAFVIFKELGSSTNALRQLQGFPFYGKPMRIQYAKTDSDIISKMRGTFADKEKKKEKKKAKTVEQTATTTNKKPGQGTPNSANTQGNSTPNPQVPDYPPNYILFLNNLPEETNEMMLSMLFNQFPGFKEVRLVPGRHDIAFVEFENDGQAGAARDALQGFKITPSHAMKITYAKK

SEQ ID NO: 79952 - protein, 225 aa, Homo sapiens; identical to SEQ ID NO: 79951
  Payload ID: 15927
  Gene Symbol: SNRPB2
  Gene Name: small nuclear ribonucleoprotein polypeptide B
  Uniprot ID: P08579
  ENSP ID: ENSP00000367178

SEQ ID NO: 79953 - protein, 159 aa, Homo sapiens
  Payload ID: 15928
  Gene Symbol: SNRPC
  Gene Name: small nuclear ribonucleoprotein polypeptide C
  Uniprot ID: P09234
  ENSP ID: ENSP00000244520
MPKFYCDYCDTYLTHDSPSVRKTHCSGRKHKENVKDYYQKWMEEQAQSLIDKTTAAFQQGKIPPTPFSAPPPAGAMIPPPPSLPGPPRPGMMPAPHMGGPPMMPMMGPPPPGMMPVGPAPGMRPPMGGHMPMMPGPPMMRPPARPMMVPTRPGMTRPDR

SEQ ID NO: 79954 - protein, 180 aa, Homo sapiens
  Payload ID: 15928
  Gene Symbol: SNRPC
  Gene Name: small nuclear ribonucleoprotein polypeptide C
  ENSP ID: ENSP00000363129
MNSASVDGHLSGCRLFLFLSPLFRFYCDYCDTYLTHDSPSVRKTHCSGRKHKENVKDYYQKWMEEQAQSLIDKTTAAFQQGKIPPTPFSAPPPAGAMIPPPPSLPGPPRPGMMPAPHMGGPPMMPMMGPPPPGMMPVGPAPGMRPPMGGHMPMMPGPPMMRPPARPMMVPTRPGMTRPDR

SEQ ID NO: 79955 - protein, 118 aa, Homo sapiens
  Payload ID: 15928
  Gene Symbol: SNRPC
  Gene Name: small nuclear ribonucleoprotein polypeptide C
  ENSP ID: ENSP00000363130
MEEQAQSLIDKTTAAFQQGKIPPTPFSAPPPAGAMIPPPPSLPGPPRPGMMPAPHMGGPPMMPMMGPPPPGMMPVGPAPGMRPPMGGHMPMMPGPPMMRPPARPMMVPTRPGMTRPDR

SEQ ID NO: 79956 - protein, 52 aa, Homo sapiens
  Payload ID: 15929
  Gene Symbol: SNRPE
  Gene Name: small nuclear ribonucleoprotein polypeptide E
  ENSP ID: ENSP00000356176
MRIEGCIIGFDEYMNLVLDDAEEIHSKTKSRKQLGRIMLKGDNITLLQSVSN

SEQ ID NO: 79957 - protein, 92 aa, Homo sapiens
  Payload ID: 15929
  Gene Symbol: SNRPE
  Gene Name: small nuclear ribonucleoprotein polypeptide E
  Uniprot ID: P62304
  ENSP ID: ENSP00000400591
MAYRGQGQKVQKVMVQPINLIFRYLQNRSRIQVWLYEQVNMRIEGCIIGFDEYMNLVLDDAEEIHSKTKSRKQLGRIMLKGDNITLLQSVSN

SEQ ID NO: 79958 - protein, 86 aa, Homo sapiens
  Payload ID: 15930
  Gene Symbol: SNRPF
  Gene Name: small nuclear ribonucleoprotein polypeptide F
  Uniprot ID: P62306
  ENSP ID: ENSP00000266735
MSLPLNPKPFLNGLTGKPVMVKLKWGMEYKGYLVSVDGYMNMQLANTEEYIDGALSGHLGEVLIRCNNVLYIRGVEEEEEDGEMRE

SEQ ID NO: 79959 - protein, 127 aa, Homo sapiens
  Payload ID: 15930
  Gene Symbol: SNRPF
  Gene Name: small nuclear ribonucleoprotein polypeptide F
  ENSP ID: ENSP00000447127
MSLPLNPKPFLNGLTGKPVMVKLKWGMEYKGYLVSVDGYMNMQIFIYILGILKQNGVSLSSPRLECNGMISAHCNLCLPGSSDSPASASRVAGITARTSRTLTKRSGAVEILALFLILGGKHSVFYH

SEQ ID NO: 79960 - protein, 67 aa, Homo sapiens
  Payload ID: 15930
  Gene Symbol: SNRPF
  Gene Name: small nuclear ribonucleoprotein polypeptide F
  ENSP ID: ENSP00000447751
MSLPLNPKPFLNGLTGKPVMVKLKWGMEYKGYLVSVDGYMNMQIFIYILGILKQSKILLFQLSEDLK

SEQ ID NO: 79961 - protein, 76 aa, Homo sapiens
  Payload ID: 15931
  Gene Symbol: SNRPG
  Gene Name: small nuclear ribonucleoprotein polypeptide G
  Uniprot ID: P62308
  ENSP ID: ENSP00000272348
MSKAHPPELKKFMDKKLSLKLNGGRHVQGILRGFDPFMNLVIDECVEMATSGQQNNIGMVVIRGNSIIMLEALERV

SEQ ID NO: 79962 - protein, 64 aa, Homo sapiens
  Payload ID: 15931
  Gene Symbol: SNRPG
  Gene Name: small nuclear ribonucleoprotein polypeptide G
  ENSP ID: ENSP00000391403
MDKKLSLKLNGGRHVQGILRGFDPFMNLVIDECVEMATSGQQNNIGMVVIRGNSIIMLEALERV

SEQ ID NO: 79963 - protein, 96 aa, Homo sapiens
  Payload ID: 15931
  Gene Symbol: SNRPG
  Gene Name: small nuclear ribonucleoprotein polypeptide G
  ENSP ID: ENSP00000393388
MSKAHPPELKKFMDKKLSLKLNGGRHVQGILRGFDPFMNLVIDECVEMATSGQQNNIGMVDNIPNKAVSPKFLKKVNQKGQLTFSKLLSIKTSKEW

SEQ ID NO: 79964 - protein, 64 aa, Homo sapiens; identical to SEQ ID NO: 79962
  Payload ID: 15931
  Gene Symbol: SNRPG
  Gene Name: small nuclear ribonucleoprotein polypeptide G
  ENSP ID: ENSP00000402194

SEQ ID NO: 79965 - protein, 68 aa, Homo sapiens
  Payload ID: 15931
  Gene Symbol: SNRPG
  Gene Name: small nuclear ribonucleoprotein polypeptide G
  ENSP ID: ENSP00000416334
MCLFMDKKLSLKLNGGRHVQGILRGFDPFMNLVIDECVEMATSGQQNNIGMVVIRGNSIIMLEALERV

SEQ ID NO: 79966 - protein, 64 aa, Homo sapiens; identical to SEQ ID NO: 79962
  Payload ID: 15931
  Gene Symbol: SNRPG
  Gene Name: small nuclear ribonucleoprotein polypeptide G
  ENSP ID: ENSP00000441332

SEQ ID NO: 79967 - protein, 240 aa, Homo sapiens [sequence omitted]

SEQ ID NO: 79968 - protein, 240 aa, Homo sapiens [sequence omitted]

SEQ ID NO: 79969 - protein, 240 aa, Homo sapiens [sequence omitted]

SEQ ID NO: 79970 - protein, 240 aa, Homo sapiens [sequence omitted]

SEQ ID NO: 79971 - protein, 244 aa, Homo sapiens
  Payload ID: 15932
  Gene Symbol: SNRPN
  Gene Name: small nuclear ribonucleoprotein polypeptide N
  Uniprot ID: P63162
  ENSP ID: ENSP00000452342
MMDSQTVGKSSKMLQHIDYRMRCILQDGRIFIGTFKAFDKHMNLILCDCDEFRKIKPKNAKQPEREEKRVLGLVLLRGENLVSMTVEGPPPKDTGIARVPLAGAAGGPGVGRAAGRGVPAGVPIPQAPAGLAGPVRGVGGPSQQVMTPQGRGTVAAAAVAATASIAGAPTQYPPGRGTPPPPVGRATPPPGIMAPPPGMRPPMGPPIGLPPARGTPIGMPPPGMRPPPPGIRGPPPPGMRPPRP

SEQ ID NO: 79972 - protein, 59 aa, Homo sapiens
  Payload ID: 15932
  Gene Symbol: SNRPN
  Gene Name: small nuclear ribonucleoprotein polypeptide N
  ENSP ID: ENSP00000462211
MTVGKSSKMLQHIDYRMRCILQDGRIFIGTFKAFDKHMNLILCDCDEFRKIKPKNAKQP

SEQ ID NO: 79973 - protein, 240 aa, Homo sapiens [sequence omitted]

SEQ ID NO: 79974 - protein, 169 aa, Homo sapiens
  Payload ID: 15932
  Gene Symbol: SNRPN
  Gene Name: small nuclear ribonucleoprotein polypeptide N
  ENSP ID: ENSP00000463510
MTVGKSSKMLQHIDYRMRCILQDGRIFIGTFKAFDKHMNLILCDCDEFRKIKPKNAKQPEREEKRVLGLVLLRGENLVSMTVEGPPPKDTGIARVPLAGAAGGPGVGRAAGRGVPAGVPIPQAPAGLAGPVRGVGGPSQQVMTPQGRGTVAAAAVAATASIAGAPTQYP

SEQ ID NO: 79975 - protein, 288 aa, Homo sapiens
  Payload ID: 15933
  Gene Symbol: SNRPB
  Gene Name: small nuclear ribonucleoprotein polypeptides B and B1
  ENSP ID: ENSP00000342305
MTVGKSSKMLQHIDYRMRCILQDGRIFIGTFKAFDKHMNLILCDCDEFRKIKPKNSKQAEREEKRVLGLVLLRGENLVSMTVEGPPPKDTGIARVPLAGAAGGPGIGRAAGRGIPAGVPMPQAPAGLAGPVRGVGGPSQQVMTPQGRGTVAAAAAAATASIAGAPTQYPPGRGGPPPPMGRGAPPPGMMGPPPGMRPPMGPPMGIPPGRGTPMGMPPPGMRPPPPGCEAFFDPWPQSMEVAPQRRGLDSSGPRYHRPVCFLCCCSWSLMGLSGFLTGPPPPGMRPPRP

SEQ ID NO: 79976 - protein, 231 aa, Homo sapiens
  Payload ID: 15933
  Gene Symbol: SNRPB
  Gene Name: small nuclear ribonucleoprotein polypeptides B and B1
  Uniprot ID: P14678
  ENSP ID: ENSP00000370746
MTVGKSSKMLQHIDYRMRCILQDGRIFIGTFKAFDKHMNLILCDCDEFRKIKPKNSKQAEREEKRVLGLVLLRGENLVSMTVEGPPPKDTGIARVPLAGAAGGPGIGRAAGRGIPAGVPMPQAPAGLAGPVRGVGGPSQQVMTPQGRGTVAAAAAAATASIAGAPTQYPPGRGGPPPPMGRGAPPPGMMGPPPGMRPPMGPPMGIPPGRGTPMGMPPPGMRPPPPGMRGLL

SEQ ID NO: 79977 - protein, 240 aa, Homo sapiens
  Payload ID: 15933
  Gene Symbol: SNRPB
  Gene Name: small nuclear ribonucleoprotein polypeptides B and B1
  Uniprot ID: P14678
  ENSP ID: ENSP00000412566
MTVGKSSKMLQHIDYRMRCILQDGRIFIGTFKAFDKHMNLILCDCDEFRKIKPKNSKQAEREEKRVLGLVLLRGENLVSMTVEGPPPKDTGIARVPLAGAAGGPGIGRAAGRGIPAGVPMPQAPAGLAGPVRGVGGPSQQVMTPQGRGTVAAAAAAATASIAGAPTQYPPGRGGPPPPMGRGAPPPGMMGPPPGMRPPMGPPMGIPPGRGTPMGMPPPGMRPPPPGMRGPPPPGMRPPRP

SEQ ID NO: 79978 - protein, 70 aa, Homo sapiens
  Payload ID: 15933
  Gene Symbol: SNRPB
  Gene Name: small nuclear ribonucleoprotein polypeptides B and B1
  ENSP ID: ENSP00000474579
MTVGKSSKMLQHIDYRMRCILQDGRIFIGTFKAFDKHMNLILCDCDEFRKIKCVRGESLSFWPHCLFVKL

SEQ ID NO: 79979 - protein, 368 aa, Homo sapiens
  Payload ID: 15934
  Gene Symbol: SNAPC1
  Gene Name: small nuclear RNA activating complex, polypeptide 1, 43kDa
  Uniprot ID: Q16533
  ENSP ID: ENSP00000216294
MGTPPGLQTDCEALLSRFQETDSVRFEDFTELWRNMKFGTIFCGRMRNLEKNMFTKEALALAWRYFLPPYTFQIRVGALYLLYGLYNTQLCQPKQKIRVALKDWDEVLKFQQDLVNAQHFDAAYIFRKLRLDRAFHFTAMPKLLSYRMKKKIHRAEVTEEFKDPSDRVMKLITSDVLEEMLNVHDHYQNMKHVISVDKSKPDKALSLIKDDFFDNIKNIVLEHQQWHKDRKNPSLKSKTNDGEEKMEGNSQETERCERAESLAKIKSKAFSVVIQASKSRRHRQVKLDSSDSDSASGQGQVKATRKKEKKERLKPAGRKMSLRNKGNVQNIHKEDKPLSLSMPVITEEEENESLSGTEFTASKKRRKH

SEQ ID NO: 79980 - protein, 334 aa, Homo sapiens
  Payload ID: 15935
  Gene Symbol: SNAPC2
  Gene Name: small nuclear RNA activating complex, polypeptide 2, 45kDa
  Uniprot ID: Q13487
  ENSP ID: ENSP00000221573
MKPPPRRRAAPARYLGEVTGPATWSAREKRQLVRLLQARQGQPEPDATELARELRGRSEAEIRVFLQQLKGRVAREAIQKVHPGGLQGPRRREAQPPAPIEVWTDLAEKITGPLEEALAVAFSQVLTIAATEPVTLLHSKPPKPTQARGKPLLLSAPGGQEDPAPEIPSSAPAAPSSAPRTPDPAPEKPSESSAGPSTEEDFAVDFEKIYKYLSSVSRSGRSPELSAAESAVVLDLLMSLPEELPLLPCTALVEHMTETYLRLTAPQPIPAGGSLGPAAEGDGAGSKAPEETPPATEKAEHSELKSPWQAAGICPLNPFLVPLELLGRAATPAR

SEQ ID NO: 79981 - protein, 279 aa, Homo sapiens
  Payload ID: 15935
  Gene Symbol: SNAPC2
  Gene Name: small nuclear RNA activating complex, polypeptide 2, 45kDa
  ENSP ID: ENSP00000469475
  MOD_RES (1)..(1): Any amino acid
XRAAPARYLGEVTGPATWSAREKRQLVRLLQARQGQPEPDATELARELRGRSEAEIRVFLQQLKGRVAREAIQKVHPGGLQGPRRREAQPPAPIEVWTDLAEKITGPLEEALAVAFSQVLTIAATEPVTLLHSKPPKPTQARGKPLLLSAPGGQEDPAPEIPSSAPAAPSSAPRTPDPAPEKPSESSAGPSTEEDFAVDFEKIYKYLSSVSRSGRSPELSAAGEKGEGGGRSRGIKGPWQQAGVSPYPSPPSITRVRCGPRPAHVTSRGAATPALHSPG

SEQ ID NO: 79982 - protein, 97 aa, Homo sapiens
  Payload ID: 15935
  Gene Symbol: SNAPC2
  Gene Name: small nuclear RNA activating complex, polypeptide 2, 45kDa
  ENSP ID: ENSP00000471962
MSLPEELPLLPCTALVEHMTETYLRLTAPQPIPAGGSLGPAAEGDGAGSKAPEETPPATEKAEHSELKSPWQAAGICPLNPFLVPLELLGRAATPAR

SEQ ID NO: 79983 - protein, 124 aa, Homo sapiens
  Payload ID: 15936
  Gene Symbol: SNAPC3
  Gene Name: small nuclear RNA activating complex, polypeptide 3, 50kDa
  ENSP ID: ENSP00000370177
MLVLGSQKLTQLRDSIRCVSDLQIGGEFSNTPDQAPEHISKDLYKSAFFYFEGTFYNDKRYPECRDLSRTIIEWSESHDRGYGKFQTARMEDFTFNDLCIKLGFPYLYCHQGDCEHVIVITDIR

SEQ ID NO: 79984 - protein, 411 aa, Homo sapiens
  Payload ID: 15936
  Gene Symbol: SNAPC3
  Gene Name: small nuclear RNA activating complex, polypeptide 3, 50kDa
  Uniprot ID: Q92966
  ENSP ID: ENSP00000370200
MAEGSRGGPTCSGVGGRQDPVSGSGGCNFPEYELPELNTRAFHVGAFGELWRGRLRGAGDLSLREPPASALPGSQAADSDREDAAVARDLDCSLEAAAELRAVCGLDKLKCLEDGEDPEVIPENTDLVTLGVRKRFLEHREETITIDRACRQETFVYEMESHAIGKKPENSADMIEEGELILSVNILYPVIFHKHKEHKPYQTMLVLGSQKLTQLRDSIRCVSDLQIGGEFSNTPDQAPEHISKDLYKSAFFYFEGTFYNDKRYPECRDLSRTIIEWSESHDRGYGKFQTARMEDFTFNDLCIKLGFPYLYCHQGDCEHVIVITDIRLVHHDDCLDRTLYPLLIKKHWLWTRKCFVCKMYTARWVTNNDSFAPEDPCFFCDVCFRMLHYDSEGNKLGEFLAYPYVDPGTFN

SEQ ID NO: 79985 - protein, 243 aa, Homo sapiens
  Payload ID: 15936
  Gene Symbol: SNAPC3
  Gene Name: small nuclear RNA activating complex, polypeptide 3, 50kDa
  ENSP ID: ENSP00000391832
MAEGSRGGPTCSGVGGRQDPVSGSGGCNFPEYELPELNTRAFHVGAFGELWRGRLRGAGDLSLREPPASALPGSQAADSDREDAAVARDLDCSLEAAAELRAVCGLDKLKCLEDGEDPEVIPENTDLVTLGVRKRFLEHREETITIDRACRQETFVYEMESHAIGKKPENSADMIEEGELILSVNILYPVIFHKDLYKSAFFYFEGTFYNDKRYPECRDLSRTIIEWSESHDRGYGKFQTARM

SEQ ID NO: 79986 - protein, 411 aa, Homo sapiens; identical to SEQ ID NO: 79984
  Payload ID: 15936
  Gene Symbol: SNAPC3
  Gene Name: small nuclear RNA activating complex, polypeptide 3, 50kDa
  Uniprot ID: Q92966
  ENSP ID: ENSP00000432393

SEQ ID NO: 79987 - protein, 411 aa, Homo sapiens; identical to SEQ ID NO: 79984
  Payload ID: 15936
  Gene Symbol: SNAPC3
  Gene Name: small nuclear RNA activating complex, polypeptide 3, 50kDa
  Uniprot ID: Q92966
  ENSP ID: ENSP00000436699

SEQ ID NO: 79988 - protein, 411 aa, Homo sapiens; identical to SEQ ID NO: 79984
  Payload ID: 15936
  Gene Symbol: SNAPC3
  Gene Name: small nuclear RNA activating complex, polypeptide 3, 50kDa
  Uniprot ID: Q92966
  ENSP ID: ENSP00000483273

SEQ ID NO: 79989 - protein, 1469 aa, Homo sapiens
  Payload ID: 15937
  Gene Symbol: SNAPC4
  Gene Name: small nuclear RNA activating complex, polypeptide 4, 190kDa
  Uniprot ID: Q5SXM2
  ENSP ID: ENSP00000298532
MDVDAEREKITQEIKELERILDPGSSGSHVEISESSLESDSEADSLPSEDLDPADPPISEEERWGEASNDEDDPKDKTLPEDPETCLQLNMVYQEVIQEKLAEANLLLAQNREQQEELMRDLAGSKGTKVKDGKSLPPSTYMGHFMKPYFKDKVTGVGPPANEDTREKAAQGIKAFEELLVTKWKNWEKALLRKSVVSDRLQRLLQPKLLKLEYLHQKQSKVSSELERQALEKQGREAEKEIQDINQLPEEALLGNRLDSHDWEKISNINFEGSRSAEEIRKFWQNSEHPSINKQEWSREEEERLQAIAAAHGHLEWQKIAEELGTSRSAFQCLQKFQQHNKALKRKEWTEEEDRMLTQLVQEMRVGSHIPYRRIVYYMEGRDSMQLIYRWTKSLDPGLKKGYWAPEEDAKLLQAVAKYGEQDWFKIREEVPGRSDAQCRDRYLRRLHFSLKKGRWNLKEEEQLIELIEKYGVGHWAKIASELPHRSGSQCLSKWKIMMGKKQGLRRRRRRARHSVRWSSTSSSGSSSGSSGGSSSSSSSSSEEDEPEQAQAGEGDRALLSPQYMVPDMDLWVPARQSTSQPWRGGAGAWLGGPAASLSPPKGSSASQGGSKEASTTAAAPGEETSPVQVPARAHGPVPRSAQASHSADTRPAGAEKQALEGGRRLLTVPVETVLRVLRANTAARSCTQKEQLRQPPLPTSSPGVSSGDSVARSHVQWLRHRATQSGQRRWRHALHRRLLNRRLLLAVTPWVGDVVVPCTQASQRPAVVQTQADGLREQLQQARLASTPVFTLFTQLFHIDTAGCLEVVRERKALPPRLPQAGARDPPVHLLQASSSAQSTPGHLFPNVPAQEASKSASHKGSRRLASSRVERTLPQASLLASTGPRPKPKTVSELLQEKRLQEARAREATRGPVVLPSQLLVSSSVILQPPLPHTPHGRPAPGPTVLNVPLSGPGAPAAAKPGTSGSWQEAGTSAKDKRLSTMQALPLAPVFSEAEGTAPAASQAPALGPGQISVSCPESGLGQSQAPAASRKQGLPEAPPFLPAAPSPTPLPVQPLSLTHIGGPHVATSVPLPVTWVLTAQGLLPVPVPAVVSLPRPAGTPGPAGLLATLLPPLTETRAAQGPRAPALSSSWQPPANMNREPEPSCRTDTPAPPTHALSQSPAEADGSVAFVPGEAQVAREIPEPRTSSHADPPEAEPPWSGRLPAFGGVIPATEPRGTPGSPSGTQEPRGPLGLEKLPLRQPGPEKGALDLEKPPLPQPGPEKGALDLGLLSQEGEAATQQWLGGQRGVRVPLLGSRLPYQPPALCSLRALSGLLLHKKALEHKATSLVVGGEAERPAGALQASLGLVRGQLQDNPAYLLLRARFLAAFTLPALLATLAPQGVRTTLSVPSRVGSESEDEDLLSELELADRDGQPGCTTATCPIQGAPDSGKCSASSCLDTSNDPDDLDVLRTRHARHTRKRRRLV

SEQ ID NO: 79990 - protein, 68 aa, Homo sapiens
  Payload ID: 15938
  Gene Symbol: SNAPC5
  Gene Name: small nuclear RNA activating complex, polypeptide 5, 19kDa
  Uniprot ID: O75971
  ENSP ID: ENSP00000308439
MLSRLQELRKEEETLLRLKAALHDQLNRLKMLVHVDNEASINQTTLELSTKSHVTEEEEEEEEEESDS

SEQ ID NO: 79991 - protein, 98 aa, Homo sapiens
  Payload ID: 15938
  Gene Symbol: SNAPC5
  Gene Name: small nuclear RNA activating complex, polypeptide 5, 19kDa
  Uniprot ID: O75971
  ENSP ID: ENSP00000319597
MLSRLQELRKEEETLLRLKAALHDQLNRLKVEELALQSMISSRRGDEMLSSHTVPEQSHDMLVHVDNEASINQTTLELSTKSHVTEEEEEEEEEESDS

SEQ ID NO: 79992 - protein, 98 aa, Homo sapiens; identical to SEQ ID NO: 79991
  Payload ID: 15938
  Gene Symbol: SNAPC5
  Gene Name: small nuclear RNA activating complex, polypeptide 5, 19kDa
  Uniprot ID: O75971
  ENSP ID: ENSP00000378954

SEQ ID NO: 79993 - protein, 98 aa, Homo sapiens; identical to SEQ ID NO: 79991
  Payload ID: 15938
  Gene Symbol: SNAPC5
  Gene Name: small nuclear RNA activating complex, polypeptide 5, 19kDa
  Uniprot ID: O75971
  ENSP ID: ENSP00000454421

SEQ ID NO: 79994 - protein, 67 aa, Homo sapiens
  Payload ID: 15938
  Gene Symbol: SNAPC5
  Gene Name: small nuclear RNA activating complex, polypeptide 5, 19kDa
  ENSP ID: ENSP00000455626
MLSRLQELRKEEETLLRLKAALHDQLNRLKVTPRPSPAPPPFLPSDHFPPTWASVVTTCCGQFSATH

SEQ ID NO: 79995 - protein, 83 aa, Homo sapiens
  Payload ID: 15938
  Gene Symbol: SNAPC5
  Gene Name: small nuclear RNA activating complex, polypeptide 5, 19kDa
  ENSP ID: ENSP00000455680
MLSRLQELRKEEETLLRLKAALHDQLNRLKVEELALQSMISSRRGDEMLSSHTVPEQSHDVSLIKCRPRRECKVCSAPMLLGW

SEQ ID NO: 79996 - protein, 67 aa, Homo sapiens; identical to SEQ ID NO: 79994
  Payload ID: 15938
  Gene Symbol: SNAPC5
  Gene Name: small nuclear RNA activating complex, polypeptide 5, 19kDa
  ENSP ID: ENSP00000456716

SEQ ID NO: 79997 - protein, 98 aa, Homo sapiens; identical to SEQ ID NO: 79991
  Payload ID: 15938
  Gene Symbol: SNAPC5
  Gene Name: small nuclear RNA activating complex, polypeptide 5, 19kDa
  Uniprot ID: O75971
  ENSP ID: ENSP00000457892

SEQ ID NO: 79998 - protein, 89 aa, Homo sapiens
  Payload ID: 15939
  Gene Symbol: SPRR1A
  Gene Name: small proline-rich protein 1A
  Uniprot ID: P35321
  ENSP ID: ENSP00000357751
MNSQQQKQPCTPPPQPQQQQVKQPCQPPPQEPCIPKTKEPCHPKVPEPCHPKVPEPCQPKVPEPCQPKVPEPCPSTVTPAPAQQKTKQK

SEQ ID NO: 79999 - protein, 89 aa, Homo sapiens
  Payload ID: 15940
  Gene Symbol: SPRR1B
  Gene Name: small proline-rich protein 1B
  Uniprot ID: P22528
  ENSP ID: ENSP00000306461
MSSQQQKQPCTPPPQLQQQQVKQPCQPPPQEPCIPKTKEPCHPKVPEPCHPKVPEPCQPKVPEPCHPKVPEPCPSIVTPAPAQQKTKQK

SEQ ID NO: 80000 - protein, 72 aa, Homo sapiens
  Payload ID: 15941
  Gene Symbol: SPRR2A
  Gene Name: small proline-rich protein 2A
  Uniprot ID: P35326
  ENSP ID: ENSP00000376423
MSYQQQQCKQPCQPPPVCPTPKCPEPCPPPKCPEPCPPPKCPQPCPPQQCQQKYPPVTPSPPCQSKYPPKSK

SEQ ID NO: 80001 - protein, 72 aa, Homo sapiens
  Payload ID: 15942
  Gene Symbol: SPRR2B
  Gene Name: small proline-rich protein 2B
  Uniprot ID: P35325
  ENSP ID: ENSP00000357744
MSYQQQQCKQPCQPPPVCPTPKCPEPCPPPKCPEPCPPPKCPQPCPPQQCQQKYPPVTPSPPCQPKYPPKSK

SEQ ID NO: 80002 - protein, 72 aa, Homo sapiens
  Payload ID: 15943
  Gene Symbol: SPRR2D
  Gene Name: small proline-rich protein 2D
  Uniprot ID: P22532
  ENSP ID: ENSP00000353542
MSYQQQQCKQPCQPPPVCPTPKCPEPCPPPKCPEPCPSPKCPQPCPPQQCQQKYPPVTPSPPCQPKCPPKSK

SEQ ID NO: 80003 - protein, 72 aa, Homo sapiens; identical to SEQ ID NO: 80002
  Payload ID: 15943
  Gene Symbol: SPRR2D
  Gene Name: small proline-rich protein 2D
  Uniprot ID: P22532
  ENSP ID: ENSP00000357745

SEQ ID NO: 80004 - protein, 72 aa, Homo sapiens; identical to SEQ ID NO: 80002
  Payload ID: 15943
  Gene Symbol: SPRR2D
  Gene Name: small proline-rich protein 2D
  Uniprot ID: P22532
  ENSP ID: ENSP00000357746

SEQ ID NO: 80005 - protein, 72 aa, Homo sapiens; identical to SEQ ID NO: 80002
  Payload ID: 15943
  Gene Symbol: SPRR2D
  Gene Name: small proline-rich protein 2D
  Uniprot ID: P22532
  ENSP ID: ENSP00000357747

SEQ ID NO: 80006 - protein, 72 aa, Homo sapiens
  Payload ID: 15944
  Gene Symbol: SPRR2E
  Gene Name: small proline-rich protein 2E
  Uniprot ID: P22531
  ENSP ID: ENSP00000357739
MSYQQQQCKQPCQPPPVCPTPKCPEPCPPPKCPEPCPPPKCPQPCPPQQCQQKCPPVTPSPPCQPKCPPKSK

SEQ ID NO: 80007 - protein, 72 aa, Homo sapiens; identical to SEQ ID NO: 80006
  Payload ID: 15944
  Gene Symbol: SPRR2E
  Gene Name: small proline-rich protein 2E
  Uniprot ID: P22531
  ENSP ID: ENSP00000357740

SEQ ID NO: 80008 - protein, 72 aa, Homo sapiens
  Payload ID: 15945
  Gene Symbol: SPRR2F
  Gene Name: small proline-rich protein 2F
  Uniprot ID: Q96RM1
  ENSP ID: ENSP00000418193
MSYQQQQCKQPCQPPPVCPAPKCPEPCPPPKCPEPCPPSKCPQSCPPQQCQQKCPPVTPSPPCQPKCPPKSK

SEQ ID NO: 80009 - protein, 73 aa, Homo sapiens
  Payload ID: 15946
  Gene Symbol: SPRR2G
  Gene Name: small proline-rich protein 2G
  Uniprot ID: Q9BYE4
  ENSP ID: ENSP00000357737
MSYQQQQCKQPCQPPPVCPTPKCPEPCPPPKCPEPYLPPPCPPEHCPPPPCQDKCPPVQPYPPCQQKYPPKSK

SEQ ID NO: 80010 - protein, 169 aa, Homo sapiens
  Payload ID: 15947
  Gene Symbol: SPRR3
  Gene Name: small proline-rich protein 3
  Uniprot ID: Q9UBC9
  ENSP ID: ENSP00000295367
MSSYQQKQTFTPPPQLQQQQVKQPSQPPPQEIFVPTTKEPCHSKVPQPGNTKIPEPGCTKVPEPGCTKVPEPGCTKVPEPGCTKVPEPGCTKVPEPGCTKVPEPGYTKVPEPGSIKVPDQGFIKFPEPGAIKVPEQGYTKVPVPGYTKLPEPCPSTVTPGPAQQKTKQK

SEQ ID NO: 80011 - protein, 169 aa, Homo sapiens; identical to SEQ ID NO: 80010
  Payload ID: 15947
  Gene Symbol: SPRR3
  Gene Name: small proline-rich protein 3
  Uniprot ID: Q9UBC9
  ENSP ID: ENSP00000330391

SEQ ID NO: 80012 - protein, 158 aa, Homo sapiens
  Payload ID: 15947
  Gene Symbol: SPRR3
  Gene Name: small proline-rich protein 3
  ENSP ID: ENSP00000402016
MSSYQQKQTFTPPPQLQQQQVKQPSQPPPQEIFVPTTKEPCHSKVPQPGNTKIPEPGCTKVPEPGCTKVPEPGCTKVPEPGCTKVPEPGCTKVPEPGCTKVPEPGYTKVPEPGSIKVPDQGFIKFPEPGAIKVPEQGYTKVPVPGYTKLPEPCPSTVT

SEQ ID NO: 80013 - protein, 79 aa, Homo sapiens
  Payload ID: 15948
  Gene Symbol: SPRR4
  Gene Name: small proline-rich protein 4
  Uniprot ID: Q96PI1
  ENSP ID: ENSP00000332163
MSSQQQQRQQQQCPPQRAQQQQVKQPCQPPPVKCQETCAPKTKDPCAPQVKKQCPPKGTIIPAQQKCPSAQQASKSKQK

SEQ ID NO: 80014 - protein, 76 aa, Homo sapiens
  Payload ID: 15949
  Gene Symbol: SUMO1
  Gene Name: small ubiquitin-like modifier 1
  Uniprot ID: P63165
  ENSP ID: ENSP00000376075
MSDQDSSEIHFKVKMTTHLKKLKESYCQRQGVPMNSLRFLFEGQRIADNHTPKELGMEEEDVIEVYQEQTGGHSTV

SEQ ID NO: 80015 - protein, 101 aa, Homo sapiens
  Payload ID: 15949
  Gene Symbol: SUMO1
  Gene Name: small ubiquitin-like modifier 1
  Uniprot ID: P63165
  ENSP ID: ENSP00000376076
MSDQEAKPSTEDLGDKKEGEYIKLKVIGQDSSEIHFKVKMTTHLKKLKESYCQRQGVPMNSLRFLFEGQRIADNHTPKELGMEEEDVIEVYQEQTGGHSTV

SEQ ID NO: 80016 - protein, 101 aa, Homo sapiens; identical to SEQ ID NO: 80015
  Payload ID: 15949
  Gene Symbol: SUMO1
  Gene Name: small ubiquitin-like modifier 1
  Uniprot ID: P63165
  ENSP ID: ENSP00000376077

SEQ ID NO: 80017 - protein, 62 aa, Homo sapiens
  Payload ID: 15949
  Gene Symbol: SUMO1
  Gene Name: small ubiquitin-like modifier 1
  ENSP ID: ENSP00000386267
MTTHLKKLKESYCQRQGVPMNSLRFLFEGQRIADNHTPKELGMEEEDVIEVYQEQTGGHSTV

SEQ ID NO: 80018 - protein, 77 aa, Homo sapiens
  Payload ID: 15949
  Gene Symbol: SUMO1
  Gene Name: small ubiquitin-like modifier 1
  ENSP ID: ENSP00000386296
MSDQEAKPSTEDLGDKKEGEYIKLKVIGQDSSEIHFKVKMTTHLKKLKESYCQRQLGMEEEDVIEVYQEQTGGHSTV

SEQ ID NO: 80019 - protein, 62 aa, Homo sapiens; identical to SEQ ID NO: 80017
  Payload ID: 15949
  Gene Symbol: SUMO1
  Gene Name: small ubiquitin-like modifier 1
  ENSP ID: ENSP00000386472

SEQ ID NO: 80020 - protein, 73 aa, Homo sapiens
  Payload ID: 15949
  Gene Symbol: SUMO1
  Gene Name: small ubiquitin-like modifier 1
  ENSP ID: ENSP00000386500
MSDQESLNPESLVRRHGEKWSQAHTMMADKGREADNLFFLRRSLALSPSLECSGAISTRCNLRLPGSRGKTFN

SEQ ID NO: 80021 - protein, 58 aa, Homo sapiens
  Payload ID: 15949
  Gene Symbol: SUMO1
  Gene Name: small ubiquitin-like modifier 1
  ENSP ID: ENSP00000386753
MSDQEAKPSTEDLGDKKEGEYIKLKVIGQDSSEIHFKVKMTTHLKKLKESYCQRQVSL

SEQ ID NO: 80022 - protein, 146 aa, Homo sapiens
  Payload ID: 15949
  Gene Symbol: SUMO1
  Gene Name: small ubiquitin-like modifier 1
  ENSP ID: ENSP00000387204
MSDQEAKPSTEDLGDKKEGEYIKLKVIGQDSSEIHFKVKMTTHLKKLKESYCQRQGVPMNSLRFLFEGQRIADNHTPKEAQWPTPAILALWEAEAGWITAGQELRPAWATWRNLISTKNRKSSQLGMEEEDVIEVYQEQTGGHSTV

SEQ ID NO: 80023 - protein, 71 aa, Homo sapiens
  Payload ID: 15950
  Gene Symbol: SUMO2
  Gene Name: small ubiquitin-like modifier 2
  Uniprot ID: P61956
  ENSP ID: ENSP00000400886
MADEKPKEGVKTENNDHINLKVAGQDGSVVQFKIKRHTPLSKLMKAYCERQLEMEDEDTIDVFQQQTGGVY

SEQ ID NO: 80024 - protein, 95 aa, Homo sapiens
  Payload ID: 15950
  Gene Symbol: SUMO2
  Gene Name: small ubiquitin-like modifier 2
  Uniprot ID: P61956
  ENSP ID: ENSP00000405965
MADEKPKEGVKTENNDHINLKVAGQDGSVVQFKIKRHTPLSKLMKAYCERQGLSMRQIRFRFDGQPINETDTPAQLEMEDEDTIDVFQQQTGGVY

SEQ ID NO: 80025 - protein, 52 aa, Homo sapiens
  Payload ID: 15950
  Gene Symbol: SUMO2
  Gene Name: small ubiquitin-like modifier 2
  ENSP ID: ENSP00000461997
MKAYCERQGLSMRQIRFRFDGQPINETDTPAQLEMEDEDTIDVFQQQTGGVY

SEQ ID NO: 80026 - protein, 103 aa, Homo sapiens
  Payload ID: 15951
  Gene Symbol: SUMO3
  Gene Name: small ubiquitin-like modifier 3
  Uniprot ID: P55854
  ENSP ID: ENSP00000330343
MSEEKPKEGVKTENDHINLKVAGQDGSVVQFKIKRHTPLSKLMKAYCERQGLSMRQIRFRFDGQPINETDTPAQLEMEDEDTIDVFQQQTGGVPESSLAGHSF

SEQ ID NO: 80027 - protein, 147 aa, Homo sapiens
  Payload ID: 15951
  Gene Symbol: SUMO3
  Gene Name: small ubiquitin-like modifier 3
  ENSP ID: ENSP00000380990
MSEEKPKEGVKTENDHINLKVAGQDGSVVQFKIKRHTPLSKLMKAYCERQGLSMRQIRFRFDGQPINETDTPAQGIILSWKELWTWKQTFFFETESRFVAQARMQWRSLSSLCKLCLLSSRHSPASASQVAGTIGAHHHSRLIFLYF

SEQ ID NO: 80028 - protein, 135 aa, Homo sapiens
  Payload ID: 15951
  Gene Symbol: SUMO3
  Gene Name: small ubiquitin-like modifier 3
  ENSP ID: ENSP00000380995
MSEEKPKEGVKTENDHINLKVAGQDGSVVQFKIKRHTPLSKLMKAYCERQGLSMRQIRFRFDGQPINETDTPAQVRSWLRVVPGRLPICAGWRWRTRTPSTCSSSRREVCRRAAWQGTVSRGPVPSPGRPSSHCC

SEQ ID NO: 80029 - protein, 141 aa, Homo sapiens
  Payload ID: 15951
  Gene Symbol: SUMO3
  Gene Name: small ubiquitin-like modifier 3
  Uniprot ID: P55854
  ENSP ID: ENSP00000409666
MSEEKPKEGVKTENDHINLKVAGQDGSVVQFKIKRHTPLSKLMKAYCERQVRHLAPPQSLPVCALVLCVPGIPRARASRGWTQMQLPEGLSMRQIRFRFDGQPINETDTPAQLEMEDEDTIDVFQQQTGGVPESSLAGHSF

SEQ ID NO: 80030 - protein, 95 aa, Homo sapiens
  Payload ID: 15952
  Gene Symbol: SUMO4
  Gene Name: small ubiquitin-like modifier 4
  Uniprot ID: Q6EEV6
  ENSP ID: ENSP00000318635
MANEKPTEEVKTENNNHINLKVAGQDGSVVQFKIKRQTPLSKLMKAYCEPRGLSVKQIRFRFGGQPISGTDKPAQLEMEDEDTIDVFQQPTGGVY

SEQ ID NO: 80031 - protein, 66 aa, Homo sapiens
  Payload ID: 15953
  Gene Symbol: SVBP
  Gene Name: small vasohibin binding protein
  Uniprot ID: Q8N300
  ENSP ID: ENSP00000361599
MDPPARKEKTKVKESVSRVEKAKQKSAQQELKQRQRAEIYALNRVMTELEQQQFDEFCKQMQPPGE

SEQ ID NO: 80032 - protein, 66 aa, Homo sapiens; identical to SEQ ID NO: 80031
  Payload ID: 15953
  Gene Symbol: SVBP
  Gene Name: small vasohibin binding protein
  Uniprot ID: Q8N300
  ENSP ID: ENSP00000361600

SEQ ID NO: 80033 - protein, 77 aa, Homo sapiens
  Payload ID: 15954
  Gene Symbol: SVIP
  Gene Name: small VCP/p97-interacting protein
  Uniprot ID: Q8NHG7
  ENSP ID: ENSP00000346130
MGLCFPCPGESAPPTPDLEEKRAKLAEAAERRQKEAASRGILDVQSVQEKRKKKEKIEKQIATSGPPPEGGLRWTVS

SEQ ID NO: 80034 - protein, 1058 aa, Homo sapiens
  Payload ID: 15955
  Gene Symbol: SLF1
  Gene Name: SMC5-SMC6 complex localization factor 1
  Uniprot ID: Q9BQI6
  ENSP ID: ENSP00000265140
MEDGTPKHIIQMTGFKMEEKEALVKLLLKLDCTFIKSEKYKNCTHLIAERLCKSEKFLAACAAGKWILTKDYIIHSAKSGRWLDETTYEWGYKIEKDSRYSPQMQSAPKRWREELKRTGAPGAFHRWKVVLLVRTDKRSDSLIRVLEAGKANVILPKSSPSGITHVIASNARIKAEKEKDNFKAPFYPIQYLGDFLLEKEIQNDEDSQTNSVWTEHSNEETNKDFRKDAGFLEMKGALRETMYRTQKEMQNHEDVNVGSILIQHHKKEKFSGSSKDLKFVKMRNTFGSHTYENQKEIKKKDEDIQRSYTLRRKRKKGKESNCKKGVEHEKIKSTLRRHIYNRDQKEMKNSIFAEYAKESKAMAIKTDVDVVEIKNTLRKHIYRAQAVRYNCIRIDKQPVYNVEVKNAEFPRGVLNLIESLIEGHFFKEAIEELSTLQAHYIPPVCVLHALLENVLQDNIDTFSGRYFHILSALLHLHPPWKSPAMSRYYLELFQCPTCMKGAWSLVEVLIRSCLFNESFCHQISENIGSKVLHLTLLKFFFNLIESEVQHLSQKLYDWSDSQNLKITGKAMLLEIFWSGSETSGLLTKPVNMLLEWTIYSHKEKFKSNDVFKHELAYLLAGILGAAIDYWIFLGLKMGRNVMRHMSDDLGSYVSLSCDDFSSQELEIFICSFSSSWLQMFVAEAVFKKLCLQSSGSVSSEPLSLQKMVYSYLPALGKTGVLGSGKIQVSKKIGQRPCFDSQRTLLMLNGTKQKQVEGLPELLDLNLAKCSSSLKKLKKKSEGELSCSKENCPSVVKKMNFHKTNLKGETALHRACINNQVEKLILLLSLPGIDINVKDNAGWTPLHEACNYGNTVCVQEILQRCPEVDLLTQVDGVTPLHDALSNGHVEIGKLLLQHGGPVLLQQRNAKGELPLDYVVSPQIKEELFAITKIEDTVENFHAQAEKHFHYQQLEFGSFLLSRMLLNFCSIFDLSSEFILASKGLTHLNELLMACKSHKETTSVHTDWLLDLYAGNIKTLQKLPHILKELPENLKVCPGVHTEALMITLEMMCRSVMEFS

SEQ ID NO: 80035 - protein, 179 aa, Homo sapiens
  Payload ID: 15955
  Gene Symbol: SLF1
  Gene Name: SMC5-SMC6 complex localization factor 1
  Uniprot ID: Q9BQI6
  ENSP ID: ENSP00000424232
MEDGTPKHIIQMTGFKMEEKEALVKLLLKLDCTFIKSEKYKNCTHLIAERLCKSEKFLAACAAGKWILTKDYIIHSAKSGRWLDETTYEWGYKIEKDSRYSPQMQSAPKRWREELKRTGAPGAFHRWKVVLLVRTDKRSDSLIRKKFRMMKIPKPILFGLNIAMKKQTKISGKMQDFLK

SEQ ID NO: 80036 - protein, 130 aa, Homo sapiens
  Payload ID: 15955
  Gene Symbol: SLF1
  Gene Name: SMC5-SMC6 complex localization factor 1
  ENSP ID: ENSP00000425022
MEDGTPKHIIQMTGFKMEEKEALVKLLLKLDCTFIKSEKYKNCTHLIAERLCKSEKFLAACAAGKWILTKDYIIHSAKSGRWLDETTYEWGYKIEKDSRYSPQMQSAPKRWREELKRTGAPGAFHRWKVV

SEQ ID NO: 80037 - protein, 129 aa, Homo sapiens
  Payload ID: 15955
  Gene Symbol: SLF1
  Gene Name: SMC5-SMC6 complex localization factor 1
  ENSP ID: ENSP00000430335
  MOD_RES (1)..(1): Any amino acid
XKLLLKLDCTFIKSEKYKNCTHLIAERLCKSEKFLAACAAGKWILTKDYIIHSAKSGRWLDETTYEWGYKIEKDSRYSPQMQSAPKRWREELKRTGAPGAFHRWKVVLLVRTDKRSDSLIRLSDTTALE

SEQ ID NO: 80038 - protein, 1173 aa, Homo sapiens
  Payload ID: 15956
  Gene Symbol: SLF2
  Gene Name: SMC5-SMC6 complex localization factor 2
  Uniprot ID: Q8IX21
  ENSP ID: ENSP00000238961
MTRRCMPARPGFPSSPAPGSSPPRCHLRPGSTAHAAAGKRTESPGDRKQSIIDFFKPASKQDRHMLDSPQKSNIKYGGSRLSITGTEQFERKLSSPKESKPKRVPPEKSPIIEAFMKGVKEHHEDHGIHESRRPCLSLASKYLAKGTNIYVPSSYHLPKEMKSLKKKHRSPERRKSLFIHENNEKNDRDRGKTNADSKKQTTVAEADIFNNSSRSLSSRSSLSRHHPEESPLGAKFQLSLASYCRERELKRLRKEQMEQRINSENSFSEASSLSLKSSIERKYKPRQEQRKQNDIIPGKNNLSNVENGHLSRKRSSSDSWEPTSAGSKQNKFPEKRKRNSVDSDLKSTRESMIPKARESFLEKRPDGPHQKEKFIKHIALKTPGDVLRLEDISKEPSDETDGSSAGLAPSNSGNSGHHSTRNSDQIQVAGTKETKMQKPHLPLSQEKSAIKKASNLQKNKTASSTTKEKETKLPLLSRVPSAGSSLVPLNAKNCALPVSKKDKERSSSKECSGHSTESTKHKEHKAKTNKADSNVSSGKISGGPLRSEYGTPTKSPPAALEVVPCIPSPAAPSDKAPSEGESSGNSNAGSSALKRKLRGDFDSDEESLGYNLDSDEEEETLKSLEEIMALNFNQTPAATGKPPALSKGLRSQSSDYTGHVHPGTYTNTLERLVKEMEDTQRLDELQKQLQEDIRQGRGIKSPIRIGEEDSTDDEDGLLEEHKEFLKKFSVTIDAIPDHHPGEEIFNFLNSGKIFNQYTLDLRDSGFIGQSAVEKLILKSGKTDQIFLTTQGFLTSAYHYVQCPVPVLKWLFRMMSVHTDCIVSVQILSTLMEITIRNDTFSDSPVWPWIPSLSDVAAVFFNMGIDFRSLFPLENLQPDFNEDYLVSETQTTSRGKESEDSSYKPIFSTLPETNILNVVKFLGLCTSIHPEGYQDREIMLLILMLFKMSLEKQLKQIPLVDFQSLLINLMKNIRDWNTKVPELCLGINELSSHPHNLLWLVQLVPNWTSRGRQLRQCLSLVIISKLLDEKHEDVPNASNLQVSVLHRYLVQMKPSDLLKKMVLKKKAEQPDGIIDDSLHLELEKQAYYLTYILLHLVGEVSCSHSFSSGQRKHFVLLCGALEKHVKCDIREDARLFYRTKVKDLVARIHGKWQEIIQNCRPTQGQLHDFWVPDS

SEQ ID NO: 80039 - protein, 1186 aa, Homo sapiens
  Payload ID: 15956
  Gene Symbol: SLF2
  Gene Name: SMC5-SMC6 complex localization factor 2
  Uniprot ID: Q8IX21
  ENSP ID: ENSP00000359292
MTRRCMPARPGFPSSPAPGSSPPRCHLRPGSTAHAAAGKRTESPGDRKQSIIDFFKPASKQDRHMLDSPQKSNIKYGGSRLSITGTEQFERKLSSPKESKPKRVPPEKSPIIEAFMKGVKEHHEDHGIHESRRPCLSLASKYLAKGTNIYVPSSYHLPKEMKSLKKKHRSPERRKSLFIHENNEKNDRDRGKTNADSKKQTTVAEADIFNNSSRSLSSRSSLSRHHPEESPLGAKFQLSLASYCRERELKRLRKEQMEQRINSENSFSEASSLSLKSSIERKYKPRQEQRKQNDIIPGKNNLSNVENGHLSRKRSSSDSWEPTSAGSKQNKFPEKRKRNSVDSDLKSTRESMIPKARESFLEKRPDGPHQKEKFIKHIALKTPGDVLRLEDISKEPSDETDGSSAGLAPSNSGNSGHHSTRNSDQIQVAGTKETKMQKPHLPLSQEKSAIKKASNLQKNKTASSTTKEKETKLPLLSRVPSAGSSLVPLNAKNCALPVSKKDKERSSSKECSGHSTESTKHKEHKAKTNKADSNVSSGKISGGPLRSEYGTPTKSPPAALEVVPCIPSPAAPSDKAPSEGESSGNSNAGSSALKRKLRGDFDSDEESLGYNLDSDEEEETLKSLEEIMALNFNQTPAATGKPPALSKGLRSQSSDYTGHVHPGTYTNTLERLVKEMEDTQRLDELQKQLQEDIRQGRGIKSPIRIGEEDSTDDEDGLLEEHKEFLKKFSVTIDAIPDHHPGEEIFNFLNSGKIFNQYTLDLRDSGFIGQSAVEKLILKSGKTDQIFLTTQGFLTSAYHYVQCPVPVLKWLFRMMSVHTDCIVSVQILSTLMEITIRNDTFSDSPVWPWIPSLSDVAAVFFNMGIDFRSLFPLENLQPDFNEDYLVSETQTTSRGKESEDSSYKPIFSTLPETNILNVVKFLGLCTSIHPEGYQDREIMLLILMLFKMSLEKQLKQIPLVDFQSLLINLMKNIRDWNTKVPELCLGINELSSHPHNLLWLVQLVPNWTSRGRQLRQCLSLVIISKLLDEKHEDVPNASNLQVSVLHRYLVQMKPSDLLKKMVLKKKAEQPDGIIDDSLHLELEKQAYYLTYILLHLVGEVSCSHSFSSGQRKHFVLLCGALEKHVKCDIREDARLFYRTKVKDLVARIHGKWQEIIQNCRPTQVSFCYTISCILNSFAEWHSSYCLK

SEQ ID NO: 80040 - protein, 758 aa, Homo sapiens
  Payload ID: 15956
  Gene Symbol: SLF2
  Gene Name: SMC5-SMC6 complex localization factor 2
  ENSP ID: ENSP00000359294
MTRRCMPARPGFPSSPAPGSSPPRCHLRPGSTAHAAAGKRTESPGDRKQSIIDFFKPASKQDRHMLDSPQKSNIKYGGSRLSITGTEQFERKLSSPKESKPKRVPPEKSPIIEAFMKGVKEHHEDHGIHESRRPCLSLASKYLAKGTNIYVPSSYHLPKEMKSLKKKHRSPERRKSLFIHENNEKNDRDRGKTNADSKKQTTVAEADIFNNSSRSLSSRSSLSRHHPEESPLGAKFQLSLASYCRERELKRLRKEQMEQRINSENSFSEASSLSLKSSIERKYKPRQEQRKQNDIIPGKNNLSNVENGHLSRKRSSSDSWEPTSAGSKQNKFPEKRKRNSVDSDLKSTRESMIPKARESFLEKRPDGPHQKEKFIKHIALKTPGDVLRLEDISKEPSDETDGSSAGLAPSNSGNSGHHSTRNSDQIQVAGTKETKMQKPHLPLSQEKSAIKKASNLQKNKTASSTTKEKETKLPLLSRVPSAGSSLVPLNAKNCALPVSKKDKERSSSKECSGHSTESTKHKEHKAKTNKADSNVSSGKISGGPLRSEYGTPTKSPPAALEVVPCIPSPAAPSDKAPSEGESSGNSNAGSSALKRKLRGDFDSDEESLGYNLDSDEEEETLKSLEEIMALNFNQTPAATGKPPALSKGLRSQSSDYTGHVHPGTYTNTLERLVKEMEDTQRFVSIKINLLNLTFCLFVWLTFNLPFLKNHEKLACILDSVVNCVRIRYVGRTQWLMPVITTLWETQARLLEPRSSRLR

SEQ ID NO: 80041 - protein, 63 aa, Homo sapiens
  Payload ID: 15956
  Gene Symbol: SLF2
  Gene Name: SMC5-SMC6 complex localization factor 2
  Uniprot ID: Q8IX21
  ENSP ID: ENSP00000476379
MTRRCMPARPGFPSSPAPGSSPPRCHLRPGSTAHAAAGKRTESPGDRYRAEGLRRGRVAGARV

SEQ ID NO: 80042 - protein, 3661 aa, Homo sapiens
  Payload ID: 15957
  Gene Symbol: SMG1
  Gene Name: SMG1 phosphatidylinositol 3-kinase-related kinase
  Uniprot ID: Q96Q15
  ENSP ID: ENSP00000402515
MSRRAPGSRLSSGGGGGGTKYPRSWNDWQPRTDSASADPDNLKYSSSRDRGGSSSYGLQPSNSAVVSRQRHDDTRVHADIQNDEKGGYSVNGGSGENTYGRKSLGQELRVNNVTSPEFTSVQHGSRALATKDMRKSQERSMSYSDESRLSNLLRRITREDDRDRRLATVKQLKEFIQQPENKLVLVKQLDNILAAVHDVLNESSKLLQELRQEGACCLGLLCASLSYEAEKIFKWIFSKFSSSAKDEVKLLYLCATYKALETVGEKKAFSSVMQLVMTSLQSILENVDTPELLCKCVKCILLVARCYPHIFSTNFRDTVDILVGWHIDHTQKPSLTQQVSGWLQSLEPFWVADLAFSTTLLGQFLEDMEAYAEDLSHVASGESVDEDVPPPSVSLPKLAALLRVFSTVVRSIGERFSPIRGPPITEAYVTDVLYRVMRCVTAANQVFFSEAVLTAANECVGVLLGSLDPSMTIHCDMVITYGLDQLENCQTCGTDYIISVLNLLTLIVEQINTKLPSSFVEKLFIPSSKLLFLRYHKEKEVVAVAHAVYQAVLSLKNIPVLETAYKLILGEMTCALNNLLHSLQLPEACSEIKHEAFKNHVFNVDNAKFVVIFDLSALTTIGNAKNSLIGMWALSPTVFALLSKNLMIVHSDLAVHFPAIQYAVLYTLYSHCTRHDHFISSSLSSSSPSLFDGAVISTVTTATKKHFSIILNLLGILLKKDNLNQDTRKLLMTWALEAAVLMKKSETYAPLFSLPSFHKFCKGLLANTLVEDVNICLQACSSLHALSSSLPDDLLQRCVDVCRVQLVHSGTRIRQAFGKLLKSIPLDVVLSNNNHTEIQEISLALRSHMSKAPSNTFHPQDFSDVISFILYGNSHRTGKDNWLERLFYSCQRLDKRDQSTIPRNLLKTDAVLWQWAIWEAAQFTVLSKLRTPLGRAQDTFQTIEGIIRSLAAHTLNPDQDVSQWTTADNDEGHGNNQLRLVLLLQYLENLEKLMYNAYEGCANALTSPPKVIRTFFYTNRQTCQDWLTRIRLSIMRVGLLAGQPAVTVRHGFDLLTEMKTTSLSQGNELEVTIMMVVEALCELHCPEAIQGIAVWSSSIVGKNLLWINSVAQQAEGRFEKASVEYQEHLCAMTGVDCCISSFDKSVLTLANAGRNSASPKHSLNGESRKTVLSKPTDSSPEVINYLGNKACECYISIADWAAVQEWQNAIHDLKKSTSSTSLNLKADFNYIKSLSSFESGKFVECTEQLELLPGENINLLAGGSKEKIDMKKLLPNMLSPDPRELQKSIEVQLLRSSVCLATALNPIEQDQKWQSITENVVKYLKQTSRIAIGPLRLSTLTVSQSLPVLSTLQLYCSSALENTVSNRLSTEDCLIPLFSEALRSCKQHDVRPWMQALRYTMYQNQLLEKIKEQTVPIRSHLMELGLTAAKFARKRGNVSLATRLLAQCSEVQLGKTTTAQDLVQHFKKLSTQGQVDEKWGPELDIEKTKLLYTAGQSTHAMEMLSSCAISFCKSVKAEYAVAKSILTLAKWIQAEWKEISGQLKQVYRAQHQQNFTGLSTLSKNILTLIELPSVNTMEEEYPRIESESTVHIGVGEPDFILGQLYHLSSVQAPEVAKSWAALASWAYRWGRKVVDNASQGEGVRLLPREKSEVQNLLPDTITEEEKERIYGILGQAVCRPAGIQDEDITLQITESEDNEEDDMVDVIWRQLISSCPWLSELDESATEGVIKVWRKVVDRIFSLYKLSCSAYFTFLKLNAGQIPLDEDDPRLHLSHRVEQSTDDMIVMATLRLLRLLVKHAGELRQYLEHGLETTPTAPWRGIIPQLFSRLNHPEVYVRQSICNLLCRVAQDSPHLILYPAIVGTISLSSESQASGNKFSTAIPTLLGNIQGEELLVSECEGGSPPASQDSNKDEPKSGLNEDQAMMQDCYSKIVDKLSSANPTMVLQVQMLVAELRRVTVLWDELWLGVLLQQHMYVLRRIQQLEDEVKRVQNNNTLRKEEKIAIMREKHTALMKPIVFALEHVRSITAAPAETPHEKWFQDNYGDAIENALEKLKTPLNPAKPGSSWIPFKEIMLSLQQRAQKRASYILRLEEISPWLAAMTNTEIALPGEVSARDTVTIHSVGGTITILPTKTKPKKLLFLGSDGKSYPYLFKGLEDLHLDERIMQFLSIVNTMFATINRQETPRFHARHYSVTPLGTRSGLIQWVDGATPLFGLYKRWQQREAALQAQKAQDSYQTPQNPGIVPRPSELYYSKIGPALKTVGLSLDVSRRDWPLHVMKAVLEELMEATPPNLLAKELWSSCTTPDEWWRVTQSYARSTAVMSMVGYIIGLGDRHLDNVLIDMTTGEVVHIDYNVCFEKGKSLRVPEKVPFRMTQNIETALGVTGVEGVFRLSCEQVLHIMRRGRETLLTLLEAFVYDPLVDWTAGGEAGFAGAVYGGGGQQAESKQSKREMEREITRSLFSSRVAEIKVNWFKNRDEMLVVLPKLDGSLDEYLSLQEQLTDVEKLQGKLLEEIEFLEGAEGVDHPSHTLQHRYSEHTQLQTQQRAVQEAIQVKLNEFEQWITHYQAAFNNLEATQLASLLQEISTQMDLGPPSYVPATAFLQNAGQAHLISQCEQLEGEVGALLQQRRSVLRGCLEQLHHYATVALQYPKAIFQKHRIEQWKTWMEELICNTTVERCQELYRKYEMQYAPQPPPTVCQFITATEMTLQRYAADINSRLIRQVERLKQEAVTVPVCEDQLKEIERCIKVFLHENGEEGSLSLASVIISALCTLTRRNLMMEGAASSAGEQLVDLTSRDGAWFLEELCSMSGNVTCLVQLLKQCHLVPQDLDIPNPMEASETVHLANGVYTSLQELNSNFRQIIFPEALRCLMKGEYTLESMLHELDGLIEQTTDGVPLQTLVESLQAYLRNAAMGLEEETHAHYIDVARLLHAQYGELIQPRNGSVDETPKMSAGQMLLVAFDGMFAQVETAFSLLVEKLNKMEIPIAWRKIDIIREARSTQVNFFDDDNHRQVLEEIFFLKRLQTIKEFFRLCGTFSKTLSGSSSLEDQNTVNGPVQIVNVKTLFRNSCFSEDQMAKPIKAFTADFVRQLLIGLPNQALGLTLCSFISALGVDIIAQVEAKDFGAESKVSVDDLCKKAVEHNIQIGKFSQLVMNRATVLASSYDTAWKKHDLVRRLETSISSCKTSLQRVQLHIAMFQWQHEDLLINRPQAMSVTPPPRSAILTSMKKKLHTLSQIETSIATVQEKLAALESSIEQRLKWAGGANPALAPVLQDFEATIAERRNLVLKESQRASQVTFLCSNIIHFESLRTRTAEALNLDAALFELIKRCQQMCSFASQFNSSVSELELRLLQRVDTGLEHPIGSSEWLLSAHKQLTQDMSTQRAIQTEKEQQIETVCETIQNLVDNIKTVLTGHNRQLGDVKHLLKAMAKDEEAALADGEDVPYENSVRQFLGEYKSWQDNIQTVLFTLVQAMGQVRSQEHVEMLQEITPTLKELKTQSQSIYNNLVSFASPLVTDATNECSSPTSSATYQPSFAAAVRSNTGQKTQPDVMSQNARKLIQKNLATSADTPPSTVPGTGKSVACSPKKAVRDPKTGKAVQERNSYAVSVWKRVKAKLEGRDVDPNRRMSVAEQVDYVIKEATNLDNLAQLYEGWTAWV

SEQ ID NO: 80043 - protein, 335 aa, Homo sapiens
  Payload ID: 15957
  Gene Symbol: SMG1
  Gene Name: SMG1 phosphatidylinositol 3-kinase-related kinase
  ENSP ID: ENSP00000432825
MRFLRTDSASADPDNLKYSSSRDRGGSSSYGLQPSNSAVVSRQRHDDTRVHADIQNDEKGGYSVNGGSGENTYGRKSLGQELRVNNVTSPEFTSVQHGSRALATKDMRKSQERSMSYSDESRLSNLLRRITREDDRDRRLATVKQLKEFIQQPENKLVLVKQLDNILAAVHDVLNESSKLLQELRQEGACCLGLLCASLSYEAEKIFKWIFSKFSSSAKDEVKLLYLCATYKALETVGEKKAFSSVMQLVMTSLQSILENVDTPELLCKCVKCILLVARCYPHIFSTNFRDTVDILVGWHIDHTQKPSLTQQVSGWLQSLEPFWVADLAFSTTLL

SEQ ID NO: 80044 - protein, 62 aa, Homo sapiens
  Payload ID: 15957
  Gene Symbol: SMG1
  Gene Name: SMG1 phosphatidylinositol 3-kinase-related kinase
  ENSP ID: ENSP00000455453
MRKSQERSMSYSDESRLSNLLRRITREDDRDRRLATVKQLKEFIQQPENKLVLVKQLDNILA

SEQ ID NO: 80045 - protein, 853 aa, Homo sapiens
  Payload ID: 15957
  Gene Symbol: SMG1
  Gene Name: SMG1 phosphatidylinositol 3-kinase-related kinase
  ENSP ID: ENSP00000455861
  MOD_RES (1)..(1): Any amino acid
XEMTCALNNLLHSLQLPEACSEIKHEAFKNHVFNVDNAKFVVIFDLSALTTIGNAKNSLIGMWALSPTVFALLSKNLMIVHSDLAVHFPAIQYAVLYTLYSHCTRHDHFISSSLSSSSPSLFDGAVISTVTTATKKHFSIILNLLGILLKKDNLNQDTRKLLMTWALEAAVLMKKSETYAPLFSLPSFHKFCKGLLANTLVEDVNICLQACSSLHALSSSLPDDLLQRCVDVCRVQLVHSGTRIRQAFGKLLKSIPLDVVLSNNNHTEIQEISLALRSHMSKAPSNTFHPQDFSDVISFILYGNSHRTGKDNWLERLFYSCQRLDKRDQSTIPRNLLKTDAVLWQWAIWEAAQFTVLSKLRTPLGRAQDTFQTIEGIIRSLAAHTLNPDQDVSQWTTADNDEGHGNNQLRLVLLLQYLENLEKLMYNAYEGCANALTSPPKVIRTFFYTNRQTCQDWLTRIRLSIMRVGLLAGQPAVTVRHGFDLLTEMKTTSLSQGNELEVTIMMVVEALCELHCPEAIQGIAVWSSSIVGKNLLWINSVAQQAEGRFEKASVEYQEHLCAMTGVDCCISSFDKSVLTLANAGRNSASPKHSLNGESRKTVLSKPTDSSPEVINYLGNKACECYISIADWAAVQEWQNAIHDLKKSTSSTSLNLKADFNYIKSLSSFESGKFVECTEQLELLPGENINLLAGGSKEKIDMKKLLPNMLSPDPRELQKSIEVQLLRSSVCLATALNPIEQDQKWQSITENVVKYLKQTSRIAIGPLRLSTLTVSQSLPVLSTLQLYCSSALENTVSNRLSTEDCLIPLFSEALRSCKQHDVRPWMQALRYTMYQNQLLEKIKGKWFFFLVREN

SEQ ID NO: 80046 - protein, 56 aa, Homo sapiens
  Payload ID: 15957
  Gene Symbol: SMG1
  Gene Name: SMG1 phosphatidylinositol 3-kinase-related kinase
  ENSP ID: ENSP00000456025
MRFLRTDSASADPDNLKYSSSRDRGGSSSYGLQPSNSAVVSRQRHDDTRVHADIQN

SEQ ID NO: 80047 - protein, 3551 aa, Homo sapiens
  Payload ID: 15957
  Gene Symbol: SMG1
  Gene Name: SMG1 phosphatidylinositol 3-kinase-related kinase
  ENSP ID: ENSP00000456259
QPSNSAVVSRQRHDDTRVHADIQNDEKERSMSYSDESRLSNLLRRITREDDRDRRLATVKQLKEFIQQPENKLVLVKQLDNILAAVHDVLNESSKLLQELRQEGACCLGLLCASLSYEAEKIFKWIFSKFSSSAKDEVKLLYLCATYKALETVGEKKAFSSVMQLVMTSLQSILENVDTPELLCKCVKCILLVARCYPHIFSTNFRDTVDILVGWHIDHTQKPSLTQQVSGWLQSLEPFWVADLAFSTTLLGQFLEDMEAYAEDLSHVASGESVDEDVPPPSVSLPKLAALLRVFSTVVRSIGERFSPIRGPPITEAYVTDVLYRVMRCVTAANQVFFSEAVLTAANECVGVLLGSLDPSMTIHCDMVITYGLDQLENCQTCGTDYIISVLNLLTLIVEQINTKLPSSFVEKLFIPSSKLLFLRYHKEKEVVAVAHAVYQAVLSLKNIPVLETAYKLILGEMTCALNNLLHSLQLPEACSEIKHEAFKNHVFNVDNAKFVVIFDLSALTTIGNAKNSLIGMWALSPTVFALLSKNLMIVHSDLAVHFPAIQYAVLYTLYSHCTRHDHFISSSLSSSSPSLFDGAVISTVTTATKKHFSIILNLLGILLKKDNLNQDTRKLLMTWALEAAVLMKKSETYAPLFSLPSFHKFCKGLLANTLVEDVNICLQACSSLHALSSSLPDDLLQRCVDVCRVQLVHSGTRIRQAFGKLLKSIPLDVVLSNNNHTEIQEISLALRSHMSKAPSNTFHPQDFSDVISFILYGNSHRTGKDNWLERLFYSCQRLDKRDQSTIPRNLLKTDAVLWQWAIWEAAQFTVLSKLRTPLGRAQDTFQTIEGIIRSLAAHTLNPDQDVSQWTTADNDEGHGNNQLRLVLLLQYLENLEKLMYNAYEGCANALTSPPKVIRTFFYTNRQTCQDWLTRIRLSIMRVGLLAGQPAVTVRHGFDLLTEMKTTSLSQGNELEVTIMMVVEALCELHCPEAIQGIAVWSSSIVGKNLLWINSVAQQAEGRFEKASVEYQEHLCAMTGVDCCISSFDKSVLTLANAGRNSASPKHSLNGESRKTVLSKPTDSSPEVINYLGNKACECYISIADWAAVQEWQNAIHDLKKSTSSTSLNLKADFNYIKSLSSFESGKFVECTEQLELLPGENINLLAGGSKEKIDMKKLLPNMLSPDPRELQKSIEVQLLRSSVCLATALNPIEQDQKWQSITENVVKYLKQTSRIAIGPLRLSTLTVSQSLPVLSTLQLYCSSALENTVSNRLSTEDCLIPLFSEALRSCKQHDVRPWMQALRYTMYQNQLLEKIKEQTVPIRSHLMELGLTAAKFARKRGNVSLATRLLAQCSEVQLGKTTTAQDLVQHFKKLSTQGQVDEKWGPELDIEKTKLLYTAGQSTHAMEMLSSCAISFCKSVKAEYAVAKSILTLAKWIQAEWKEISGQLKQVYRAQHQQNFTGLSTLSKNILTLIELPSVNTMEEEYPRIESESTVHIGVGEPDFILGQLYHLSSVQAPEVAKSWAALASWAYRWGRKVVDNASQGEGVRLLPREKSEVQNLLPDTITEEEKERIYGILGQAVCRPAGIQDEDITLQITESEDNEEDDMVDVIWRQLISSCPWLSELDESATEGVIKVWRKVVDRIFSLYKLSCSAYFTFLKLNAGQIPLDEDDPRLHLSHRVEQSTDDMIVMATLRLLRLLVKHAGELRQYLEHGLETTPTAPWRGIIPQLFSRLNHPEVYVRQSICNLLCRVAQDSPHLILYPAIVGTISLSSESQASGNKFSTAIPTLLGNIQGEELLVSECEGGSPPASQDSNKDEPKSGLNEDQAMMQDCYSKIVDKLSSANPTMVLQVQMLVAELRRVTVLWDELWLGVLLQQHMYVLRRIQQLEDEVKRVQNNNTLRKEEKIAIMREKHTALMKPIVFALEHVRSITAAPAETPHEKWFQDNYGDAIENALEKLKTPLNPAKPGSSWIPFKEIMLSLQQRAQKRASYILRLEEISPWLAAMTNTEIALPGEVSARDTVTIHSVGGTITILPTKTKPKKLLFLGSDGKSYPYLFKGLEDLHLDERIMQFLSIVNTMFATINRQETPRFHARHYSVTPLGTRSGLIQWVDGATPLFGLYKRWQQREAALQAQKAQDSYQTPQNPGIVPRPSELYYSKIGPALKTVGLSLDVSRRDWPLHVMKAVLEELMEATPPNLLAKELWSSCTTPDEWWRVTQSYARSTAVMSMVGYIIGLGDRHLDNVLIDMTTGEVVHIDYNVCFEKGKSLRVPEKVPFRMTQNIETALGVTGVEGVFRLSCEQVLHIMRRGRETLLTLLEAFVYDPLVDWTAGGEAGFAGAVYGGGGQQAESKQSKREMEREITRSLFSSRVAEIKVNWFKNRDEMLVVLPKLDGSLDEYLSLQEQLTDVEKLQGKLLEEIEFLEGAEGVDHPSHTLQHRYSEHTQLQTQQRAVQEAIQVKLNEFEQWITHYQAAFNNLEATQLASLLQEISTQMDLGPPSYVPATAFLQNAGQAHLISQCEQLEGEVGALLQQRRSVLRGCLEQLHHYATVALQYPKAIFQKHRIEQWKTWMEELICNTTVERCQELYRKYEMQYAPQPPPTVCQFITATEMTLQRYAADINSRLIRQVERLKQEAVTVPVCEDQLKEIERCIKVFLHENGEEGSLSLASVIISALCTLTRRNLMMEGAASSAGEQLVDLTSRDGAWFLEELCSMSGNVTCLVQLLKQCHLVPQDLDIPNPMEASETVHLANGVYTSLQELNSNFRQIIFPEALRCLMKGEYTLESMLHELDGLIEQTTDGVPLQTLVESLQAYLRNAAMGLEEETHAHYIDVARLLHAQYGELIQPRNGSVDETPKMSAGQMLLVAFDGMFAQVETAFSLLVEKLNKMEIPIAWRKIDIIREARSTQVNFFDDDNHRQVLEEIFFLKRLQTIKEFFRLCGTFSKTLSGSSSLEDQNTVNGPVQIVNVKTLFRNSCFSEDQMAKPIKAFTADFVRQLLIGLPNQALGLTLCSFISALGVDIIAQVEAKDFGAESKVSVDDLCKKAVEHNIQIGKFSQLVMNRATVLASSYDTAWKKHDLVRRLETSISSCKTSLQRVQLHIAMFQWQHEDLLINRPQAMSVTPPPRSAILTSMKKKLHTLSQIETSIATVQEKLAALESSIEQRLKWAGGANPALAPVLQDFEATIAERRNLVLKESQRASQVTFLCSNIIHFESLRTRTAEALNLDAALFELIKRCQQMCSFASQFNSSVSELELRLLQRVDTGLEHPIGSSEWLLSAHKQLTQDMSTQRAIQTEKEQQIETVCETIQNLVDNIKTVLTGHNRQLGDVKHLLKAMAKDEEAALADGEDVPYENSVRQFLGEYKSWQDNIQTVLFTLVQAMGQVRSQEHVEMLQEITPTLKELKTQSQSIYNNLVSFASPLVTDATNECSSPTSSATYQPSFAAAVRSNTGQKTQPDVMSQNARKLIQKNLATSADTPPSTVPGTGKSVACSPKKAVRDPKTGKAVQERNSYAVSVWKRVKAKLEGRDVDPNRRMSVAEQVDYVIKEATNLDNLAQLYEGWTAWV

SEQ ID NO: 80048 - protein, 607 aa, Homo sapiens
  Payload ID: 15957
  Gene Symbol: SMG1
  Gene Name: SMG1 phosphatidylinositol 3-kinase-related kinase
  ENSP ID: ENSP00000458380
MRFLRTDSASADPDNLKYSSSRDRGGSSSYGLQPSNSAVVSRQRHDDTRVHADIQNDEKGGYSVNGGSGENTYGRKSLGQELRVNNVTSPEFTSVQHGSRALATKDMRKSQERSMSYSDESRLSNLLRRITREDDRDRRLATVKQLKEFIQQPENKLVLVKQLDNILAAVHDVLNESSKLLQELRQEGACCLGLLCASLSYEAEKIFKWIFSKFSSSAKDEVKLLYLCATYKALETVGEKKAFSSVMQLVMTSLQSILENVDTPELLCKCVKCILLVARCYPHIFSTNFRDTVDILVGWHIDHTQKPSLTQQVSGWLQSLEPFWVADLAFSTTLLGQFLEDMEAYAEDLSHVASGESVDEDVPPPSVSLPKLAALLRVFSTVVRSIGERFSPIRGPPITEAYVTDVLYRVMRCVTAANQVFFSEAVLTAANECVGVLLGSLDPSMTIHCDMVITYGLDQLENCQTCGTDYIISVLNLLTLIVEQINTKLPSSFVEKLFIPSSKLLFLRYHKEKEVVAVAHAVYQAVLSLKNIPVLETAYKLILGEMTCALNNLLHSLQLPEACSEIKHEAFKNHVFNVDNAKFVVIFDLSALTTIGNAKNSLIGVSL

SEQ ID NO: 80049 - protein, 321 aa, Homo sapiens
  Payload ID: 15957
  Gene Symbol: SMG1
  Gene Name: SMG1 phosphatidylinositol 3-kinase-related kinase
  ENSP ID: ENSP00000458558
  MOD_RES (1)..(1): Any amino acid
XHFPAIQYAVLYTLYSHCTRHDHFISSSLSSSSPSLFDGAVISTVTTATKKHFSIILNLLGILLKKDNLNQDTRKLLMTWALEAAVLMKKSETYAPLFSLPSFHKFCKGLLANTLVEDVNICLQACSSLHALSSSLPDDLLQRCVDVCRVQLVHSGTRIRQAFGKLLKSIPLDVVLSNNNHTEIQEISLALRSHMSKAPSNTFHPQDFSDVISFILYGNSHRTGKDNWLERLFYSCQRLDKRDQSTIPRNLLKTDAVLWQWAIWEAAQFTVLSKLRTPLGRAQDTFQTIEGIIRSLAAHTLNPDQDVSQWTTADNDEGHGH

SEQ ID NO: 80050 - protein, 551 aa, Homo sapiens
  Payload ID: 15957
  Gene Symbol: SMG1
  Gene Name: SMG1 phosphatidylinositol 3-kinase-related kinase
  ENSP ID: ENSP00000460854
  MOD_RES (1)..(1): Any amino acid
XTDSASADPDNLKYSSSRDRGGSSSYGLQPSNSAVVSRQRHDDTRVHADIQNDEKERSMSYSDESRLSNLLRRITREDDRDRRLATVKQLKEFIQQPENKLVLVKQLDNILAAVHDVLNESSKLLQELRQEGACCLGLLCASLSYEAEKIFKWIFSKFSSSAKDEVKLLYLCATYKALETVGEKKAFSSVMQLVMTSLQSILENVDTPELLCKCVKCILLVARCYPHIFSTNFRDTVDILVGWHIDHTQKPSLTQQVSGWLQSLEPFWVADLAFSTTLLGQFLEDMEAYAEDLSHVASGESVDEDVPPPSVSLPKLAALLRVFSTVVRSIGERFSPIRGPPITEAYVTDVLYRVMRCVTAANQVFFSEAVLTAANECVGVLLGSLDPSMTIHCDMVITYGLDQLENCQTCGTDYIISVLNLLTLIVEQINTKLPSSFVEKLFIPSSKLLFLRYHKEKEVVAVAHAVYQAVLSLKNIPVLETAYKLILGEMTCALNNLLHSLQLPEACSEIKHEAFKNHVFNVDNAKFVVIFDLSALTTIGNAKNSLIGVSL

SEQ ID NO: 80051 - protein, 197 aa, Homo sapiens
  Payload ID: 15957
  Gene Symbol: SMG1
  Gene Name: SMG1 phosphatidylinositol 3-kinase-related kinase
  ENSP ID: ENSP00000481150
MSYSDESRLSNLLRRITREDDRDRRLATVKQLKEFIQQPENKLVLVKQLDNILAAVHDVLNESSKLLQELRQEGACCLGLLCASLSYEAEKIFKWIFSKFSSSAKDEVKLLYLCATYKALETVGEKKAFSSVMQLVMTSLQSILENVDTPELLCKCVKCILLVARCYPHIFSTNFRVSSSFRFSDHGVRGMVVCVRI

SEQ ID NO: 80052 - protein, 85 aa, Homo sapiens
  Payload ID: 15957
  Gene Symbol: SMG1
  Gene Name: SMG1 phosphatidylinositol 3-kinase-related kinase
  ENSP ID: ENSP00000484278
  MOD_RES (1)..(1): Any amino acid
XEMKTTSLSQGNELEVTIMMVVEALCELHCPEAIQGIAVWSSSIVGKNLLWINSVAQQAEGSIEACYKSLHQEASSVCSLVSSNT

SEQ ID NO: 80053 - protein, 1016 aa, Homo sapiens
  Payload ID: 15958
  Gene Symbol: SMG5
  Gene Name: SMG5 nonsense mediated mRNA decay factor
  Uniprot ID: Q9UPR3
  ENSP ID: ENSP00000355261
MSQGPPTGESSEPEAKVLHTKRLYRAVVEAVHRLDLILCNKTAYQEVFKPENISLRNKLRELCVKLMFLHPVDYGRKAEELLWRKVYYEVIQLIKTNKKHIHSRSTLECAYRTHLVAGIGFYQHLLLYIQSHYQLELQCCIDWTHVTDPLIGCKKPVSASGKEMDWAQMACHRCLVYLGDLSRYQNELAGVDTELLAERFYYQALSVAPQIGMPFNQLGTLAGSKYYNVEAMYCYLRCIQSEVSFEGAYGNLKRLYDKAAKMYHQLKKCETRKLSPGKKRCKDIKRLLVNFMYLQSLLQPKSSSVDSELTSLCQSVLEDFNLCLFYLPSSPNLSLASEDEEEYESGYAFLPDLLIFQMVIICLMCVHSLERAGSKQYSAAIAFTLALFSHLVNHVNIRLQAELEEGENPVPAFQSDGTDEPESKEPVEKEEEPDPEPPPVTPQVGEGRKSRKFSRLSCLRRRRHPPKVGDDSDLSEGFESDSSHDSARASEGSDSGSDKSLEGGGTAFDAETDSEMNSQESRSDLEDMEEEEGTRSPTLEPPRGRSEAPDSLNGPLGPSEASIASNLQAMSTQMFQTKRCFRLAPTFSNLLLQPTTNPHTSASHRPCVNGDVDKPSEPASEEGSESEGSESSGRSCRNERSIQEKLQVLMAEGLLPAVKVFLDWLRTNPDLIIVCAQSSQSLWNRLSVLLNLLPAAGELQESGLALCPEVQDLLEGCELPDLPSSLLLPEDMALRNLPPLRAAHRRFNFDTDRPLLSTLEESVVRICCIRSFGHFIARLQGSILQFNPEVGIFVSIAQSEQESLLQQAQAQFRMAQEEARRNRLMRDMAQLRLQLEVSQLEGSLQQPKAQSAMSPYLVPDTQALCHHLPVIRQLATSGRFIVIIPRTVIDGLDLLKKEHPGARDGIRYLEAEFKKGNRYIRCQKEVGKSFERHKLKRQDADAWTLYKILDSCKQLTLAQGAGEEDPSGMVTIITGLPLDNPSVLSGPMQAALQAAAHASVDIKNVLDFYKQWKEIG

SEQ ID NO: 80054 - protein, 1419 aa, Homo sapiens
  Payload ID: 15959
  Gene Symbol: SMG6
  Gene Name: SMG6 nonsense mediated mRNA decay factor
  Uniprot ID: Q86US8
  ENSP ID: ENSP00000263073
MAEGLERVRISASELRGILATLAPQAGSRENMKELKEARPRKDNRRPDLEIYKPGLSRLRNKPKIKEPPGSEEFKDEIVNDRDCSAVENGTQPVKDVCKELNNQEQNGPIDPENNRGQESFPRTAGQEDRSLKIIKRTKKPDLQIYQPGRRLQTVSKESASRVEEEEVLNQVEQLRVEEDECRGNVAKEEVANKPDRAEIEKSPGGGRVGAAKGEKGKRMGKGEGVRETHDDPARGRPGSAKRYSRSDKRRNRYRTRSTSSAGSNNSAEGAGLTDNGCRRRRQDRTKERPRLKKQVSVSSTDSLDEDRIDEPDGLGPRRSSERKRHLERNWSGRGEGEQKNSAKEYRGTLRVTFDAEAMNKESPMVRSARDDMDRGKPDKGLSSGGKGSEKQESKNPKQELRGRGRGILILPAHTTLSVNSAGSPESAPLGPRLLFGSGSKGSRSWGRGGTTRRLWDPNNPDQKPALKTQTPQLHFLDTDDEVSPTSWGDSRQAQASYYKFQNSDNPYYYPRTPGPASQYPYTGYNPLQYPVGPTNGVYPGPYYPGYPTPSGQYVCSPLPTSTMSPEEVEQHMRNLQQQELHRLLRVADNQELQLSNLLSRDRISPEGLEKMAQLRAELLQLYERCILLDIEFSDNQNVDQILWKNAFYQVIEKFRQLVKDPNVENPEQIRNRLLELLDEGSDFFDSLLQKLQVTYKFKLEDYMDGLAIRSKPLRKTVKYALISAQRCMICQGDIARYREQASDTANYGKARSWYLKAQHIAPKNGRPYNQLALLAVYTRRKLDAVYYYMRSLAASNPILTAKESLMSLFEETKRKAEQMEKKQHEEFDLSPDQWRKGKKSTFRHVGDDTTRLEIWIHPSHPRSSQGTESGKDSEQENGLGSLSPSDLNKRFILSFLHAHGKLFTRIGMETFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSDWMLGYPDTWNPPPTSLDLPSHVAVDVWSTLADFCNILTAVNQSEVPLYKDPDDDLTLLILEEDRLLSGFVPLLAAPQDPCYVEKTSDKVIAADCKRVTVLKYFLEALCGQEEPLLAFKGGKYVSVAPVPDTMGKEMGSQEGTRLEDEEEDVVIEDFEEDSEAEGSGGEDDIRELRAKKLALARKIAEQQRRQEKIQAVLEDHSQMRQMELEIRPLFLVPDTNGFIDHLASLARLLESRKYILVVPLIVINELDGLAKGQETDHRAGGYARVVQEKARKSIEFLEQRFESRDSCLRALTSRGNELESIAFRSEDITGQLGNNDDLILSCCLHYCKDKAKDFMPASKEEPIRLLREVVLLTDDRNLRVKALTRNVPVRDIPAFLTWAQVG

SEQ ID NO: 80055 - protein, 511 aa, Homo sapiens
  Payload ID: 15959
  Gene Symbol: SMG6
  Gene Name: SMG6 nonsense mediated mRNA decay factor
  Uniprot ID: Q86US8
  ENSP ID: ENSP00000346977
METFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSDWMLGYPDTWNPPPTSLDLPSHVAVDVWSTLADFCNILTAVNQSEVPLYKDPDDDLTLLILEEDRLLSGFVPLLAAPQDPCYVEKTSDKVIAADCKRVTVLKYFLEALCGQEEPLLAFKGGKYVSVAPVPDTMGKEMGSQEGTRLEDEEEDVVIEDFEEDSEAEGSGGEDDIRELRAKKLALARKIAEQQRRQEKIQAVLEDHSQMRQMELEIRPLFLVPDTNGFIDHLASLARLLESRKYILVVPLIVINELDGLAKGQETDHRAGGYARVVQEKARKSIEFLEQRFESRDSCLRALTSRGNELESIAFRSEDITGQLGNNDDLILSCCLHYCKDKAKDFMPASKEEPIRLLREVVLLTDDRNLRVKALTRNVPVRDIPAFLTWAQVG

SEQ ID NO: 80056 - protein, 511 aa, Homo sapiens; identical to SEQ ID NO: 80055
  Payload ID: 15959
  Gene Symbol: SMG6
  Gene Name: SMG6 nonsense mediated mRNA decay factor
  Uniprot ID: Q86US8
  ENSP ID: ENSP00000440283

SEQ ID NO: 80057 - protein, 162 aa, Homo sapiens
  Payload ID: 15959
  Gene Symbol: SMG6
  Gene Name: SMG6 nonsense mediated mRNA decay factor
  ENSP ID: ENSP00000458635
METFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSDWMLGYPDTWNPPPTSLDLPSHVAVDVWSTLADFCNILTA

SEQ ID NO: 80058 - protein, 164 aa, Homo sapiens
  Payload ID: 15959
  Gene Symbol: SMG6
  Gene Name: SMG6 nonsense mediated mRNA decay factor
  ENSP ID: ENSP00000459164
METFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSDWMLGYPDTWNPPPTSLDLPSHVAVDVWSTLADFCNILTAVN

SEQ ID NO: 80059 - protein, 123 aa, Homo sapiens
  Payload ID: 15959
  Gene Symbol: SMG6
  Gene Name: SMG6 nonsense mediated mRNA decay factor
  ENSP ID: ENSP00000460191
METFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSD

SEQ ID NO: 80060 - protein, 208 aa, Homo sapiens
  Payload ID: 15959
  Gene Symbol: SMG6
  Gene Name: SMG6 nonsense mediated mRNA decay factor
  ENSP ID: ENSP00000460273
MTGPCIRQLSLQILFPLCVAVDVWSTLADFCNILTAVNQSEVPLYKDPDDDLTLLILEEDRLLSGFVPLLAAPQDPCYVEKTSDKVIAADCKRVTVLKYFLEALCGQEEPLLAFKGGKYVSVAPVPDTMGKEMGSQEGTRLEDEEEDVVIEDFEEDSEAEGSGGEDDIRELRAKKLALARKIAEQQRRQEKIQAVLEDHSQMRQMELE

SEQ ID NO: 80061 - protein, 119 aa, Homo sapiens
  Payload ID: 15959
  Gene Symbol: SMG6
  Gene Name: SMG6 nonsense mediated mRNA decay factor
  ENSP ID: ENSP00000460301
METFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVK

SEQ ID NO: 80062 - protein, 163 aa, Homo sapiens
  Payload ID: 15959
  Gene Symbol: SMG6
  Gene Name: SMG6 nonsense mediated mRNA decay factor
  ENSP ID: ENSP00000460898
METFPAVAEKVLKEFQVLLQHSPSPIGSTRMLQLMTINMFAVHNSQLKDCFSEECRSVIQEQAAALGLAMFSLLVRRCTCLLKESAKAQLSSPEDQDDQDDIKVSSFVPDLKELLPSVKVWSDWMLGYPDTWNPPPTSLDLPSHVAVDVWSTLADFCNILTAV

SEQ ID NO: 80063 - protein, 138 aa, Homo sapiens
  Payload ID: 15959
  Gene Symbol: SMG6
  Gene Name: SMG6 nonsense mediated mRNA decay factor
  ENSP ID: ENSP00000465793
MFSLLVRRCTCLLKESAKAQLSSPEDQDDQDDIKVSSFVPDLKELLPSVKVWSDWMLGYPDTWNPPPTSLDLPSHVAVDVWSTLADFCNILTAVNQSEVPLYKDPDDDLTLLILEEDRLLSGFVPLLAAPQDPCYVEK

SEQ ID NO: 80064 - protein, 124 aa, Homo sapiens
  Payload ID: 15959
  Gene Symbol: SMG6
  Gene Name: SMG6 nonsense mediated mRNA decay factor
  ENSP ID: ENSP00000466139
MFSLLVRRCTCLLKESAKAQLSSPEDQDDQDDIKVSSFVPDLKELLPSVKVWSDWMLGYPDTWNPPPTSLDLPSHVAVDVWSTLADFCNILTAVNQSEVPLYKDPDDDLTLLILEEDRLLSGFV

SEQ ID NO: 80065 - protein, 115 aa, Homo sapiens
  Payload ID: 15959
  Gene Symbol: SMG6
  Gene Name: SMG6 nonsense mediated mRNA decay factor
  ENSP ID: ENSP00000466951
MFSLLVRRCTCLLKESAKAQLSSPEDQDDQDDIKVSSFVPDLKELLPSVKVWSDWMLGYPDTWNPPPTSLDLPSHVAVDVWSTLADFCNILTAVNQSEVPLYKDPDDDLTLLILE

SEQ ID NO: 80066 - protein, 1137 aa, Homo sapiens
  Payload ID: 15960
  Gene Symbol: SMG7
  Gene Name: SMG7 nonsense mediated mRNA decay factor
  Uniprot ID: Q92540
  ENSP ID: ENSP00000340766
MSLQSAQYLRQAEVLKADMTDSKLGPAEVWTSRQALQDLYQKMLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNGQPYNQLAILASSKGDHLTTIFYYCRSIAVKFPFPAASTNLQKALSKALESRDEVKTKWGVSDFIKAFIKFHGHVYLSKSLEKLSPLREKLEEQFKRLLFQKAFNSQQLVHVTVINLFQLHHLRDFSNETEQHTYSQDEQLCWTQLLALFMSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVRRDYSKGITVTKNDGKKDNNKRKTETKKCTLEKLQETGKQNVAVQVKSQTELRKTPVSEARKTPVTQTPTQASNSQFIPIHHPGAFPPLPSRPGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQTQDPIKLFEPSLQPPVMQQQPLEKKMKPFPMEPYNHNPSEVKVPEFYWDSSYSMADNRSVMAQQANIDRRGKRSPGVFRPEQDPVPRMPFEKSLLEKPSELMSHSSSFLSLTGFSLNQERYPNNSMFNEVYGKNLTSSSKAELSPSMAPQETSLYSLFEGTPWSPSLPASSDHSTPASQSPHSSNPSSLPSSPPTHNHNSVPFSNFGPIGTPDNRDRRTADRWKTDKPAMGGFGIDYLSATSSSESSWHQASTPSGTWTGHGPSMEDSSAVLMESLKSIWSSSMMHPGPSALEQLLMQQKQKQQRGQGTMNPPH

SEQ ID NO: 80067 - protein, 1170 aa, Homo sapiens
  Payload ID: 15960
  Gene Symbol: SMG7
  Gene Name: SMG7 nonsense mediated mRNA decay factor
  ENSP ID: ENSP00000356507
MRNWMFLQIVIVGENVSFKSQMRTENLKSEEHLKSSNIRQAEVLKADMTDSKLGPAEVWTSRQALQDLYQKMLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNGQPYNQLAILASSKGDHLTTIFYYCRSIAVKFPFPAASTNLQKALSKALESRDEVKTKWGVSDFIKAFIKFHGHVYLSKSLEKLSPLREKLEEQFKRLLFQKAFNSQQLVHVTVINLFQLHHLRDFSNETEQHTYSQDEQLCWTQLLALFMSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVKSQTELRKTPVSEARKTPVTQTPTQASNSQFIPIHHPGAFPPLPSRPGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQTQDPIKLFEPSLQPPVMQQQPLEKKMKPFPMEPYNHNPSEVKVPEFYWDSSYSMADNRSVMAQQANIDRRGKRSPGVFRPEQDPVPRMPFEDPKSSPLLPPDLLKSLAALEEEEELIFSNPPDLYPALLGPLASLPGRSLFKSLLEKPSELMSHSSSFLSLTGFSLNQERYPNNSMFNEVYGKNLTSSSKAELSPSMAPQETSLYSLFEGTPWSPSLPASSDHSTPASQSPHSSNPSSLPSSPPTHNHNSVPFSNFGPIGTPDNRDRRTADRWKTDKPAMGGFGIDYLSATSSSESSWHQASTPSGTWTGHGPSMEDSSAVLMESLKSIWSSSMMHPGPSALEQLLMQQKQKQQRGQGTMNPPH

SEQ ID NO: 80068 - protein, 756 aa, Homo sapiens
  Payload ID: 15960
  Gene Symbol: SMG7
  Gene Name: SMG7 nonsense mediated mRNA decay factor
  ENSP ID: ENSP00000388390
MLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNGQPYNQLAILASSKGDHLTTIFYYCRSIAVKFPFPAASTNLQKALSKALESRDEVKTKWGVSDFIKAFIKFHGHVYLSKSLEKLSPLREKLEEQFKRLLFQKAFNSQQLVHVTVINLFQLHHLRDFSNETEQHTYSQDEQLCWTQLLALFMSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVKSQTELRKTPVSEARKTPVTQTPTQASNSQFIPIHHPGAFPPLPSRPGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQTQDPIKLFEPSLQPPVMQQQP

SEQ ID NO: 80069 - protein, 73 aa, Homo sapiens
  Payload ID: 15960
  Gene Symbol: SMG7
  Gene Name: SMG7 nonsense mediated mRNA decay factor
  ENSP ID: ENSP00000400220
MSLQSAQYLRQAEVLKADMTDSKLGPAEVWTSRQALQDLYQKMLVTDLEYALDKKVEQDLGTSVCPVSHCYTK

SEQ ID NO: 80070 - protein, 184 aa, Homo sapiens
  Payload ID: 15960
  Gene Symbol: SMG7
  Gene Name: SMG7 nonsense mediated mRNA decay factor
  ENSP ID: ENSP00000410254
MSLQSAQYLRQAEVLKADMTDSKLGPAEVWTSRQALQDLYQKMLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIVPYNSPLLVGRLQVTSIVHSGSW

SEQ ID NO: 80071 - protein, 1091 aa, Homo sapiens
  Payload ID: 15960
  Gene Symbol: SMG7
  Gene Name: SMG7 nonsense mediated mRNA decay factor
  Uniprot ID: Q92540
  ENSP ID: ENSP00000421358
MSLQSAQYLRQAEVLKADMTDSKLGPAEVWTSRQALQDLYQKMLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNGQPYNQLAILASSKGDHLTTIFYYCRSIAVKFPFPAASTNLQKALSKALESRDEVKTKWGVSDFIKAFIKFHGHVYLSKSLEKLSPLREKLEEQFKRLLFQKAFNSQQLVHVTVINLFQLHHLRDFSNETEQHTYSQDEQLCWTQLLALFMSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVKSQTELRKTPVSEARKTPVTQTPTQASNSQFIPIHHPGAFPPLPSRPGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQTQDPIKLFEPSLQPPVMQQQPLEKKMKPFPMEPYNHNPSEVKVPEFYWDSSYSMADNRSVMAQQANIDRRGKRSPGVFRPEQDPVPRMPFEKSLLEKPSELMSHSSSFLSLTGFSLNQERYPNNSMFNEVYGKNLTSSSKAELSPSMAPQETSLYSLFEGTPWSPSLPASSDHSTPASQSPHSSNPSSLPSSPPTHNHNSVPFSNFGPIGTPDNRDRRTADRWKTDKPAMGGFGIDYLSATSSSESSWHQASTPSGTWTGHGPSMEDSSAVLMESLKSIWSSSMMHPGPSALEQLLMQQKQKQQRGQGTMNPPH

SEQ ID NO: 80072 - protein, 56 aa, Homo sapiens
  Payload ID: 15960
  Gene Symbol: SMG7
  Gene Name: SMG7 nonsense mediated mRNA decay factor
  ENSP ID: ENSP00000422056
MRNWMFLQIVIVGENVSFKSQMRTENLKSEEHLKSSNIRQAEVLKADMTDSKLGPA

SEQ ID NO: 80073 - protein, 150 aa, Homo sapiens
  Payload ID: 15960
  Gene Symbol: SMG7
  Gene Name: SMG7 nonsense mediated mRNA decay factor
  ENSP ID: ENSP00000422742
MRNWMFLQIVIVGENVSFKSQMRTENLKSEEHLKSSNIRQAEVLKADMTDSKLGPAEVWTSRQALQDLYQKMLVTDLEYALDKKVEQDLWNHAFKNQITTLQGQAKNRANPNRSEVQANLSLFLEAASGFYTQLLQELCTVFNVDLPCRV

SEQ ID NO: 80074 - protein, 1178 aa, Homo sapiens
  Payload ID: 15960
  Gene Symbol: SMG7
  Gene Name: SMG7 nonsense mediated mRNA decay factor
  Uniprot ID: Q92540
  ENSP ID: ENSP00000425133
MSLQSAQYLRQAEVLKADMTDSKLGPAEVWTSRQALQDLYQKMLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNGQPYNQLAILASSKGDHLTTIFYYCRSIAVKFPFPAASTNLQKALSKALESRDEVKTKWGVSDFIKAFIKFHGHVYLSKSLEKLSPLREKLEEQFKRLLFQKAFNSQQLVHVTVINLFQLHHLRDFSNETEQHTYSQDEQLCWTQLLALFMSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVKSQTELRKTPVSEARKTPVTQTPTQASNSQFIPIHHPGAFPPLPSRPGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQTQDPIKLFEPSLQPPVMQQQPLEKKMKPFPMEPYNHNPSEVKVPEFYWDSSYSMADNRSVMAQQANIDRRGKRSPGVFRPEQDPVPRMPFEDPKSSPLLPPDLLKSLAALEEEEELIFSNPPDLYPALLGPLASLPGRSLFKSLLEKPSELMSHSSSFLSLTGFSLNQERYPNNSMFNEVYGKNLTSSSKAELSPSMAPQETSLYSLFEGTPWSPSLPASSDHSTPASQSPHSSNPSSLPSSPPTHNHNSVPFSNFGPIGTPDNRDRRTADRWKTDKPAMGGFGIDYLSATSSSESSWHQASTPSGTWTGHGPSMEDSSAVLMESLKKQQHGVQQLGPKRQSEEEGSSSICVAHRGPRPLPSCSLPASTFRVKFKAARTCAHQAQKKTRRRPFWKRRKKGK

SEQ ID NO: 80075 - protein, 1145 aa, Homo sapiens
  Payload ID: 15960
  Gene Symbol: SMG7
  Gene Name: SMG7 nonsense mediated mRNA decay factor
  Uniprot ID: Q92540
  ENSP ID: ENSP00000426915
MLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNGQPYNQLAILASSKGDHLTTIFYYCRSIAVKFPFPAASTNLQKALSKALESRDEVKTKWGVSDFIKAFIKFHGHVYLSKSLEKLSPLREKLEEQFKRLLFQKAFNSQQLVHVTVINLFQLHHLRDFSNETEQHTYSQDEQLCWTQLLALFMSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVRRDYSKGITVTKNDGKKDNNKRKTETKKCTLEKLQETGKQNVAVQVKSQTELRKTPVSEARKTPVTQTPTQASNSQFIPIHHPGAFPPLPSRPGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQTQDPIKLFEPSLQPPVMQQQPLEKKMKPFPMEPYNHNPSEVKVPEFYWDSSYSMADNRSVMAQQANIDRRGKRSPGVFRPEQDPVPRMPFEDPKSSPLLPPDLLKSLAALEEEEELIFSNPPDLYPALLGPLASLPGRSLFKSLLEKPSELMSHSSSFLSLTGFSLNQERYPNNSMFNEVYGKNLTSSSKAELSPSMAPQETSLYSLFEGTPWSPSLPASSDHSTPASQSPHSSNPSSLPSSPPTHNHNSVPFSNFGPIGTPDNRDRRTADRWKTDKPAMGGFGIDYLSATSSSESSWHQASTPSGTWTGHGPSMEDSSAVLMESLKSIWSSSMMHPGPSALEQLLMQQKQKQQRGQGTMNPPH

SEQ ID NO: 80076 - protein, 991 aa, Homo sapiens
  Payload ID: 15961
  Gene Symbol: SMG8
  Gene Name: SMG8 nonsense mediated mRNA decay factor
  Uniprot ID: Q8ND04
  ENSP ID: ENSP00000300917
MAGPVSLRDLLMGASAWMGSESPGGSPTEGGGSAAGGPEPPWREDEICVVGIFGKTALRLNSEKFSLVNTVCDRQVFPLFRHQDPGDPGPGIRTEAGAVGEAGGAEDPGAAAGGSVRGSGAVAEGNRTEAGSQDYSLLQAYYSQESKVLYLLLTSICDNSQLLRACRALQSGEAGGGLSLPHAEAHEFWKHQEKLQCLSLLYLFSVCHILLLVHPTCSFDITYDRVFRALDGLRQKVLPLLKTAIKDCPVGKDWKLNCRPCPPRLLFLFQLNGALKVEPPRNQDPAHPDKPKKHSPKRRLQHALEDQIYRIFRKSRVLTNQSINCLFTVPANQAFVYIVPGSQEEDPVGMLLDQLRSHCTVKDPESLLVPAPLSGPRRYQVMRQHSRQQLSFHIDSSSSSSSGQLVDFTLREFLWQHVELVLSKKGFDDSVGRNPQPSHFELPTYQKWISAASKLYEVAIDGKEEDLGSPTGELTSKILSSIKVLEGFLDIDTKFSENRCQKALPMAHSAYQSNLPHNYTMTVHKNQLAQALRVYSQHARGPAFHKYAMQLHEDCYKFWSNGHQLCEERSLTDQHCVHKFHSLPKSGEKPEADRNPPVLYHNSRARSTGACNCGRKQAPRDDPFDIKAANYDFYQLLEEKCCGKLDHINFPVFEPSTPDPAPAKNESSPAPPDSDADKLKEKEPQTQGESTSLSLALSLGQSTDSLGTYPADPQAGGDNPEVHGQVEVKTEKRPNFVDRQASTVEYLPGMLHSNCPKGLLPKFSSWSLVKLGPAKSYNFHTGLDQQGFIPGTNYLMPWDIVIRTRAEDEGDLDTNSWPAPNKAIPGKRSAVVMGRGRRRDDIARAFVGFEYEDSRGRRFMCSGPDKVMKVMGSGPKESALKALNSDMPLYILSSSQGRGLKPHYAQLMRLFVVVPDAPLQIILMPQVQPGPPPCPVFYPEKQEITLPPDGLWVLRFPYAYVTERGPCFPPKENVQLMSYKVLRGVLKAVTQ

SEQ ID NO: 80077 - protein, 991 aa, Homo sapiens; identical to SEQ ID NO: 80076
  Payload ID: 15961
  Gene Symbol: SMG8
  Gene Name: SMG8 nonsense mediated mRNA decay factor
  Uniprot ID: Q8ND04
  ENSP ID: ENSP00000438748

SEQ ID NO: 80078 - protein, 588 aa, Homo sapiens
  Payload ID: 15961
  Gene Symbol: SMG8
  Gene Name: SMG8 nonsense mediated mRNA decay factor
  Uniprot ID: Q8ND04
  ENSP ID: ENSP00000462119
MAGPVSLRDLLMGASAWMGSESPGGSPTEGGGSAAGGPEPPWREDEICVVGIFGKTALRLNSEKFSLVNTVCDRQVFPLFRHQDPGDPGPGIRTEAGAVGEAGGAEDPGAAAGGSVRGSGAVAEGNRTEAGSQDYSLLQAYYSQESKVLYLLLTSICDNSQLLRACRALQSGEAGGGLSLPHAEAHEFWKHQEKLQCLSLLYLFSVCHILLLVHPTCSFDITYDRVFRALDGLRQKVLPLLKTAIKDCPVGKDWKLNCRPCPPRLLFLFQLNGALKVEPPRNQDPAHPDKPKKHSPKRRLQHALEDQIYRIFRKSRVLTNQSINCLFTVPANQAFVYIVPGSQEEDPVGMLLDQLRSHCTVKDPESLLVPAPLSGPRRYQVMRQHSRQQLSFHIDSSSSSSSGQLVDFTLREFLWQHVELVLSKKGFDDSVGRNPQPSHFELPTYQKWISAASKLYEVAIDGKEEDLGSPTGELTSKILSSIKVLEGFLDIDTKFSENRCQKALPMAHSAYQSNLPHNYTMTVHKNQLAQALRVYSQHARGPAFHKYAMQLHEDCYKFWSNGHQLCEERSLTDQHCVHKFHSLPKSGS

SEQ ID NO: 80079 - protein, 271 aa, Homo sapiens
  Payload ID: 15961
  Gene Symbol: SMG8
  Gene Name: SMG8 nonsense mediated mRNA decay factor
  ENSP ID: ENSP00000462931
VAIDGKEEDLGSPTGELTSKILSSIKVLEGFLDIDTKFSENRCQKALPMAHSAYQSNLPHNYTMTVHKNQLAQALRVYSQHARGPAFHKYAMQLHEDCYKFWSNGHQLCEERSLTDQHCVHKFHSLPKSGEKPEADRNPPVLYHNSRARSTGACNCGRKQAPRDDPFDIKAANYDFYQLLEEKCCGKLDHINFPVFEPSTPDPAPAKNESSPAPPDSDADKLKEKEPQTQGESTSLSLALSLGQSTDSLGSARPTTMSGILPRKTRNHPST

SEQ ID NO: 80080 - protein, 32 aa, Homo sapiens
  Payload ID: 15961
  Gene Symbol: SMG8
  Gene Name: SMG8 nonsense mediated mRNA decay factor
  ENSP ID: ENSP00000463175
  MOD_RES (1)..(1): Any amino acid
XFWSNGHQLCEERSLTDQHCVHKFHSLPKSGS

SEQ ID NO: 80081 - protein, 520 aa, Homo sapiens
  Payload ID: 15962
  Gene Symbol: SMG9
  Gene Name: SMG9 nonsense mediated mRNA decay factor
  Uniprot ID: Q9H0W8
  ENSP ID: ENSP00000270066
MSESGHSQPGLYGIERRRRWKEPGSGGPQNLSGPGGRERDYIAPWERERRDASEETSTSVMQKTPIILSKPPAERSKQPPPPTAPAAPPAPAPLEKPIVLMKPREEGKGPVAVTGASTPEGTAPPPPAAPAPPKGEKEGQRPTQPVYQIQNRGMGTAAPAAMDPVVGQAKLLPPERMKHSIKLVDDQMNWCDSAIEYLLDQTDVLVVGVLGLQGTGKSMVMSLLSANTPEEDQRTYVFRAQSAEMKERGGNQTSGIDFFITQERIVFLDTQPILSPSILDHLINNDRKLPPEYNLPHTYVEMQSLQIAAFLFTVCHVVIVVQDWFTDLSLYRFLQTAEMVKPSTPSPSHESSSSSGSDEGTEYYPHLVFLQNKARREDFCPRKLRQMHLMIDQLMAHSHLRYKGTLSMLQCNVFPGLPPDFLDSEVNLFLVPFMDSEAESENPPRAGPGSSPLFSLLPGYRGHPSFQSLVSKLRSQVMSMARPQLSHTILTEKNWFHYAARIWDGVRKSSALAEYSRLLA

SEQ ID NO: 80082 - protein, 120 aa, Homo sapiens
  Payload ID: 15962
  Gene Symbol: SMG9
  Gene Name: SMG9 nonsense mediated mRNA decay factor
  ENSP ID: ENSP00000468941
MSESGHSQPGLYGIERRRRWKEPGSGGPQNLSGPGGRERDYIAPWERERRDASEETSTSVMQKTPIILSKPPAERSKQPPPPTAPAAPPAPAPLEKPIVLMKPREEGKGPVAVTGASTPE

SEQ ID NO: 80083 - protein, 148 aa, Homo sapiens
  Payload ID: 15962
  Gene Symbol: SMG9
  Gene Name: SMG9 nonsense mediated mRNA decay factor
  ENSP ID: ENSP00000470031
MSESGHSQPGLYGIERRRRWKEPGSGGPQNLSGPGGRERDYIAPWERERRDASEETSTSVMQKTPIILSKPPAERSKQPPPPTAPAAPPAPAPLEKPIVLMKPREEGKGPVAVTGASTPEGTAPPPPAAPAPPKGEKEGQRPTQPVYQ

SEQ ID NO: 80084 - protein, 183 aa, Homo sapiens
  Payload ID: 15962
  Gene Symbol: SMG9
  Gene Name: SMG9 nonsense mediated mRNA decay factor
  ENSP ID: ENSP00000470451
MSESGHSQPGLYGIERRRRWKEPGSGGPQNLSGPGGRERDYIAPWERERRDASEETSTSVMQKTPIILSKPPAERSKQPPPPTAPAAPPAPAPLEKPIVLMKPREEGKGPVAVTGASTPEGTAPPPPAAPAPPKGEKEGQRPTQPVYQIQNRGMGTAAPAAMDPVVGQAKLLPPERMKHSIKL

SEQ ID NO: 80085 - protein, 115 aa, Homo sapiens
  Payload ID: 15962
  Gene Symbol: SMG9
  Gene Name: SMG9 nonsense mediated mRNA decay factor
  ENSP ID: ENSP00000470541
MSESGHSQPGLYGIERRRRWKEPGSGGPQNLSGPGGRERDYIAPWERERRDASEETSTSVMQKTPIILSKPPAERSKQPPPPTAPAAPPAPAPLEKPIVLMKPREEGKGPVAVTG

SEQ ID NO: 80086 - protein, 495 aa, Homo sapiens
  Payload ID: 15962
  Gene Symbol: SMG9
  Gene Name: SMG9 nonsense mediated mRNA decay factor
  Uniprot ID: Q9H0W8
  ENSP ID: ENSP00000471398
MSESGHSQPGLYGIERRRRWKEPGSGGPQNLSGPGGRERDYIAPWERERRDASEETSTSVMQKTPIILSKPPAERSKQPPPPTAPAAPPAPAPLEKPIVLMKPREEGKGPVAVTGASTPEGTAPPPPAAPAPPKGEKEGQRPTQPVYQIQNRGMGTAAPAAMDPVVGQAKLLPPERMKHSIKLVDDQMNWCDSAIEYLLDQTDVLVVGVLGLQGTGKSMVMSLLSANTPEEDQRTYVFRAQSAEMKERGGNQTSGIDFFITQERIVFLDTQPILSPSILDHLINNDRKLPPEYNLPHTYVEMQSLQIAAFLFTVCHVVIVVQDWFTDLSLYRFLQTAEMVKPSTPSPSHESSSSSGSDEGTEYYPHLVFLQNKARREDFCPRKLRQMHLMIDQLMAHSHLRYKGTLSMLQCNVFPGLPPDFLDSEVNLFLVPFMDSEAESENPPRAGPGSSPLFSLLPGYRGHPSFQSLVSKLRSQVMSMARPQLSHTILTEKNW

SEQ ID NO: 80087 - protein, 157 aa, Homo sapiens
  Payload ID: 15962
  Gene Symbol: SMG9
  Gene Name: SMG9 nonsense mediated mRNA decay factor
  ENSP ID: ENSP00000471442
  MOD_RES (1)..(1): Any amino acid
XAPPKGEKEGQRPTQPVYQIQNRGMGTAAPAAMDPVVGQAKLLPPERMKHSIKLVDDQMNWCDSAIEYLLDQTDVLVVGVLGLQGTGKSMVMSLLSANTPEEDQRTYVFRAQSAEMKERGGNQTSGIDFFITQERIVFLDTQVPAPPAFAPPCHILH

SEQ ID NO: 80088 - protein, 156 aa, Homo sapiens
  Payload ID: 15962
  Gene Symbol: SMG9
  Gene Name: SMG9 nonsense mediated mRNA decay factor
  ENSP ID: ENSP00000472684
MSESGHSQPGLYGIERRRRWKEPGSGGPQNLSGPGGRERDYIAPWERERRDASEETSTSVMQKTPIILSKPPAERSKQPPPPTAPAAPPAPAPLEKPIVLMKPREEGKGPVAVTGASTPEGTAPPPPAAPAPPKGEKEGQRPTQPVYQIQNRGMGT

SEQ ID NO: 80089 - protein, 937 aa, Homo sapiens
  Payload ID: 15963
  Gene Symbol: SMCR8
  Gene Name: Smith-Magenis syndrome chromosome region, candidate 8
  Uniprot ID: Q8TEV9
  ENSP ID: ENSP00000385025
MISAPDVVAFTKEEEYEEEPYNEPALPEEYSVPLFPFASQGANPWSKLSGAKFSRDFILISEFSEQVGPQPLLTIPNDTKVFGTFDLNYFSLRIMSVDYQASFVGHPPGSAYPKLNFVEDSKVVLGDSKEGAFAYVHHLTLYDLEARGFVRPFCMAYISADQHKIMQQFQELSAEFSRASECLKTGNRKAFAGELEKKLKDLDYTRTVLHTETEIQKKANDKGFYSSQAIEKANELASVEKSIIEHQDLLKQIRSYPHRKLKGHDLCPGEMEHIQDQASQASTTSNPDESADTDLYTCRPAYTPKLIKAKSTKCFDKKLKTLEELCDTEYFTQTLAQLSHIEHMFRGDLCYLLTSQIDRALLKQQHITNFLFEDFVEVDDRMVEKQESIPSKPSQDRPPSSSLEECPIPKVLISVGSYKSSVESVLIKMEQELGDEEYKEVEVTELSSFDPQENLDYLDMDMKGSISSGESIEVLGTEKSTSVLSKSDSQASLTVPLSPQVVRSKAVSHRTISEDSIEVLSTCPSEALIPDDFKASYPSAINEEESYPDGNEGAIRFQASISPPELGETEEGSIENTPSQIDSSCCIGKESDGQLVLPSTPAHTHSDEDGVVSSPPQRHRQKDQGFRVDFSVENANPSSRDNSCEGFPAYELDPSHLLASRDISKTSLDNYSDTTSYVSSVASTSSDRIPSAYPAGLSSDRHKKRAGQNALKFIRQYPFAHPAIYSLLSGRTLVVLGEDEAIVRKLVTALAIFVPSYGCYAKPVKHWASSPLHIMDFQKWKLIGLQRVASPAGAGTLHALSRYSRYTSILDLDNKTLRCPLYRGTLVPRLADHRTQIKRGSTYYLHVQSMLTQLCSKAFLYTFCHHLHLPTHDKETEELVASRQMSFLKLTLGLVNEDVRVVQYLAELLKLHYMQESPGTSHPMLRFDYVPSFLYKI

SEQ ID NO: 80090 - protein, 917 aa, Homo sapiens
  Payload ID: 15964
  Gene Symbol: SMTN
  Gene Name: smoothelin
  Uniprot ID: P53814
  ENSP ID: ENSP00000328635
MADEALAGLDEGALRKLLEVTADLAERRRIRSAIRELQRQELEREEEALASKRFRAERQDNKENWLHSQQREAEQRAALARLAGQLESMNDVEELTALLRSAGEYEERKLIRAAIRRVRAQEIEAATLAGRLYSGRPNSGSREDSKGLAAHRLEQCEVPEREEQEQQAEVSKPTPTPEGTSQDVTTVTLLLRAPPGSTSSSPASPSSSPTPASPEPPLEPAEAQCLTAEVPGSPEPPPSPPKTTSPEPQESPTLPSTEGQVVNKLLSGPKETPAAQSPTRGPSDTKRADVAGPRPCQRSLSVLSPRQPAQNRESTPLASGPSSFQRAGSVRDRVHKFTSDSPMAARLQDGTPQAALSPLTPARLLGPSLTSTTPASSSSGSSSRGPSDTSSRFSKEQRGVAQPLAQLRSCPQEEGPRGRGLAARPLENRAGGPVARSEEPGAPLPVAVGTAEPGGSMKTTFTIEIKDGRGQASTGRVLLPTGNQRAELTLGLRAPPTLLSTSSGGKSTITRVNSPGTLARLGSVTHVTSFSHAPPSSRGGCSIKMEAEPAEPLAAAVEAANGAEQTRVNKAPEGRSPLSAEELMTIEDEGVLDKMLDQSTDFEERKLIRAALRELRQRKRDQRDKERERRLQEARGRPGEGRGNTATETTTRHSQRAADGSAVSTVTKTERLVHSNDGTRTARTTTVESSFVRRSENGSGSTMMQTKTFSSSSSSKKMGSIFDREDQASPRAGSLAALEKRQAEKKKELMKAQSLPKTSASQARKAMIEKLEKEGAAGSPGGPRAAVQRSTSFGVPNANSIKQMLLDWCRAKTRGYEHVDIQNFSSSWSDGMAFCALVHNFFPEAFDYGQLSPQNRRQNFEVAFSSAEMLVDCVPLVEVDDMMIMGKKPDPKCVFTYVQSLYNHLRRHELRLRGKNV

SEQ ID NO: 80091 - protein, 915 aa, Homo sapiens
  Payload ID: 15964
  Gene Symbol: SMTN
  Gene Name: smoothelin
  Uniprot ID: P53814
  ENSP ID: ENSP00000329532
MADEALAGLDEGALRKLLEVTADLAERRRIRSAIRELQRQELEREEEALASKRFRAERQDNKENWLHSQQREAEQRAALARLAGQLESMNDVEELTALLRSAGEYEERKLIRAAIRRVRAQEIEAATLAGRLYSGRPNSGSREDSKGLAAHRLEQCEVPEREEQEQQAEVSKPTPTPEGTSQDVTTVTLLLRAPPGSTSSSPASPSSSPTPASPEPPLEPAEAQCLTAEVPGSPEPPPSPPKTTSPEPQESPTLPSTEGQVVNKLLSGPKETPAAQSPTRGPSDTKRADVAGPRPCQRSLSVLSPRQPAQNRESTPLASGPSSFQRAGSVRDRVHKFTSDSPMAARLQDGTPQAALSPLTPARLLGPSLTSTTPASSSSGSSSRGPSDTSSRFSKEQRGVAQPLAQLRSCPQEEGPRGRGLAARPLENRAGGPVARSEEPGAPLPVAVGTAEPGGSMKTTFTIEIKDGRGQASTGRVLLPTGNQRAELTLGLRAPPTLLSTSSGGKSTITRVNSPGTLARLGSVTHVTSFSHAPPSSRGGCSIKMEAEPAEPLAAAVEAANGAEQTRVNKAPEGRSPLSAEELMTIEDEGVLDKMLDQSTDFEERKLIRAALRELRQRKRDQRDKERERRLQEARGRPGEGRGNTATETTTRHSQRAADGSAVSTVTKTERLVHSNDGTRTARTTTVESSFVRRSENGSGSTMMQTKTFSSSSSSKKMGSIFDREDQASPRAGSLAALEKRQAEKKKELMKAQSLPKTSASQARKAMIEKLEKEGAAGSPGGPRAAVQRSTSFGVPNANSIKQMLLDWCRAKTRGYEHVDIQNFSSSWSDGMAFCALVHNFFPEAFDYGQLSPQNRRQNFEVAFSSAETHADCPQLLDTEDMVRLREPDWKCVYTYIQEFYRCLVQKGLVKTKKS

SEQ ID NO: 80092 - protein, 940 aa, Homo sapiens
  Payload ID: 15964
  Gene Symbol: SMTN
  Gene Name: smoothelin
  Uniprot ID: P53814
  ENSP ID: ENSP00000351593
MADEALAGLDEGALRKLLEVTADLAERRRIRSAIRELQRQELEREEEALASKRFRAERQDNKENWLHSQQREAEQRAALARLAGQLESMNDVEELTALLRSAGEYEERKLIRAAIRRVRAQEIEAATLAGRLYSGRPNSGSREDSKGLAAHRLEQCEVPEREEQEQQAEVSKPTPTPEGTSQDVTTVTLLLRAPPGSTSSSPASPSSSPTPASPEPPLEPAEAQCLTAEVPGSPEPPPSPPKTTSPEPQESPTLPSTEGQVVNKLLSGPKETPAAQSPTRGPSDTKRADVAGPRPCQRSLSVLSPRQPAQNRESTPLASGPSSFQRAGSVRDRVHKFTSDSPMAARLQDGTPQAALSPLTPARLLGPSLTSTTPASSSSGSSSRGPSDTSSRFSKEQRGVAQPLAQLRSCPQEEGPRGRGLAARPLENRAGGPVARSEEPGAPLPVAVGTAEPGGSMKTTFTIEIKDGRGQASTGRVLLPTGNQRAELTLGLRAPPTLLSTSSGGKSTITRVNSPGTLARLGSVTHVTSFSHAPPSSRGGCSIKMEAEPAEPLAAAVEAANGAEQTRVNKAPEGRSPLSAEELMTIEDEGVLDKMLDQSTDFEERKLIRAALRELRQRKRDQRDKERERRLQEARGRPGEGRGNTATETTTRHSQRAADGSAVSTVTKTERLVHSNDGTRTARTTTVESSFVRRSENGSGSTMMQTKTFSSSSSSKKMGSIFDREDQASPRAGSLAALEKRQAEKKKELMKAQSLPKTSASQARKAMIEKLEKEGAAGSPGGPRAAVQRSTSFGVPNANSIKQMLLDWCRAKTRGYEHVDIQNFSSSWSDGMAFCALVHNFFPEAFDYGQLSPQNRRQNFEVAFSSAETHADCPQLLDTEDMVRLREPDWKMLVDCVPLVEVDDMMIMGKKPDPKCVFTYVQSLYNHLRRHELRLRGKNV

SEQ ID NO: 80093 - protein, 438 aa, Homo sapiens
  Payload ID: 15964
  Gene Symbol: SMTN
  Gene Name: smoothelin
  ENSP ID: ENSP00000383919
MPGVPGPGPELAAALEEQLGRALEELRAVAEAGRVAVTQAAEVAVATVEPVARAAEELRAERAALSRRLDALSRQVEVLSLRLGVPLVSGLEPELEPSELLLAAADPEALFQAAEDAGTPVAHPPAFSTRRRSSTGTTRSTSLMEAEPAEPLAAAVEAANGAEQTRVNKAPEGRSPLSAEELMTIEDEGVLDKMLDQSTDFEERKLIRAALRELRQRKRDGSGSTMMQTKTFSSSSSSKKMGSIFDREDQASPRAGSLAALEKRQAEKKKELMKAQSLPKTSASQARKAMIEKLEKEGAAGSPGGPRAAVQRSTSFGVPNANSIKQMLLDWCRAKTRGYEHVDIQNFSSSWSDGMAFCALVHNFFPEAFDYGQLSPQNRRQNFEVAFSSAETHADCPQLLDTEDMVRLREPDWKCVYTYIQEFYRCLVQKGLVKTKKS

SEQ ID NO: 80094 - protein, 37 aa, Homo sapiens
  Payload ID: 15964
  Gene Symbol: SMTN
  Gene Name: smoothelin
  ENSP ID: ENSP00000390453
MADEALAGLDEGALRKLLEVTADLAERRRIRSAIREL

SEQ ID NO: 80095 - protein, 216 aa, Homo sapiens
  Payload ID: 15964
  Gene Symbol: SMTN
  Gene Name: smoothelin
  ENSP ID: ENSP00000392329
GSTSRELSRERDPQAGHPAAQMEAEPAEPLAAAVEAANGAEQTRVNKAPEGRSPLSAEELMTIEDEGVLDKMLDQSTDFEERKLIRAALRELRQRKRDGSGSTMMQTKTFSSSSSSKKMGSIFDREDQASPRAGSLAALEKRQAEKKKELMKAQSLPKTSASQARKAMIEKLEKEGAAGSPGGPRAAVQRSTSFGVPNANSIKQMLLDWCRAKTRG

SEQ ID NO: 80096 - protein, 158 aa, Homo sapiens
  Payload ID: 15964
  Gene Symbol: SMTN
  Gene Name: smoothelin
  ENSP ID: ENSP00000394637
MTCLSHPLQLEVTADLAERRRIRSAIRELQRQELEREEEALASKRFRAERQDNKENWLHSQQREAEQRAALARLAGQLESMNDVEELTALLRSAGEYEERKLIRAAIRRVRAQEIEAATLAGRLYSGRPNSGSREDSKGLAAHRLEQCEVPEREEQEQ

SEQ ID NO: 80097 - protein, 91 aa, Homo sapiens
  Payload ID: 15964
  Gene Symbol: SMTN
  Gene Name: smoothelin
  ENSP ID: ENSP00000398663
MRVHPRPHSRLAAKLAGLEPETPYPGFEFSELVTGATGTGDLTRKEPTELGASEMADEALAGLDEGALRKLLEVTADLAERRRIRSAIREL

SEQ ID NO: 80098 - protein, 141 aa, Homo sapiens
  Payload ID: 15964
  Gene Symbol: SMTN
  Gene Name: smoothelin
  ENSP ID: ENSP00000399432
MRVHPRPHSRLAAKLAGLEPETPYPGFEFSELVTGATGTGDLTRKEPTELGASEMADEALAGLDEGALRKLLEVTADLAERRRIRSAIRELQRQELEREEEALASKRFRAERQDNKENWLHSQQREAEQRAALARLAGQLE

SEQ ID NO: 80099 - protein, 151 aa, Homo sapiens
  Payload ID: 15964
  Gene Symbol: SMTN
  Gene Name: smoothelin
  ENSP ID: ENSP00000401341
MRVHPRPHSRLAAKLAGLEPETPYPGFEFSELVTGATGTGDLTRKEPTELGASEMADEALAGLDEGALRKLLEVTADLAERRRIRSAIRELQRQELEREEEALASKRFRAERQDNKENWLHSQQREAEQRAALARLAGQLESMNDVEELTA

SEQ ID NO: 80100 - protein, 127 aa, Homo sapiens
  Payload ID: 15964
  Gene Symbol: SMTN
  Gene Name: smoothelin
  ENSP ID: ENSP00000409925
MADEALAGLDEGALRKLLEVTADLAERRRIRSAIRELQRQELEREEEALASKRFRAERQDNKENWLHSQQREAEQRAALARLAGQLESMNDVEELTALLRSAGEYEERKLIRAAIRRVRAQEIEAAT

SEQ ID NO: 80101 - protein, 98 aa, Homo sapiens
  Payload ID: 15964
  Gene Symbol: SMTN
  Gene Name: smoothelin
  ENSP ID: ENSP00000409990
MNDVEELTALLRSAGEYEERKLIRAAIRRVRAQEIEAATLAGRLYSGRPNSGSREDSKGLAAHRLEQCEVPEREEQEQQAEVSKPTPTPEGTSQDVTT

SEQ ID NO: 80102 - protein, 971 aa, Homo sapiens
  Payload ID: 15964
  Gene Symbol: SMTN
  Gene Name: smoothelin
  ENSP ID: ENSP00000479578
MGGMGTPGDLHAACPSTTRRDALCLGPEFEFDLRHSAGCPGDLGFFPLDPDTEAGGSGCLPTWLPLRRLARGRLEVTADLAERRRIRSAIRELQRQELEREEEALASKRFRAERQDNKENWLHSQQREAEQRAALARLAGQLESMNDVEELTALLRSAGEYEERKLIRAAIRRVRAQEIEAATLAGRLYSGRPNSGSREDSKGLAAHRLEQCEVPEREEQEQQAEVSKPTPTPEGTSQDVTTVTLLLRAPPGSTSSSPASPSSSPTPASPEPPLEPAEAQCLTAEVPGSPEPPPSPPKTTSPEPQESPTLPSTEGQVVNKLLSGPKETPAAQSPTRGPSDTKRADVAGPRPCQRSLSVLSPRQPAQNRESTPLASGPSSFQRAGSVRDRVHKFTSDSPMAARLQDGTPQAALSPLTPARLLGPSLTSTTPASSSSGSSSRGPSDTSSRFSKEQRGVAQPLAQLRSCPQEEGPRGRGLAARPLENRAGGPVARSEEPGAPLPVAVGTAEPGGSMKTTFTIEIKDGRGQASTGRVLLPTGNQRAELTLGLRAPPTLLSTSSGGKSTITRVNSPGTLARLGSVTHVTSFSHAPPSSRGGCSIKMEAEPAEPLAAAVEAANGAEQTRVNKAPEGRSPLSAEELMTIEDEGVLDKMLDQSTDFEERKLIRAALRELRQRKRDQRDKERERRLQEARGRPGEGRGNTATETTTRHSQRAADGSAVSTVTKTERLVHSNDGTRTARTTTVESSFVRRSENGSGSTMMQTKTFSSSSSSKKMGSIFDREDQASPRAGSLAALEKRQAEKKKELMKAQSLPKTSASQARKAMIEKLEKEGAAGSPGGPRAAVQRSTSFGVPNANSIKQMLLDWCRAKTRGYEHVDIQNFSSSWSDGMAFCALVHNFFPEAFDYGQLSPQNRRQNFEVAFSSAETHADCPQLLDTEDMVRLREPDWKCVYTYIQEFYRCLVQKGLVKTKKS

SEQ ID NO: 80103 - protein, 1002 aa, Homo sapiens
  Payload ID: 15964
  Gene Symbol: SMTN
  Gene Name: smoothelin
  ENSP ID: ENSP00000484398
MRVHPRPHSRLAAKLAGLEPETPYPGFEFSELVTGATGTGDLTRKEPTELGASEMADEALAGLDEGALRKLLEVTADLAERRRIRSAIRELQRQELEREEEALASKRFRAERQDNKENWLHSQQREAEQRAALARLAGQLESMNDVEELTALLRSAGEYEERKLIRAAIRRVRAQEIEAATLAGRLYSGRPNSGSREDSKGLAAHRLEQCEVPEREEQEQQAEVSKPTPTPEGTSQDVTTVTLLLRAPPGSTSSSPASPSSSPTPASPEPPLEPAEAQCLTAEVPGSPEPPPSPPKTTSPEPQESPTLPSTEGQVVNKLLSGPKETPAAQSPTRGPSDTKRADVAGPRPCQRSLSVLSPRQPAQNRESTPLASGPSSFQRAGSVRDRVHKFTSDSPMAARLQDGTPQAALSPLTPARLLGPSLTSTTPASSSSGSSSRGPSDTSSRFSKEQRGVAQPLAQLRSCPQEEGPRGRGLAARPLENRAGGPVARSEEPGAPLPVAVGTAEPGGSMKTTFTIEIKDGRGQASTGRVLLPTGNQRAELTLGLRAPPTLLSTSSGGKSTITRVNSPGTLARLGSVTHVTSFSHAPPSSRGGCSIKAAEDAGTPVAHPPAFSTRRRSSTGTTRSTSLMEAEPAEPLAAAVEAANGAEQTRVNKAPEGRSPLSAEELMTIEDEGVLDKMLDQSTDFEERKLIRAALRELRQRKRDQRDKERERRLQEARGRPGEGRGNTATETTTRHSQRAADGSAVSTVTKTERLVHSNDGTRTARTTTVESSFVRRSENGSGSTMMQTKTFSSSSSSKKMGSIFDREDQASPRAGSLAALEKRQAEKKKELMKAQSLPKTSASQARKAMIEKLEKEGAAGSPGGPRAAVQRSTSFGVPNANSIKQMLLDWCRAKTRGYEHVDIQNFSSSWSDGMAFCALVHNFFPEAFDYGQLSPQNRRQNFEVAFSSAEMLVDCVPLVEVDDMMIMGKKPDPKCVFTYVQSLYNHLRRHELRLRGKNV

SEQ ID NO: 80104 - protein, 311 aa, Homo sapiens
  Payload ID: 15964
  Gene Symbol: SMTN
  Gene Name: smoothelin
  ENSP ID: ENSP00000485089
  MOD_RES (1)..(1): Any amino acid
XRKLIRAALRELRQRKRDQRDKERERRLQEARGRPGEGRGNTATETTTRHSQRAADGSAVSTVTKTERLVHSNDGTRTARTTTVESSFVRRSENGSGSTMMQTKTFSSSSSSKKMGSIFDREDQASPRAGSLAALEKRQAEKKKELMKAQSLPKTSASQARKAMIEKLEKEGAAGPGGPRAAVQRSTSFGVPNANSIKQMLLDWCRAKTRGYEHVDIQNFSSSWSDGMAFCALVHNFFPEAFDYGQLSPQNRRQNFEVAFSSAETHADCPQLLDTEDMVRLREPDWKCVYTYIQEFYRCLVQKGLVKTKKS

SEQ ID NO: 80105 - protein, 5 aa, Homo sapiens
  Payload ID: 15964
  Gene Symbol: SMTN
  Gene Name: smoothelin
  ENSP ID: ENSP00000485277
MNDVE

SEQ ID NO: 80106 - protein, 457 aa, Homo sapiens
  Payload ID: 15965
  Gene Symbol: SMTNL1
  Gene Name: smoothelin-like 1
  Uniprot ID: A8MU46
  ENSP ID: ENSP00000382108
MEQKEGKLSEDGTTVSPAADNPEMSGGGAPAEETKGTAGKAINEGPPTESGKQEKAPAEDGMSAELQGEANGLDEVKVESQREAGGKEDAEAELKKEDGEKEETTVGSQEMTGRKEETKSEPKEAEEKESTLASEKQKAEEKEAKPESGQKADANDRDKPEPKATVEEEDAKTASQEETVVEDEAKAEPKEPDGKEEAKHGAKEEADEPGSPSEEQEQDVEKEPEGGAGVIPSSPEEWPESPTGEGHNLSTDGLGPDCVASGQTSPSASESSPSDVPQSPPESPSSGEKKEKAPERRVSAPARPRGPRAQNRKAIVDKFGGAASGPTALFRNTKAAGAAIGGVKNMLLEWCRAMTKKYEHVDIQNFSSSWSSGMAFCALIHKFFPDAFDYAELDPAKRRHNFTLAFSTAEKLADCAQLLDVDDMVRLAVPDSKCVYTYIQELYRSLVQKGLVKTKKK

SEQ ID NO: 80107 - protein, 494 aa, Homo sapiens
  Payload ID: 15965
  Gene Symbol: SMTNL1
  Gene Name: smoothelin-like 1
  ENSP ID: ENSP00000432651
MEQKEGKLSEDGTTVSPAADNPEMSGGGAPAEETKGTAGKAINEGPPTESGKQEKAPAEDGMSAELQGEANGLDEVKVESQREAGGKEDAEAELKKEDGEKEETTVGSQEMTGRKEETKSEPKEAEEKESTLASEKQKAEEKEAKPESGQKADANDRDKPEPKATVEEEDAKTASQEETGQRKECSTEPKEKATDEEAKAESQKAVVEDEAKAEPKEPDGKEEAKHGAKEEADAKEEAEDAEEAEPGSPSEEQEQDVEKEPEGGAGVIPSSPEEWPESPTGEGHNLSTDGLGPDCVASGQTSPSASESSPSDVPQSPPESPSSGEKKEKAPERRVSAPARPRGPRAQNRKAIVDKFGGAASGPTALFRNTKAAGAAIGGVKNMLLEWCRAMTKKYEHVDIQNFSSSWSSGMAFCALIHKFFPDAFDYAELDPAKRRHNFTLAFSTAEKLADCAQLLDVDDMVRLAVPDSKCVYTYIQELYRSLVQKGLVKTKKK

SEQ ID NO: 80108 - protein, 317 aa, Homo sapiens
  Payload ID: 15966
  Gene Symbol: SMTNL2
  Gene Name: smoothelin-like 2
  Uniprot ID: Q2TAL5
  ENSP ID: ENSP00000345143
MRKTSNSCIMENGHQPGAGPGDGPPEIAQNFSAPDPPRPRPVSLSLRLPHQPVTAITRVSDRFSGETSAAALSPMSAATLGGLNPSPSEVITPWTPSPSEKNSSFTWSVPSSGYGAVTASKHSNSPPLVTPPQSPVSPQPPAITQVHRQGERRRELVRSQTLPRTSEAQARKALFEKWEQETAAGKGKGEARARLKRSQSFGVASASSIKQILLEWCRSKTLGYQHVDLQNFSSSWSDGMAFCALVHSFFPDAFDYNSLSPTQRQKNFELAFTMAENLANCERLIEVEDMMVMGRKPDPMCVFTYVQSLYNHLRRFE

SEQ ID NO: 80109 - protein, 461 aa, Homo sapiens
  Payload ID: 15966
  Gene Symbol: SMTNL2
  Gene Name: smoothelin-like 2
  Uniprot ID: Q2TAL5
  ENSP ID: ENSP00000373964
MEPAPDAQEARTVREALGRYEAALEGAVRALHEDMRGLQRGVERRVAEAMRLAGPLARTVADLQRDNQRLQAQLERLTRQVEALGLASGMSPVPGTPGTPSPPPAPGVPDRAPRLGSARFASHATFSLSGRGQSLDHDEASESEMRKTSNSCIMENGHQPGAGPGDGPPEIAQNFSAPDPPRPRPVSLSLRLPHQPVTAITRVSDRFSGETSAAALSPMSAATLGGLNPSPSEVITPWTPSPSEKNSSFTWSVPSSGYGAVTASKHSNSPPLVTPPQSPVSPQPPAITQVHRQGERRRELVRSQTLPRTSEAQARKALFEKWEQETAAGKGKGEARARLKRSQSFGVASASSIKQILLEWCRSKTLGYQHVDLQNFSSSWSDGMAFCALVHSFFPDAFDYNSLSPTQRQKNFELAFTMAENLANCERLIEVEDMMVMGRKPDPMCVFTYVQSLYNHLRRFE

SEQ ID NO: 80110 - protein, 82 aa, Homo sapiens
  Payload ID: 15966
  Gene Symbol: SMTNL2
  Gene Name: smoothelin-like 2
  ENSP ID: ENSP00000460663
MRKTSNSCIMENGHQPGAEKNSSFTWSVPSSGYGAVTASKHSNSPPLVTPPQSPVSPQPPAITQVHRQGERRRELVRSQTLP

SEQ ID NO: 80111 - protein, 787 aa, Homo sapiens
  Payload ID: 15967
  Gene Symbol: SMO
  Gene Name: smoothened, frizzled class receptor
  Uniprot ID: Q99835
  ENSP ID: ENSP00000249373
MAAARPARGPELPLLGLLLLLLLGDPGRGAASSGNATGPGPRSAGGSARRSAAVTGPPPPLSHCGRAAPCEPLRYNVCLGSVLPYGATSTLLAGDSDSQEEAHGKLVLWSGLRNAPRCWAVIQPLLCAVYMPKCENDRVELPSRTLCQATRGPCAIVERERGWPDFLRCTPDRFPEGCTNEVQNIKFNSSGQCEVPLVRTDNPKSWYEDVEGCGIQCQNPLFTEAEHQDMHSYIAAFGAVTGLCTLFTLATFVADWRNSNRYPAVILFYVNACFFVGSIGWLAQFMDGARREIVCRADGTMRLGEPTSNETLSCVIIFVIVYYALMAGVVWFVVLTYAWHTSFKALGTTYQPLSGKTSYFHLLTWSLPFVLTVAILAVAQVDGDSVSGICFVGYKNYRYRAGFVLAPIGLVLIVGGYFLIRGVMTLFSIKSNHPGLLSEKAASKINETMLRLGIFGFLAFGFVLITFSCHFYDFFNQAEWERSFRDYVLCQANVTIGLPTKQPIPDCEIKNRPSLLVEKINLFAMFGTGIAMSTWVWTKATLLIWRRTWCRLTGQSDDEPKRIKKSKMIAKAFSKRHELLQNPGQELSFSMHTVSHDGPVAGLAFDLNEPSADVSSAWAQHVTKMVARRGAILPQDISVTPVATPVPPEEQANLWLVEAEISPELQKRLGRKKKRRKRKKEVCPLAPPPELHPPAPAPSTIPRLPQLPRQKCLVAAGAWGAGDSCRQGAWTLVSNPFCPEPSPPQDPFLPSAPAPVAWAHGRRQGLGPIHSRTNLMDTELMDADSDF

SEQ ID NO: 80112 - protein, 151 aa, Homo sapiens
  Payload ID: 15967
  Gene Symbol: SMO
  Gene Name: smoothened, frizzled class receptor
  ENSP ID: ENSP00000418720
  MOD_RES (1)..(1): Any amino acid
XSNETLSCVIIFVIVYYALMAGVVWFVVLTYAWHTSFKALGTTYQPLSGKTSYFHLLTWSLPFVLTVAILAVAQVDGDSVSGICFVGYKNYRYRAGFVLAPIGLVLIVGGYFLIRGVMTLFSIKSNHPGLLSEKAASKINETMLRLDVRPM

SEQ ID NO: 80113 - protein, 70 aa, Homo sapiens
  Payload ID: 15967
  Gene Symbol: SMO
  Gene Name: smoothened, frizzled class receptor
  ENSP ID: ENSP00000420749
TKATLLIWRRTWCRLTGQSDDEPKRIKKSKMIAKAFSKRHELLQNPGQELSFSMHTVSHDGPVVALPGQE

SEQ ID NO: 80114 - protein, 513 aa, Homo sapiens [sequence omitted]

SEQ ID NO: 80115 - protein, 70 aa, Homo sapiens
  Payload ID: 15969
  Gene Symbol: SMYD5
  Gene Name: SMYD family member 5
  ENSP ID: ENSP00000258100
MAASMCDVFSFCVGVAGRARVSVEVRFVSSAKGKGLFATQLIRKGETIFVERPLVAAQFLWNALYRYRGH

SEQ ID NO: 80116 - protein, 418 aa, Homo sapiens
  Payload ID: 15969
  Gene Symbol: SMYD5
  Gene Name: SMYD family member 5
  Uniprot ID: Q6GMV2
  ENSP ID: ENSP00000374152
MAASMCDVFSFCVGVAGRARVSVEVRFVSSAKGKGLFATQLIRKGETIFVERPLVAAQFLWNALYRYRACDHCLRALEKAEENAQRLTGKPGQVLPHPELCTVRKDLHQNCPHCQVMYCSAECRLAATEQYHQVLCPGPSQDDPLHPLNKLQEAWRSIHYPPETASIMLMARMVATVKQAKDKDRWIRLFSQFCNKTANEEEEIVHKLLGDKFKGQLELLRRLFTEALYEEAVSQWFTPDGFRSLFALVGTNGQGIGTSSLSQWVHACDTLELKPQDREQLDAFIDQLYKDIEAATGEFLNCEGSGLFVLQSCCNHSCVPNAETSFPENNFLLHVTALEDIKPGEEICISYLDCCQRERSRHSRHKILRENYLFVCSCPKCLAEADEPNVTSEEEEEEEEEEEGEPEDAELGDEMTDV

SEQ ID NO: 80117 - protein, 81 aa, Homo sapiens
  Payload ID: 15969
  Gene Symbol: SMYD5
  Gene Name: SMYD family member 5
  ENSP ID: ENSP00000388195
MAASMCDVFSFCVGVAGRARVSVEVRFVSSAKGKGLFATQLIRKGETIFVERPLVAAQFLWNALYRYREWCLAHSSCSVGL

SEQ ID NO: 80118 - protein, 138 aa, Homo sapiens
  Payload ID: 15969
  Gene Symbol: SMYD5
  Gene Name: SMYD family member 5
  ENSP ID: ENSP00000412587
MCEIWGKGLFATQLIRKGETIFVERPLVAAQFLWNALYRYRACDHCLRALEKAEENAQRLTGKPGQVLPHPELCTVRKDLHQNCPHCQVMYCSAECRLAATEQYHQVLCPGPSQDDPLHPLNKLQEAWRSIHYPPETA

SEQ ID NO: 80119 - protein, 81 aa, Homo sapiens; identical to SEQ ID NO: 80117
  Payload ID: 15969
  Gene Symbol: SMYD5
  Gene Name: SMYD family member 5
  ENSP ID: ENSP00000485790

SEQ ID NO: 80120 - protein, 264 aa, Homo sapiens
  Payload ID: 15970
  Gene Symbol: SNAI1
  Gene Name: snail family zinc finger 1
  Uniprot ID: O95863
  ENSP ID: ENSP00000244050
MPRSFLVRKPSDPNRKPNYSELQDSNPEFTFQQPYDQAHLLAAIPPPEILNPTASLPMLIWDSVLAPQAQPIAWASLRLQESPRVAELTSLSDEDSGKGSQPPSPPSPAPSSFSSTSVSSLEAEAYAAFPGLGQVPKQLAQLSEAKDLQARKAFNCKYCNKEYLSLGALKMHIRSHTLPCVCGTCGKAFSRPWLLQGHVRTHTGEKPFSCPHCSRAFADRSNLRAHLQTHSDVKKYQCQACARTFSRMSLLHKHQESGCSGCPR

SEQ ID NO: 80121 - protein, 268 aa, Homo sapiens
  Payload ID: 15971
  Gene Symbol: SNAI2
  Gene Name: snail family zinc finger 2
  Uniprot ID: O43623
  ENSP ID: ENSP00000020945
MPRSFLVKKHFNASKKPNYSELDTHTVIISPYLYESYSMPVIPQPEILSSGAYSPITVWTTAAPFHAQLPNGLSPLSGYSSSLGRVSPPPPSDTSSKDHSGSESPISDEEERLQSKLSDPHAIEAEKFQCNLCNKTYSTFSGLAKHKQLHCDAQSRKSFSCKYCDKEYVSLGALKMHIRTHTLPCVCKICGKAFSRPWLLQGHIRTHTGEKPFSCPHCNRAFADRSNLRAHLQTHSDVKKYQCKNCSKTFSRMSLLHKHEESGCCVAH

SEQ ID NO: 80122 - protein, 268 aa, Homo sapiens; identical to SEQ ID NO: 80121
  Payload ID: 15971
  Gene Symbol: SNAI2
  Gene Name: snail family zinc finger 2
  Uniprot ID: O43623
  ENSP ID: ENSP00000380034

SEQ ID NO: 80123 - protein, 292 aa, Homo sapiens
  Payload ID: 15972
  Gene Symbol: SNAI3
  Gene Name: snail family zinc finger 3
  Uniprot ID: Q3KNW1
  ENSP ID: ENSP00000327968
MPRSFLVKTHSSHRVPNYRRLETQREINGACSACGGLVVPLLPRDKEAPSVPGDLPQPWDRSSAVACISLPLLPRIEEALGASGLDALEVSEVDPRASRAAIVPLKDSLNHLNLPPLLVLPTRWSPTLGPDRHGAPEKLLGAERMPRAPGGFECFHCHKPYHTLAGLARHRQLHCHLQVGRVFTCKYCDKEYTSLGALKMHIRTHTLPCTCKICGKAFSRPWLLQGHVRTHTGEKPYACSHCSRAFADRSNLRAHLQTHSDAKKYRCRRCTKTFSRMSLLARHEESGCCPGP

SEQ ID NO: 80124 - protein, 136 aa, Homo sapiens
  Payload ID: 15973
  Gene Symbol: SNAPIN
  Gene Name: SNAP-associated protein
  Uniprot ID: O95295
  ENSP ID: ENSP00000357674
MAGAGSAAVSGAGTPVAGPTGRDLFAEGLLEFLRPAVQQLDSHVHAVRESQVELREQIDNLATELCRINEDQKVALDLDPYVKKLLNARRRVVLVNNILQNAQERLRRLNHSVAKETARRRAMLDSGIYPPGSPGK

SEQ ID NO: 80125 - protein, 765 aa, Homo sapiens
  Payload ID: 15974
  Gene Symbol: SNRK
  Gene Name: SNF related kinase
  Uniprot ID: Q9NRH2
  ENSP ID: ENSP00000296088
MAGFKRGYDGKIAGLYDLDKTLGRGHFAVVKLARHVFTGEKVAVKVIDKTKLDTLATGHLFQEVRCMKLVQHPNIVRLYEVIDTQTKLYLILELGDGGDMFDYIMKHEEGLNEDLAKKYFAQIVHAISYCHKLHVVHRDLKPENVVFFEKQGLVKLTDFGFSNKFQPGKKLTTSCGSLAYSAPEILLGDEYDAPAVDIWSLGVILFMLVCGQPPFQEANDSETLTMIMDCKYTVPSHVSKECKDLITRMLQRDPKRRASLEEIENHPWLQGVDPSPATKYNIPLVSYKNLSEEEHNSIIQRMVLGDIADRDAIVEALETNRYNHITATYFLLAERILREKQEKEIQTRSASPSNIKAQFRQSWPTKIDVPQDLEDDLTATPLSHATVPQSPARAADSVLNGHRSKGLCDSAKKDDLPELAGPALSTVPPASLKPTASGRKCLFRVEEDEEEDEEDKKPMSLSTQVVLRRKPSVTNRLTSRKSAPVLNQIFEEGESDDEFDMDENLPPKLSRLKMNIASPGTVHKRYHRRKSQGRGSSCSSSETSDDDSESRRRLDKDSGFTYSWHRRDSSEGPPGSEGDGGGQSKPSNASGGVDKASPSENNAGGGSPSSGSGGNPTNTSGTTRRCAGPSNSMQLASRSAGELVESLKLMSLCLGSQLHGSTKYIIDPQNGLSFSSVKVQEKSTWKMCISSTGNAGQVPAVGGIKFFSDHMADTTTELERIKSKNLKNNVLQLPLCEKTISVNIQRNPKEGLLCASSPASCCHVI

SEQ ID NO: 80126 - protein, 765 aa, Homo sapiens; identical to SEQ ID NO: 80125
  Payload ID: 15974
  Gene Symbol: SNRK
  Gene Name: SNF related kinase
  Uniprot ID: Q9NRH2
  ENSP ID: ENSP00000401246

SEQ ID NO: 80127 - protein, 559 aa, Homo sapiens
  Payload ID: 15974
  Gene Symbol: SNRK
  Gene Name: SNF related kinase
  ENSP ID: ENSP00000409516
MLVCGQPPFQEANDSETLTMIMDCKYTVPSHVSKECKDLITRMLQRDPKRRASLEEIENHPWLQGVDPSPATKYNIPLVSYKNLSEEEHNSIIQRMVLGDIADRDAIVEALETNRYNHITATYFLLAERILREKQEKEIQTRSASPSNIKAQFRQSWPTKIDVPQDLEDDLTATPLSHATVPQSPARAADSVLNGHRSKGLCDSAKKDDLPELAGPALSTVPPASLKPTASGRKCLFRVEEDEEEDEEDKKPMSLSTQVVLRRKPSVTNRLTSRKSAPVLNQIFEEGESDDEFDMDENLPPKLSRLKMNIASPGTVHKRYHRRKSQGRGSSCSSSETSDDDSESRRRLDKDSGFTYSWHRRDSSEGPPGSEGDGGGQSKPSNASGGVDKASPSENNAGGGSPSSGSGGNPTNTSGTTRRCAGPSNSMQLASRSAGELVESLKLMSLCLGSQLHGSTKYIIDPQNGLSFSSVKVQEKSTWKMCISSTGNAGQVPAVGGIKFFSDHMADTTTELERIKSKNLKNNVLQLPLCEKTISVNIQRNPKEGLLCASSPASCCHVI

SEQ ID NO: 80128 - protein, 765 aa, Homo sapiens; identical to SEQ ID NO: 80125
  Payload ID: 15974
  Gene Symbol: SNRK
  Gene Name: SNF related kinase
  Uniprot ID: Q9NRH2
  ENSP ID: ENSP00000411375

SEQ ID NO: 80129 - protein, 1683 aa, Homo sapiens
  Payload ID: 15975
  Gene Symbol: SHPRH
  Gene Name: SNF2 histone linker PHD RING helicase, E3 ubiquitin protein ligase
  Uniprot ID: Q149N8
  ENSP ID: ENSP00000275233
MSSRRKRAPPVRVDEEKRQQLHWNMHEDRRNEPIIISDDDEQPCPGSDTSSAHYIILSDSLKEEVAHRDKKRCSKVVSFSKPIEKEETVGIFSPLSVKLNIVISPYHFDNSWKAFLGELTLQLLPAQSLIENFSERSITLMSSESSNQFLIYVHSKGEDVEKQKKEPMSICDKGILVESSFSGEMLEDLGWLQKKRRIKLYQKPEGNHIIKVGIYLLEAGLAKLDFLSDANSRMKKFNQLMKKVMEKLHNSIIPDVLEEDEDDPESEPEGQDIDELYHFVKQTHQQETQSIQVDVQHPALIPVLRPYQREAVNWMLQQECFRSSPATESALHFLWREIVTSEGLKLYYNPYTGCIIREYPNSGPQLLGGILADEMGLGKTVEVLALILTHTRQDVKQDALTLPEGKVVNYFIPSHYFGGKLKKTEIQNIEFEPKEKVQCPPTRVMILTAVKEMNGKKGVSILSIYKYVSSIYRYDVQRNRSLLKRMLKCLIFEGLVKQIKGHGFSGTFTLGKNYKEEDICDKTKKQAVGSPRKIQKETRKSGNKDTDSEYLPSDTSDDDDDPYYYYYKSRRNRSKLRKKLVPSTKKGKSQPFINPDSQGHCPATSDSGITDVAMSKSTCISEFNQEHETEDCAESLNHADSDVPPSNTMSPFNTSDYRFECICGELDQIDRKPRVQCLKCHLWQHAKCVNYDEKNLKIKPFYCPHCLVAMEPVSTRATLIISPSSICHQWVDEINRHVRSSSLRVLVYQGVKKDGFLQPHFLAEQDIVIITYDVLRSELNYVDIPHSNSEDGRRLRNQKRYMAIPSPLVAVEWWRICLDEAQMVECPTVKAAEMAQRLSGINRWCISGTPVQRGLEDLFGLVVFLGIEPYCVKHWWVRLLYRPYCKKNPQHLYSFIAKILWRSAKKDVIDQIQIPPQTEEIHWLHFSPVERHFYHRQHEVCCQDVVVKLRKISDWALKLSSLDRRTVTSILYPLLRLRQACCHPQAVRGEFLPLQKSTMTMEELLTSLQKKCGTECEEAHRQLVCALNGLAGIHIIKGEYALAAELYREVLRSSEEHKGKLKTDSLQRLHATHNLMELLIARHPGIPPTLRDGRLEEEAKQLREHYMSKCNTEVAEAQQALYPVQQTIHELQRKIHSNSPWWLNVIHRAIEFTIDEELVQRVRNEITSNYKQQTGKLSMSEKFRDCRGLQFLLTTQMEELNKCQKLVREAVKNLEGPPSRNVIESATVCHLRPARLPLNCCVFCKADELFTEYESKLFSNTVKGQTAIFEEMIEDEEGLVDDRAPTTTRGLWAISETERSMKAILSFAKSHRFDVEFVDEGSTSMDLFEAWKKEYKLLHEYWMALRNRVSAVDELAMATERLRVRDPREPKPNPPVLHIIEPHEVEQNRIKLLNDKAVATSQLQKKLGQLLYLTNLEKSQDKTSGGVNPEPCPICARQLGKQWAVLTCGHCFCNECISIIIEQYSVGSHRSSIKCAICRQTTSHKEISYVFTSEKANQEEDIPVKGSHSTKVEAVVRTLMKIQLRDPGAKALVFSTWQDVLDIISKALTDNNMEFAQISRVKTFQENLSAFKRDPQINILLLPLHTGSNGLTIIEATHVLLVEPILNPAHELQAIGRVHRIGQTKPTIVHRFLIKATIEERMQAMLKTAERSHTNSSAKHSEASVLTVADLADLFTKETEELE

SEQ ID NO: 80130 - protein, 660 aa, Homo sapiens
  Payload ID: 15975
  Gene Symbol: SHPRH
  Gene Name: SNF2 histone linker PHD RING helicase, E3 ubiquitin protein ligase
  ENSP ID: ENSP00000356473
MSSRRKRAPPVRVDEEKRQQLHWNMHEDRRNEPIIISDDDEQPCPGEDVEKQKKEPMSICDKGILVESSFSGEMLEDLGWLQKKRRIKLYQKPEGNHIIKVGIYLLEAGLAKLDFLSDANSRMKKFNQLMKKVMEKLHNSIIPDVLEEDEDDPESEPEGQDIDELYHFVKQTHQQETQSIQVDVQHPALIPVLRPYQREAVNWMLQQECFRSSPATESALHFLWREIVTSEGLKLYYNPYTGCIIREYPNSGPQLLGGILADEMGLGKTVEVLALILTHTRQDVKQDALTLPEGKVVNYFIPSHYFGGKLKKTEIQNIEFEPKEKVQCPPTRVMILTAVKEMNGKKGVSILSIYKYVSSIYRYDVQRNRSLLKRMLKCLIFEGLVKQIKGHGFSGTFTLGKNYKEEDICDKTKKQAVGSPRKIQKETRKSGNKDTDSEYLPSDTSDDDDDPYYYYYKSRRNRSKLRKKLVPSTKKGKSQPFINPDSQGHCPATSDSGITDVAMSKSTCISEFNQEHETEDCAESLNHADSDVPPSNTMSPFNTSDYRFECICGELDQIDRKPRVQCLKCHLWQHAKCVNYDEKNLKIKPFYCPHCLVAMEPVSTRATLIISPSSICHQWVDEINRHVRSSSLRVLVYQGVKKDGFLQPHFGRTGYSYHYL

SEQ ID NO: 80131 - protein, 1683 aa, Homo sapiens; identical to SEQ ID NO: 80129
  Payload ID: 15975
  Gene Symbol: SHPRH
  Gene Name: SNF2 histone linker PHD RING helicase, E3 ubiquitin protein ligase
  Uniprot ID: Q149N8
  ENSP ID: ENSP00000356475

SEQ ID NO: 80132 - protein, 129 aa, Homo sapiens
  Payload ID: 15975
  Gene Symbol: SHPRH
  Gene Name: SNF2 histone linker PHD RING helicase, E3 ubiquitin protein ligase
  ENSP ID: ENSP00000403790
ILLLPLHTGSNGLTIIEATHVLLVEPILNPAHELQAIGRVHRIGQTKPTIVHRFLIKATIEERMQAMLKTAERRFFEEQALFCFHDITPFSHPWSLTTAILQLRDLVICELFFIYFKNFLICFLSSFSI

SEQ ID NO: 80133 - protein, 449 aa, Homo sapiens
  Payload ID: 15975
  Gene Symbol: SHPRH
  Gene Name: SNF2 histone linker PHD RING helicase, E3 ubiquitin protein ligase
  ENSP ID: ENSP00000408019
WNMHEDRRNEPIIISDDDEQPCPGSDTSSAHYIILSDSLKEEVAHRDKKRCSKVVSFSKPIEKEETVGIFSPLSVKLNIVISPYHFDNSWKAFLGELTLQLLPAQSLIENFSERSITLMSSESSNQFLIYVHSKGEDVEKQKKEPMSICDKGILVESSFSGEMLEDLGWLQKKRRIKLYQKPEGNHIIKVGIYLLEAGLAKLDFLSDANSRMKKFNQLMKKVMEKLHNSIIPDVLEEDEDDPESEPEGQDIDELYHFVKQTHQQETQSIQVDVQHPALIPVLRPYQREAVNWMLQQECFRSSPATESALHFLWREIVTSEGLKLYYNPYTGCIIREYPNSGPQLLGGILADEMGLGKTVEVLALILTHTRQDVKQDALTLPEGKVVNYFIPSHYFGGKLKKTEIQNIEFEPKEKVQCPPYPFTFSYTCDDTDSCERNEWKKRSVHPFHL

SEQ ID NO: 80134 - protein, 1659 aa, Homo sapiens
  Payload ID: 15975
  Gene Symbol: SHPRH
  Gene Name: SNF2 histone linker PHD RING helicase, E3 ubiquitin protein ligase
  Uniprot ID: Q149N8
  ENSP ID: ENSP00000412797
MSSRRKRAPPVRVDEEKRQQLHWNMHEDRRNEPIIISDDDEQPCPGSDTSSAHYIILSDSLKEEVAHRDKKRCSKVVSFSKPIEKEETVGIFSPLSVKLNIVISPYHFDNSWKAFLGELTLQLLPAQSLIENFSERSITLMSSESSNQFLIYVHSKGEDVEKQKKEPMSICDKGILVESSFSGEMLEDLGWLQKKRRIKLYQKPEGNHIIKVGIYLLEAGLAKLDFLSDANSRMKKFNQLMKKVMEKLHNSIIPDVLEEDEDDPESEPEGQDIDELYHFVKQTHQQETQSIQVDVQHPALIPVLRPYQREAVNWMLQQECFRSSPATESALHFLWREIVTSEGLKLYYNPYTGCIIREYPNSGPQLLGGILADEMGLGKTVEVLALILTHTRQDVKQDALTLPEGKVVNYFIPSHYFGGKLKKTEIQNIEFEPKEKVQCPPTRVMILTAVKEMNGKKGVSILSIYKYVSSIYRYDVQRNRSLLKRMLKCLIFEGLVKQIKGHGFSGTFTLGKNYKEEDICDKTKKQAVGSPRKIQKETRKSGNKDTDSEYLPSDTSDDDDDPYYYYYKSRRNRSKLRKKLVPSTKKGKSQPFINPDSQGHCPATSDSGITDVAMSKSTCISEFNQEHETEDCAESLNHADSDVPPSNTMSPFNTSDYRFECICGELDQIDRKPRVQCLKCHLWQHAKCVNYDEKNLKIKPFYCPHCLVAMEPVSTRATLIISPSSICHQWVDEINRHVRSSSLRVLVYQGVKKDGFLQPHFLAEQDIVIITYDVLRSELNYVDIPHSNSEDGRRLRNQKRYMAIPSPLVAVEWWRICLDEAQMVECPTVKAAEMAQRLSGINRWCISGTPVQRGLEDLFGLVVFLGIEPYCVKHWWVRLLYRPYCKKNPQHLYSFIAKILWRSAKKDVIDQIQIPPQTEEIHWLHFSPVERHFYHRQHEVCCQDVVVKLRKISDWALKLSSLDRRTVTSILYPLLRLRQACCHPQAVRGEFLPLQKSFEQSTFSFSTMTMEELLTSLQKKCGTECEEAHRQLVCALNGLAGIHIIKGEYALAAELYREVLRSSEEHKGKLKTDSLQRLHATHNLMELLIARHPGIPPTLRDGRLEEEAKQLREHYMSKCNTEVAEAQQALYPVQQTIHELQRKIHSNSPWWLNVIHRAIEFTIDEELVQRVRNEITSNYKQQTGKLSMSEKGLQFLLTTQMEELNKCQKLVREAVKNLEGPPSRNVIESATVCHLRPARLPLNCCVFCKADELFTEYESKLFSNTVKGQTAIFEEMIEDEEGLVDDRAPTTTRGLWAISETERSMKAILSFAKSHRFDVEFVDEGSTSMDLFEAWKKEYKLLHEYWMALRNRVSAVDELAMATERLRVRDPREPKPNPPVLHIIEPHEVEQNRIKLLNDKAVATSQLQKKLGQLLYLTNLEKSQDKTSGGVNPEPCPICARQLGKQWAVLTCGHCFCNECISIIIEQYSVGSHRSSIKCAICRQTTSHKEISYVFTSEKANQEEDIPVKGSHSTKVEAVVRTLMKIQLRDPGAKALVFSTWQDVLDIISKALTDNNMEFAQISRVKTFQENLSAFKRDPQINILLLPLHTGSNGLTIIEATHVLLVEPILNPAHELQAIGRVHRIGQTKPTIVHRFLIKATIEERMQAMLKTAERSIYI

SEQ ID NO: 80135 - protein, 97 aa, Homo sapiens
  Payload ID: 15975
  Gene Symbol: SHPRH
  Gene Name: SNF2 histone linker PHD RING helicase, E3 ubiquitin protein ligase
  ENSP ID: ENSP00000429548
  MOD_RES (1)..(1): Any amino acid
XKPEGNHIIKVGIYLLEAGLAKLDFLSDANSRMKKFNQLMKKVMEKLHNSIIPDVASLVRTADSELSAIGHLGRVWMAWCSSSTLLEKQPKFSKFCS

SEQ ID NO: 80136 - protein, 929 aa, Homo sapiens
  Payload ID: 15975
  Gene Symbol: SHPRH
  Gene Name: SNF2 histone linker PHD RING helicase, E3 ubiquitin protein ligase
  Uniprot ID: Q149N8
  ENSP ID: ENSP00000430528
MSSRRKRAPPVRVDEEKRQQLHWNMHEDRRNEPIIISDDDEQPCPGEDVEKQKKEPMSICDKGILVESSFSGEMLEDLGWLQKKRRIKLYQKPEGNHIIKVGIYLLEAGLAKLDFLSDANSRMKKFNQLMKKVMEKLHNSIIPDVLEEDEDDPESEPEGQDIDELYHFVKQTHQQETQSIQVDVQHPALIPVLRPYQREAVNWMLQQECFRSSPATESALHFLWREIVTSEGLKLYYNPYTGCIIREYPNSGPQLLGGILADEMGLGKTVEVLALILTHTRQDVKQDALTLPEGKVVNYFIPSHYFGGKLKKTEIQNIEFEPKEKVQCPPTRVMILTAVKEMNGKKGVSILSIYKYVSSIYRYDVQRNRSLLKRMLKCLIFEGLVKQIKGHGFSGTFTLGKNYKEEDICDKTKKQAVGSPRKIQKETRKSGNKDTDSEYLPSDTSDDDDDPYYYYYKSRRNRSKLRKKLVPSTKKGKSQPFINPDSQGHCPATSDSGITDVAMSKSTCISEFNQEHETEDCAESLNHADSDVPPSNTMSPFNTSDYRFECICGELDQIDRKPRVQCLKCHLWQHAKCVNYDEKNLKIKPFYCPHCLVAMEPVSTRATLIISPSSICHQWVDEINRHVRSSSLRVLVYQGVKKDGFLQPHFLAEQDIVIITYDVLRSELNYVDIPHSNSEDGRRLRNQKRYMAIPSPLVAVEWWRICLDEAQMVECPTVKAAEMAQRLSGINRWCISGTPVQRGLEDLFGLVVFLGIEPYCVKHWWVRLLYRPYCKKNPQHLYSFIAKILWRSAKKDVIDQIQIPPQTEEIHWLHFSPVERHFYHRQHEVCCQDVVVKLRKISDWALKLSSLDRRTVTSILYPLLRLRQACCHPQAVRGEFLPLQKSTMTMEELLTSLQKKCGTECEEAHRQLVCALNGLAGIHIIKGRR

SEQ ID NO: 80137 - protein, 1687 aa, Homo sapiens
  Payload ID: 15975
  Gene Symbol: SHPRH
  Gene Name: SNF2 histone linker PHD RING helicase, E3 ubiquitin protein ligase
  ENSP ID: ENSP00000486723
MSSRRKRAPPVRVDEEKRQQLHWNMHEDRRNEPIIISDDDEQPCPGSDTSSAHYIILSDSLKEEVAHRDKKRCSKVVSFSKPIEKEETVGIFSPLSVKLNIVISPYHFDNSWKAFLGELTLQLLPAQSLIENFSERSITLMSSESSNQFLIYVHSKGEDVEKQKKEPMSICDKGILVESSFSGEMLEDLGWLQKKRRIKLYQKPEGNHIIKVGIYLLEAGLAKLDFLSDANSRMKKFNQLMKKVMEKLHNSIIPDVLEEDEDDPESEPEGQDIDELYHFVKQTHQQETQSIQVDVQHPALIPVLRPYQREAVNWMLQQECFRSSPATESALHFLWREIVTSEGLKLYYNPYTGCIIREYPNSGPQLLGGILADEMGLGKTVEVLALILTHTRQDVKQDALTLPEGKVVNYFIPSHYFGGKLKKTEIQNIEFEPKEKVQCPPTRVMILTAVKEMNGKKGVSILSIYKYVSSIYRYDVQRNRSLLKRMLKCLIFEGLVKQIKGHGFSGTFTLGKNYKEEDICDKTKKQAVGSPRKIQKETRKSGNKDTDSEYLPSDTSDDDDDPYYYYYKSRRNRSKLRKKLVPSTKKGKSQPFINPDSQGHCPATSDSGITDVAMSKSTCISEFNQEHETEDCAESLNHADSDVPPSNTMSPFNTSDYRFECICGELDQIDRKPRVQCLKCHLWQHAKCVNYDEKNLKIKPFYCPHCLVAMEPVSTRATLIISPSSICHQWVDEINRHVRSSSLRVLVYQGVKKDGFLQPHFLAEQDIVIITYDVLRSELNYVDIPHSNSEDGRRLRNQKRYMAIPSPLVAVEWWRICLDEAQMVECPTVKAAEMAQRLSGINRWCISGTPVQRGLEDLFGLVVFLGIEPYCVKHWWVRLLYRPYCKKNPQHLYSFIAKILWRSAKKDVIDQIQIPPQTEEIHWLHFSPVERHFYHRQHEVCCQDVVVKLRKISDWALKLSSLDRRTVTSILYPLLRLRQACCHPQAVRGEFLPLQKSFEQSTFSFSTMTMEELLTSLQKKCGTECEEAHRQLVCALNGLAGIHIIKGEYALAAELYREVLRSSEEHKGKLKTDSLQRLHATHNLMELLIARHPGIPPTLRDGRLEEEAKQLREHYMSKCNTEVAEAQQALYPVQQTIHELQRKIHSNSPWWLNVIHRAIEFTIDEELVQRVRNEITSNYKQQTGKLSMSEKGLQFLLTTQMEELNKCQKLVREAVKNLEGPPSRNVIESATVCHLRPARLPLNCCVFCKADELFTEYESKLFSNTVKGQTAIFEEMIEDEEGLVDDRAPTTTRGLWAISETERSMKAILSFAKSHRFDVEFVDEGSTSMDLFEAWKKEYKLLHEYWMALRNRVSAVDELAMATERLRVRDPREPKPNPPVLHIIEPHEVEQNRIKLLNDKAVATSQLQKKLGQLLYLTNLEKSQDKTSGGVNPEPCPICARQLGKQWAVLTCGHCFCNECISIIIEQYSVGSHRSSIKCAICRQTTSHKEISYVFTSEKANQEEDIPVKGSHSTKVEAVVRTLMKIQLRDPGAKALVFSTWQDVLDIISKALTDNNMEFAQISRVKTFQENLSAFKRDPQINILLLPLHTGSNGLTIIEATHVLLVEPILNPAHELQAIGRVHRIGQTKPTIVHRFLIKATIEERMQAMLKTAERSHTNSSAKHSEASVLTVADLADLFTKETEELE

SEQ ID NO: 80138 - protein, 3230 aa, Homo sapiens
  Payload ID: 15976
  Gene Symbol: SRCAP
  Gene Name: Snf2-related CREBBP activator protein
  Uniprot ID: Q6ZRS2
  ENSP ID: ENSP00000262518
MQSSPSPAHPQLPVLQTQMVSDGMTGSNPVSPASSSSPASSGAGGISPQHIAQDSSLDGPPGPPDGATVPLEGFSLSQAADLANKGPKWEKSHAEIAEQAKHEAEIETRIAELRKEGFWSLKRLPKVPEPPRPKGHWDYLCEEMQWLSADFAQERRWKRGVARKVVRMVIRHHEEQRQKEERARREEQAKLRRIASTMAKDVRQFWSNVEKVVQFKQQSRLEEKRKKALDLHLDFIVGQTEKYSDLLSQSLNQPLTSSKAGSSPCLGSSSAASSPPPPASRLDDEDGDFQPQEDEEEDDEETIEVEEQQEGNDAEAQRREIELLRREGELPLEELLRSLPPQLLEGPSSPSQTPSSHDSDTRDGPEEGAEEEPPQVLEIKPPPSAVTQRNKQPWHPDEDDEEFTANEEEAEDEEDTIAAEEQLEGEVDHAMELSELAREGELSMEELLQQYAGAYAPGSGSSEDEDEDEVDANSSDCEPEGPVEAEEPPQEDSSSQSDSVEDRSEDEEDEHSEEEETSGSSASEESESEESEDAQSQSQADEEEEDDDFGVEYLLARDEEQSEADAGSGPPTPGPTTLGPKKEITDIAAAAESLQPKGYTLATTQVKTPIPLLLRGQLREYQHIGLDWLVTMYEKKLNGILADEMGLGKTIQTISLLAHLACEKGNWGPHLIIVPTSVMLNWEMELKRWCPSFKILTYYGAQKERKLKRQGWTKPNAFHVCITSYKLVLQDHQAFRRKNWRYLILDEAQNIKNFKSQRWQSLLNFNSQRRLLLTGTPLQNSLMELWSLMHFLMPHVFQSHREFKEWFSNPLTGMIEGSQEYNEGLVKRLHKVLRPFLLRRVKVDVEKQMPKKYEHVIRCRLSKRQRCLYDDFMAQTTTKETLATGHFMSVINILMQLRKVCNHPNLFDPRPVTSPFITPGICFSTASLVLRATDVHPLQRIDMGRFDLIGLEGRVSRYEADTFLPRHRLSRRVLLEVATAPDPPPRPKPVKMKVNRMLQPVPKQEGRTVVVVNNPRAPLGPVPVRPPPGPELSAQPTPGPVPQVLPASLMVSASPAGPPLIPASRPPGPVLLPPLQPNSGSLPQVLPSPLGVLSGTSRPPTPTLSLKPTPPAPVRLSPAPPPGSSSLLKPLTVPPGYTFPPAAATTTSTTTATATTTAVPAPTPAPQRLILSPDMQARLPSGEVVSIGQLASLAQRPVANAGGSKPLTFQIQGNKLTLTGAQVRQLAVGQPRPLQRNVVHLVSAGGQHHLISQPAHVALIQAVAPTPGPTPVSVLPSSTPSTTPAPTGLSLPLAANQVPPTMVNNTGVVKIVVRQAPRDGLTPVPPLAPAPRPPSSGLPAVLNPRPTLTPGRLPTPTLGTARAPMPTPTLVRPLLKLVHSPSPEVSASAPGAAPLTISSPLHVPSSLPGPASSPMPIPNSSPLASPVSSTVSVPLSSSLPISVPTTLPAPASAPLTIPISAPLTVSASGPALLTSVTPPLAPVVPAAPGPPSLAPSGASPSASALTLGLATAPSLSSSQTPGHPLLLAPTSSHVPGLNSTVAPACSPVLVPASALASPFPSAPNPAPAQASLLAPASSASQALATPLAPMAAPQTAILAPSPAPPLAPLPVLAPSPGAAPVLASSQTPVPVMAPSSTPGTSLASASPVPAPTPVLAPSSTQTMLPAPVPSPLPSPASTQTLALAPALAPTLGGSSPSQTLSLGTGNPQGPFPTQTLSLTPASSLVPTPAQTLSLAPGPPLGPTQTLSLAPAPPLAPASPVGPAPAHTLTLAPASSSASLLAPASVQTLTLSPAPVPTLGPAAAQTLALAPASTQSPASQASSLVVSASGAAPLPVTMVSRLPVSKDEPDTLTLRSGPPSPPSTATSFGGPRPRRQPPPPPRSPFYLDSLEEKRKRQRSERLERIFQLSEAHGALAPVYGTEVLDFCTLPQPVASPIGPRSPGPSHPTFWTYTEAAHRAVLFPQQRLDQLSEIIERFIFVMPPVEAPPPSLHACHPPPWLAPRQAAFQEQLASELWPRARPLHRIVCNMRTQFPDLRLIQYDCGKLQTLAVLLRQLKAEGHRVLIFTQMTRMLDVLEQFLTYHGHLYLRLDGSTRVEQRQALMERFNADKRIFCFILSTRSGGVGVNLTGADTVVFYDSDWNPTMDAQAQDRCHRIGQTRDVHIYRLISERTVEENILKKANQKRMLGDMAIEGGNFTTAYFKQQTIRELFDMPLEEPSSSSVPSAPEEEEETVASKQTHILEQALCRAEDEEDIRAATQAKAEQVAELAEFNENDGFPAGEGEEAGRPGAEDEEMSRAEQEIAALVEQLTPIERYAMKFLEASLEEVSREELKQAEEQVEAARKDLDQAKEEVFRLPQEEEEGPGAGDESSCGTGGGTHRRSKKAKAPERPGTRVSERLRGARAETQGANHTPVISAHQTRSTTTPPRCSPARERVPRPAPRPRPTPASAPAAIPALVPVPVSAPVPISAPNPITILPVHILPSPPPPSQIPPCSSPACTPPPACTPPPAHTPPPAQTCLVTPSSPLLLGPPSVPISASVTNLPLGLRPEAELCAQALASPESLELASVASSETSSLSLVPPKDLLPVAVEILPVSEKNLSLTPSAPSLTLEAGSIPNGQEQEAPDSAEGTTLTVLPEGEELPLCVSESNGLELPPSAASDEPLQEPLEADRTSEELTEAKTPTSSPEKPQELVTAEVAAPSTSSSATSSPEGPSPARPPRRRTSADVEIRGQGTGRPGQPPGPKVLRKLPGRLVTVVEEKELVRRRRQQRGAASTLVPGVSETSASPGSPSVRSMSGPESSPPIGGPCEAAPSSSLPTPPQQPFIARRHIELGVTGGGSPENGDGALLAITPPAVKRRRGRPPKKNRSPADAGRGVDEAPSSTLKGKTNGADPVPGPETLIVADPVLEPQLIPGPQPLGPQPVHRPNPLLSPVEKRRRGRPPKARDLPIPGTISSAGDGNSESRTQPPPHPSPLTPLPPLLVCPTATVANTVTTVTISTSPPKRKRGRPPKNPPSPRPSQLPVLDRDSTSVLESCGLGRRRQPQGQGESEGSSSDEDGSRPLTRLARLRLEAEGMRGRKSGGSMVVAVIQDDLDLADSGPGGLELTPPVVSLTPKLRSTRLRPGSLVPPLETEKLPRKRAGAPVGGSPGLAKRGRLQPPSPLGPEGSVEESEAEASGEEEEGDGTPRRRPGPRRLVGTTNQGDQRILRSSAPPSLAGPAVSHRGRKAKT

SEQ ID NO: 80139 - protein, 2971 aa, Homo sapiens [sequence omitted]

SEQ ID NO: 80140 - protein, 100 aa, Homo sapiens
  Payload ID: 15976
  Gene Symbol: SRCAP
  Gene Name: Snf2-related CREBBP activator protein
  ENSP ID: ENSP00000405186
MQSSPSPAHPQLPVLQTQMVSDGMTGSNPVSPASSSSPASSGAGGISPQHIAQDSSLDGPPGPPDGATVPLEGFSLSQAADLANKGPKWEKSHAEIAEQA

SEQ ID NO: 80141 - protein, 1610 aa, Homo sapiens
  Payload ID: 15976
  Gene Symbol: SRCAP
  Gene Name: Snf2-related CREBBP activator protein
  ENSP ID: ENSP00000483329
  MOD_RES (1)..(1): Any amino acid
XTIEVEEQQEGNDAEAQRREIELLRREGELPLEELLRSLPPQLLEGPSSPSQTPSSHDSDTRDGPEEGAEEEPPQVLEIKPPPSAVTQRNKQPWHPDEDDEEFTANEEEAEDEEDTIAAEEQLEGEVDHAMELSELAREGELSMEELLQQYAGAYAPGSGSSEDEDEDEVDANSSDCEPEGPVEAEEPPQEDSSSQSDSVEDRSEDEEDEHSEEEETSGSSASEESESEESEDAQSQSQADEEEEDDDFGVEYLLARDEEQSEADAGSGPPTPGPTTLGPKKEITDIAAAAESLQPKGYTLATTQVKTPIPLLLRGQLREYQHIGLDWLVTMYEKKLNGILADEMGLGKTIQTISLLAHLACEKGNWGPHLIIVPTSVMLNWEMELKRWCPSFKILTYYGAQKERKLKRQGWTKPNAFHVCITSYKLVLQDHQAFRRKNWRYLILDEAQNIKNFKSQRWQSLLNFNSQRRLLLTGTPLQNSLMELWSLMHFLMPHVFQSHREFKEWFSNPLTGMIEGSQEYNEGLVKRLHKVLRPFLLRRVKVDVEKQMPKKYEHVIRCRLSKRQRCLYDDFMAQTTTKETLATGHFMSVINILMQLRKVCNHPNLFDPRPVTSPFITPGICFSTASLVLRATDVHPLQRIDMGRFDLIGLEGRVSRYEADTFLPRHRLSRRVLLEVATAPDPPPRPKPVKMKVNRMLQPVPKQEGRTVVVVNNPRAPLGPVPVRPPPGPELSAQPTPGPVPQVLPASLMVSASPAGPPLIPASRPPGPVLLPPLQPNSGSLPQVLPSPLGVLSGTSRPPTPTLSLKPTPPAPVRLSPAPPPGSSSLLKPLTVPPGYTFPPAAATTTSTTTATATTTAVPAPTPAPQRLILSPDMQARLPSGEVVSIGQLASLAQRPVANAGGSKPLTFQIQGNKLTLTGAQVRQLAVGQPRPLQRNVVHLVSAGGQHHLISQPAHVALIQAVAPTPGPTPVSVLPSSTPSTTPAPTGLSLPLAANQVPPTMVNNTGVVKIVVRQAPRDGLTPVPPLAPAPRPPSSGLPAVLNPRPTLTPGRLPTPTLGTARAPMPTPTLVRPLLKLVHSPSPEVSASAPGAAPLTISSPLHVPSSLPGPASSPMPIPNSSPLASPVSSTVSVPLSSSLPISVPTTLPAPASAPLTIPISAPLTVSASGPALLTSVTPPLAPVVPAAPGPPSLAPSGASPSASALTLGLATAPSLSSSQTPGHPLLLAPTSSHVPGLNSTVAPACSPVLVPASALASPFPSAPNPAPAQASLLAPASSASQALATPLAPMAAPQTAILAPSPAPPLAPLPVLAPSPGAAPVLASSQTPVPVMAPSSTPGTSLASASPVPAPTPVLAPSSTQTMLPAPVPSPLPSPASTQTLALAPALAPTLGGSSPSQTLSLGTGNPQGPFPTQTLSLTPASSLVPTPAQTLSLAPGPPLGPTQTLSLAPAPPLAPASPVGPAPAHTLTLAPASSSASLLAPASVQTLTLSPAPVPTLGPAAAQTLALAPASTQSPASQASSLVVSASGAAPLPVTMVSRLPVSKDEPDTLTLRSGPPSPPSTATSFGGPRPRRQPPPPPRSPFYLVSFTSSRGNRKLSFFGVLVGWMEQ

SEQ ID NO: 80142 - protein, 257 aa, Homo sapiens
  Payload ID: 15977
  Gene Symbol: SNF8
  Gene Name: SNF8, ESCRT-II complex subunit
  Uniprot ID: Q96H20
  ENSP ID: ENSP00000290330
MHRRGVGAGAIAKKKLAEAKYKERGTVLAEDQLAQMSKQLDMFKTNLEEFASKHKQEIRKNPEFRVQFQDMCATIGVDPLASGKGFWSEMLGVGDFYYELGVQIIEVCLALKHRNGGLITLEELHQQVLKGRGKFAQDVSQDDLIRAIKKLKALGTGFGIIPVGGTYLIQSVPAELNMDHTVVLQLAENGYVTVSEIKASLKWETERARQVLEHLLKEGLAWLDLQAPGEAHYWLPALFTDLYSQEITAEEAREALP

SEQ ID NO: 80143 - protein, 258 aa, Homo sapiens
  Payload ID: 15977
  Gene Symbol: SNF8
  Gene Name: SNF8, ESCRT-II complex subunit
  Uniprot ID: Q96H20
  ENSP ID: ENSP00000421380
MHRRGVGAGAIAKKKLAEAKYKERGTVLAEDQLAQMSKQLDMFKTNLEEFASKHKQEIRKNPEFRVQFQDMCATIGVDPLASGKGFWSEMLGVGDFYYELGVQIIEVCLALKHRNGGLITLEELHQQVLKGRGKFAQDVSQDDLIRAIKKLKALGTGFGIIPVGGTYLIQSVPAELNMDHTVVLQLAEKNGYVTVSEIKASLKWETERARQVLEHLLKEGLAWLDLQAPGEAHYWLPALFTDLYSQEITAEEAREALP

SEQ ID NO: 80144 - protein, 167 aa, Homo sapiens
  Payload ID: 15977
  Gene Symbol: SNF8
  Gene Name: SNF8, ESCRT-II complex subunit
  ENSP ID: ENSP00000421390
MHRRGVGAGAIAKKKLAEAKYKERGTVLAEDQLAQMSKQLDMFKTNLEEFASKHKQEIRKNPEFRVQFQDMCATIGVDPLASGKGFWSEMLGVGDFYYELGVQIIEVCLALKHRNGGLITLEELHQQVLKGRGKFAQDVSQLERSGTISAHCNLRLLGSNDSSASAS

SEQ ID NO: 80145 - protein, 81 aa, Homo sapiens
  Payload ID: 15977
  Gene Symbol: SNF8
  Gene Name: SNF8, ESCRT-II complex subunit
  ENSP ID: ENSP00000421956
  MOD_RES (1)..(1): Any amino acid
XHRRGVGAGAIAKKKLAEAKYKERGTVLAEDQLAQMSKQLDMFKTNLEEFASKHKQEIRKNPEFRVQFQDMCATIGVDPLA

SEQ ID NO: 80146 - protein, 103 aa, Homo sapiens
  Payload ID: 15977
  Gene Symbol: SNF8
  Gene Name: SNF8, ESCRT-II complex subunit
  ENSP ID: ENSP00000422701
MHRRGVGAGAIAKKKLAEAKYKERGTVLAEDQLAQMSKQLDMFKTNLEEFASKHKQEIRKNPEFRVQFQDMCATIGVDPLASGVTLEKDFGLRCWAWGTSITN

SEQ ID NO: 80147 - protein, 141 aa, Homo sapiens
  Payload ID: 15977
  Gene Symbol: SNF8
  Gene Name: SNF8, ESCRT-II complex subunit
  ENSP ID: ENSP00000427328
MHRRGVGAGAIAKKKLAEAKYKERGTVLAEDQLAQMSKQLDMFKTNLEEFASKHKQEIRKNPEFRVQFQDMCATIGVDPLASGKGFWSEMLGVGDFYYELGVQIIEVCLALKHRNGGLITLEELHQQVLKGRGKFAQDVSQ

SEQ ID NO: 80148 - protein, 53 aa, Homo sapiens
  Payload ID: 15977
  Gene Symbol: SNF8
  Gene Name: SNF8, ESCRT-II complex subunit
  ENSP ID: ENSP00000460001
MHRRGVGAGAIAKKKLAEAKYKERGTVLAEDQLAQLEKDFGLRCWAWGTSITN

SEQ ID NO: 80149 - protein, 36 aa, Homo sapiens
  Payload ID: 15977
  Gene Symbol: SNF8
  Gene Name: SNF8, ESCRT-II complex subunit
  ENSP ID: ENSP00000460981
MHRRGVGAGAIAKKKLAEAKYKERGTVLAEDQLAQR

SEQ ID NO: 80150 - protein, 16 aa, Homo sapiens
  Payload ID: 15977
  Gene Symbol: SNF8
  Gene Name: SNF8, ESCRT-II complex subunit
  ENSP ID: ENSP00000467548
  MOD_RES (1)..(1): Any amino acid
XEVCLALKHRNGGEGG

SEQ ID NO: 80151 - protein, 71 aa, Homo sapiens
  Payload ID: 15978
  Gene Symbol: SNURF
  Gene Name: SNRPN upstream reading frame
  Uniprot ID: Q9Y675
  ENSP ID: ENSP00000342152
MERARDRLHLRRTTEQHVPEVEVQVKRRRTASLSNQECQLYPRRSQQQQVPVVDFQAELRQAFLAETPRGG

SEQ ID NO: 80152 - protein, 71 aa, Homo sapiens; identical to SEQ ID NO: 80151
  Payload ID: 15978
  Gene Symbol: SNURF
  Gene Name: SNRPN upstream reading frame
  Uniprot ID: Q9Y675
  ENSP ID: ENSP00000463201

SEQ ID NO: 80153 - protein, 71 aa, Homo sapiens; identical to SEQ ID NO: 80151
  Payload ID: 15978
  Gene Symbol: SNURF
  Gene Name: SNRPN upstream reading frame
  Uniprot ID: Q9Y675
  ENSP ID: ENSP00000463396

SEQ ID NO: 80154 - protein, 71 aa, Homo sapiens; identical to SEQ ID NO: 80151
  Payload ID: 15979
  Gene Symbol:
  Gene Name: SNRPN upstream reading frame protein  [Source:UniProtKB/Swiss-Prot
  Acc:Q9Y675]
  Uniprot ID: Q9Y675
  ENSP ID: ENSP00000451421

SEQ ID NO: 80155 - protein, 37 aa, Homo sapiens
  Payload ID: 15979
  Gene Symbol:
  Gene Name: SNRPN upstream reading frame protein  [Source:UniProtKB/Swiss-Prot
  Acc:Q9Y675]
  ENSP ID: ENSP00000451898
MERARDRLHLRRTTEQHVPEVEVQVKRRRTASLSNQE

SEQ ID NO: 80156 - protein, 128 aa, Homo sapiens
  Payload ID: 15980
  Gene Symbol: SNU13
  Gene Name: SNU13 homolog, small nuclear ribonucleoprotein (U4/U6.U5)
  Uniprot ID: P55769
  ENSP ID: ENSP00000215956
MTEADVNPKAYPLADAHLTKKLLDLVQQSCNYKQLRKGANEATKTLNRGISEFIVMAADAEPLEIILHLPLLCEDKNVPYVFVRSKQALGRACGVSRPVIACSVTIKEGSQLKQQIQSIQQSIERLLV

SEQ ID NO: 80157 - protein, 128 aa, Homo sapiens; identical to SEQ ID NO: 80156
  Payload ID: 15980
  Gene Symbol: SNU13
  Gene Name: SNU13 homolog, small nuclear ribonucleoprotein (U4/U6.U5)
  Uniprot ID: P55769
  ENSP ID: ENSP00000347401

SEQ ID NO: 80158 - protein, 128 aa, Homo sapiens; identical to SEQ ID NO: 80156
  Payload ID: 15980
  Gene Symbol: SNU13
  Gene Name: SNU13 homolog, small nuclear ribonucleoprotein (U4/U6.U5)
  Uniprot ID: P55769
  ENSP ID: ENSP00000383949

SEQ ID NO: 80159 - protein, 132 aa, Homo sapiens
  Payload ID: 15980
  Gene Symbol: SNU13
  Gene Name: SNU13 homolog, small nuclear ribonucleoprotein (U4/U6.U5)
  ENSP ID: ENSP00000383989
MLLVQTEADVNPKAYPLADAHLTKKLLDLVQQSCNYKQLRKGANEATKTLNRGISEFIVMAADAEPLEIILHLPLLCEDKNVPYVFVRSKQALGRACGVSRPVIACSVTIKEGSQLKQQIQSIQQSIERLLV

SEQ ID NO: 80160 - protein, 360 aa, Homo sapiens
  Payload ID: 15981
  Gene Symbol: SNUPN
  Gene Name: snurportin 1
  Uniprot ID: O95149
  ENSP ID: ENSP00000309831
MEELSQALASSFSVSQDLNSTAAPHPRLSQYKSKYSSLEQSERRRRLLELQKSKRLDYVNHARRLAEDDWTGMESEEENKKDDEEMDIDTVKKLPKHYANQLMLSEWLIDVPSDLGQEWIVVVCPVGKRALIVASRGSTSAYTKSGYCVNRFSSLLPGGNRRNSTAKDYTILDCIYNEVNQTYYVLDVMCWRGHPFYDCQTDFRFYWMHSKLPEEEGLGEKTKLNPFKFVGLKNFPCTPESLCDVLSMDFPFEVDGLLFYHKQTHYSPGSTPLVGWLRPYMVSDVLGVAVPAGPLTTKPDYAGHQLQQIMEHKKSQKEGMKEKLTHKASENGHYELEHLSTPKLKGSSHSPDHPGCLMEN

SEQ ID NO: 80161 - protein, 360 aa, Homo sapiens; identical to SEQ ID NO: 80160
  Payload ID: 15981
  Gene Symbol: SNUPN
  Gene Name: snurportin 1
  Uniprot ID: O95149
  ENSP ID: ENSP00000454852

SEQ ID NO: 80162 - protein, 2 aa, Homo sapiens
  Payload ID: 15981
  Gene Symbol: SNUPN
  Gene Name: snurportin 1
  ENSP ID: ENSP00000455649
ME

SEQ ID NO: 80163 - protein, 63 aa, Homo sapiens
  Payload ID: 15981
  Gene Symbol: SNUPN
  Gene Name: snurportin 1
  ENSP ID: ENSP00000455894
MEELSQALASSFSVSQDLNSTAAPHPRLSQYKSKYSSLEQSERRRRLLELQKSKRLDYVNHAR

SEQ ID NO: 80164 - protein, 360 aa, Homo sapiens; identical to SEQ ID NO: 80160
  Payload ID: 15981
  Gene Symbol: SNUPN
  Gene Name: snurportin 1
  Uniprot ID: O95149
  ENSP ID: ENSP00000456224

SEQ ID NO: 80165 - protein, 209 aa, Homo sapiens
  Payload ID: 15981
  Gene Symbol: SNUPN
  Gene Name: snurportin 1
  ENSP ID: ENSP00000456260
MEELSQALASSFSVSQDLNSTAAPHPRLSQYKSKYSSLEQSERRRRLLELQKSKRLDYVNHARRLAEDDWTGMESEEENKKDDEEMDIDTVKKLPKHYANQLMLSEWLIDVPSDLGQEWIVVVCPVGKRALIVASRGSTSAYTKSGYCVNRFSSLLPGGNRRNSTAKDYTILDCIYNEVNQTYYVLDVMCWRGHPFYDCQTDFRFYWMH

SEQ ID NO: 80166 - protein, 136 aa, Homo sapiens
  Payload ID: 15981
  Gene Symbol: SNUPN
  Gene Name: snurportin 1
  ENSP ID: ENSP00000456742
MEELSQALASSFSVSQDLNSTAAPHPRLSQYKSKYSSLEQSERRRRLLELQKSKRLDYVNHARRLAEDDWTGMESEEENKKDDEEMDIDTVKKLPKHYANQLMLSEWLIDVPSDLGQEWIVVVCPVGKRALIVASR

SEQ ID NO: 80167 - protein, 100 aa, Homo sapiens
  Payload ID: 15981
  Gene Symbol: SNUPN
  Gene Name: snurportin 1
  ENSP ID: ENSP00000457093
MEELSQALASSFSVSQDLNSTAAPHPRLSQYKSKYSSLEQSERRRRLLELQKSKRLDYVNHARRLAEDDWTGMESEEENKKDDEEMDIDTVKKLPKHYAN

SEQ ID NO: 80168 - protein, 200 aa, Homo sapiens
  Payload ID: 15981
  Gene Symbol: SNUPN
  Gene Name: snurportin 1
  ENSP ID: ENSP00000457562
RRLAEDDWTGMESEEENKKDDEEMDIDTVKKLPKHYANQLMLSEWLIDVPSDLGQEWIVVVCPVGKRALIVASRGSTSAYTKSGYCVNRFSSLLPGGNRRNSTAKDYTILDCIYNEVNQTYYVLDVMCWRGHPFYDCQTDFRFYWMHSKLPEEEGLGEKTKLNPFKFVGLKNFPCTPESLCDVLSMDFPFEVTKPLSLLP

SEQ ID NO: 80169 - protein, 360 aa, Homo sapiens; identical to SEQ ID NO: 80160
  Payload ID: 15981
  Gene Symbol: SNUPN
  Gene Name: snurportin 1
  Uniprot ID: O95149
  ENSP ID: ENSP00000458053

SEQ ID NO: 80170 - protein, 536 aa, Homo sapiens
  Payload ID: 15982
  Gene Symbol: SNW1
  Gene Name: SNW domain containing 1
  Uniprot ID: Q13573
  ENSP ID: ENSP00000261531
MALTSFLPAPTQLSQDQLEAEEKARSQRSRQTSLVSSRREPPPYGYRKGWIPRLLEDFGDGGAFPEIHVAQYPLDMGRKKKMSNALAIQVDSEGKIKYDAIARQGQSKDKVIYSKYTDLVPKEVMNADDPDLQRPDEEAIKEITEKTRVALEKSVSQKVAAAMPVRAADKLAPAQYIRYTPSQQGVAFNSGAKQRVIRMVEMQKDPMEPPRFKINKKIPRGPPSPPAPVMHSPSRKMTVKEQQEWKIPPCISNWKNAKGYTIPLDKRLAADGRGLQTVHINENFAKLAEALYIADRKAREAVEMRAQVERKMAQKEKEKHEEKLREMAQKARERRAGIKTHVEKEDGEARERDEIRHDRRKERQHDRNLSRAAPDKRSKLQRNENRDISEVIALGVPNPRTSNEVQYDQRLFNQSKGMDSGFAGGEDEIYNVYDQAWRGGKDMAQSIYRPSKNLDKDMYGDDLEARIKTNRFVPDKEFSGSDRRQRGREGPVQFEEDPFGLDKFLEEAKQHGGSKRPSDSSRPKEHEHEGKKRRKE

SEQ ID NO: 80171 - protein, 571 aa, Homo sapiens
  Payload ID: 15982
  Gene Symbol: SNW1
  Gene Name: SNW domain containing 1
  ENSP ID: ENSP00000451129
MALTSFLPAPTQLSQDQLEAEEKARSQRSRQTSLVSSRREPPPYGYRKGWIPRLLEDFGDGGAFPEIHVAQYPLDMGRKKKMSNALAIQVDSEGKIKYDAIARQGQSKDKVIYSKYTDLVPKEVMNADDPDLQRPDEEAIKEITEKTRVALEKSVSQKVAAAMPVRAADKLAPAQYIRYTPSQQGVAFNSGAKQRVIRMVEMQKDPMEPPRFKINKKIPRGPPSPPAPVMHSPSRKMTVKEQQEWKIPPCISNWKNAKGYTIPLDKRLAADGRGLQTVHINENFAKLAEALYIADRKAREAVEMRAQVERKMAQKEKEKHEEKLREMAQKARERRAGIKTHVEKEDGEARERDEIRHDRRKERQHDRNLSRAAPDKRSKLQRNENRDISEVIALGVPNPRTSNEVQYDQRLFNQSKGMDSGFAGGEDEIYNVYDQAWRGGKDMAQSIYRPSKNLDKDMYGDDLEARIKTNRCQAIQLNFSVYTGESKVVHSFFSFSLDLFPTRSFLVQTVDREAEKDQCSLRKILLVWTSFWKKPNSMVALKDPQIAAAPRNTSMKARRGGRNRHRSLQSE

SEQ ID NO: 80172 - protein, 47 aa, Homo sapiens
  Payload ID: 15982
  Gene Symbol: SNW1
  Gene Name: SNW domain containing 1
  ENSP ID: ENSP00000451741
MALTSYLRTSLRLKKRQDPRDHGRPHWSPPEENLPRTDTGKAGYLGY

SEQ ID NO: 80173 - protein, 374 aa, Homo sapiens
  Payload ID: 15982
  Gene Symbol: SNW1
  Gene Name: SNW domain containing 1
  ENSP ID: ENSP00000452059
MPVRAADKLAPAQYIRYTPSQQGVAFNSGAKQRVIRMVEMQKDPMEPPRFKINKKIPRGPPSPPAPVMHSPSRKMTVKEQQEWKIPPCISNWKNAKGYTIPLDKRLAADGRGLQTVHINENFAKLAEALYIADRKAREAVEMRAQVERKMAQKEKEKHEEKLREMAQKARERRAGIKTHVEKEDGEARERDEIRHDRRKERQHDRNLSRAAPDKRSKLQRNENRDISEVIALGVPNPRTSNEVQYDQRLFNQSKGMDSGFAGGEDEIYNVYDQAWRGGKDMAQSIYRPSKNLDKDMYGDDLEARIKTNRFVPDKEFSGSDRRQRGREGPVQFEEDPFGLDKFLEEAKQHGGSKRPSDSSRPKEHEHEGKKRRKE

SEQ ID NO: 80174 - protein, 185 aa, Homo sapiens
  Payload ID: 15982
  Gene Symbol: SNW1
  Gene Name: SNW domain containing 1
  ENSP ID: ENSP00000452473
MALTSFLPAPTQLSQDQLEAEEKARSQRSRQTSLVSSRREPPPYGYRKGWIPRLLEDFGDGGAFPEIHVAQYPLDMGRKKKMSNALAIQVDSEGKIKYDAIARQGQSKDKVIYSKYTDLVPKEVMNADDPDLQRPDEEAIKEMTVKEQQEWKIPPCISNWKNAKGYTIPLDKRLAADGRGLQTVH

SEQ ID NO: 80175 - protein, 688 aa, Homo sapiens
  Payload ID: 15983
  Gene Symbol: SCLT1
  Gene Name: sodium channel and clathrin linker 1
  Uniprot ID: Q96NL6
  ENSP ID: ENSP00000281142
MAAEIDFLREQNRRLNEDFRRYQMESFSKYSSVQKAVCQGEGDDTFENLVFDQSFLAPLVTEYDKHLGELNGQLKYYQKQVGEMKLQLENVIKENERLHSELKDAVEKKLEAFPLGTEVGTDIYADDETVRNLQEQLQLANQEKTQAVELWQTVSQELDRLHKLYQEHMTEAQIHVFESQKQKDQLFDFQQLTKQLHVTNENMEVTNQQFLKTVTEQSVIIEQLRKKLRQAKLELRVAVAKVEELTNVTEDLQGQMKKKEKDVVSAHGREEASDRRLQQLQSSIKQLEIRLCVTIQEANQLRTENTHLEKQTRELQAKCNELENERYEAIVRARNSMQLLEEANLQKSQALLEEKQKEEDIEKMKETVSRFVQDATIRTKKEVANTKKQCNIQISRLTEELSALQMECAEKQGQIERVIKEKKAVEEELEKIYREGRGNESDYRKLEEMHQRFLVSERSKDDLQLRLTRAENRIKQLETDSSEEISRYQEMIQKLQNVLESERENCGLVSEQRLKLQQENKQLRKETESLRKIALEAQKKAKVKISTMEHEFSIKERGFEVQLREMEDSNRNSIVELRHLLATQQKAANRWKEETKKLTESAEIRINNLKSELSRQKLHTQELLSQLEMANEKVAENEKLILEHQEKANRLQRRLSQAEERAASASQQLSVITVQRRKAASLMNLENI

SEQ ID NO: 80176 - protein, 175 aa, Homo sapiens
  Payload ID: 15983
  Gene Symbol: SCLT1
  Gene Name: sodium channel and clathrin linker 1
  Uniprot ID: Q96NL6
  ENSP ID: ENSP00000395292
MAAEIDFLREQNRRLNEDFRRYQMESFSKYSSVQKAVCQGEGDDTFENLVFDQSFLAPLVTEYDKHLGELNGQLKYYQKQVGEMKLQLENVIKENERSELSRQKLHTQELLSQLEMANEKVAENEKLILEHQEKANRLQRRLSQAEERAASASQQLSVITVQRRKAASLMNLENI

SEQ ID NO: 80177 - protein, 79 aa, Homo sapiens
  Payload ID: 15983
  Gene Symbol: SCLT1
  Gene Name: sodium channel and clathrin linker 1
  Uniprot ID: Q96NL6
  ENSP ID: ENSP00000420861
MAAEIDFLREQNRRLNEDFRRYQMESFSKYSSVQKAVCQGEGDDTFENLVFDQSFLAPLVTEYDKHLGELNGQLKYYQA

SEQ ID NO: 80178 - protein, 284 aa, Homo sapiens
  Payload ID: 15983
  Gene Symbol: SCLT1
  Gene Name: sodium channel and clathrin linker 1
  ENSP ID: ENSP00000424029
MESFSKYSSVQKAVCQGEGDDTFENLVFDQSFLAPLVTEYDKHLGELNGQLKYYQKQVGEMKLQLENVIKENERLHSELKDAVEKKLEAFPLGTEVGTDIYADDETVRNLQEQLQLANQEKTQAVELWQTVSQELDRLHKLYQEHMTEAQIHVFESQKQKDQLFDFQQLTKQLHVTNENMEVTNQQFLKTVTEQSVIIEQLRKKLRSELSRQKLHTQELLSQLEMANEKVAENEKLILEHQEKANRLQRRLSQAEERAASASQQLSVITVQRRKAASLMNLENI

SEQ ID NO: 80179 - protein, 131 aa, Homo sapiens
  Payload ID: 15983
  Gene Symbol: SCLT1
  Gene Name: sodium channel and clathrin linker 1
  ENSP ID: ENSP00000424304
MAAEIDFLREQNRRLNEDFRRYQMESFSKYSSVQKAVCQGEGDDTFENLVFDQSFLAPLVTEYDKHLGELNGQLKYYQKQVGEMKLQLENVIKENERVLLCLPGWSAVVRSRLTASSASRIRAILLPQPPQ

SEQ ID NO: 80180 - protein, 56 aa, Homo sapiens
  Payload ID: 15983
  Gene Symbol: SCLT1
  Gene Name: sodium channel and clathrin linker 1
  ENSP ID: ENSP00000425315
MESFSKYSSVQKAVCQGEGDDTFENLVFDQSFLAPLVTEYDKHLGELNGQLKYYQA

SEQ ID NO: 80181 - protein, 195 aa, Homo sapiens
  Payload ID: 15984
  Gene Symbol: SCNM1
  Gene Name: sodium channel modifier 1
  Uniprot ID: Q9BWG6
  ENSP ID: ENSP00000357898
MLRDGRFACAICPHRPVLDTLAMLTAHRAGKKHLSSLQLFYGKKQPGKERKQNPKHQNELRREETKAEAPLLTQTRLITQSALHRAPHYNSCCRRKYRPEAPGPSVSLSPMPPSEVKLQSGKISREPEPAAGPQAEESATVSAPAPMSPTRRRALDHYLTLRSSGWIPDGRGRWVKDENVEFDSDEEEPPDLPLD

SEQ ID NO: 80182 - protein, 230 aa, Homo sapiens
  Payload ID: 15984
  Gene Symbol: SCNM1
  Gene Name: sodium channel modifier 1
  Uniprot ID: Q9BWG6
  ENSP ID: ENSP00000357901
MSFKREGDDWSQLNVLKKRRVGDLLASYIPEDEALMLRDGRFACAICPHRPVLDTLAMLTAHRAGKKHLSSLQLFYGKKQPGKERKQNPKHQNELRREETKAEAPLLTQTRLITQSALHRAPHYNSCCRRKYRPEAPGPSVSLSPMPPSEVKLQSGKISREPEPAAGPQAEESATVSAPAPMSPTRRRALDHYLTLRSSGWIPDGRGRWVKDENVEFDSDEEEPPDLPLD

SEQ ID NO: 80183 - protein, 195 aa, Homo sapiens; identical to SEQ ID NO: 80181
  Payload ID: 15984
  Gene Symbol: SCNM1
  Gene Name: sodium channel modifier 1
  Uniprot ID: Q9BWG6
  ENSP ID: ENSP00000473282

SEQ ID NO: 80184 - protein, 669 aa, Homo sapiens
  Payload ID: 15985
  Gene Symbol: SCNN1A
  Gene Name: sodium channel, non voltage gated 1 alpha subunit
  Uniprot ID: P37088
  ENSP ID: ENSP00000228916
MEGNKLEEQDSSPPQSTPGLMKGNKREEQGLGPEPAAPQQPTAEEEALIEFHRSYRELFEFFCNNTTIHGAIRLVCSQHNRMKTAFWAVLWLCTFGMMYWQFGLLFGEYFSYPVSLNINLNSDKLVFPAVTICTLNPYRYPEIKEELEELDRITEQTLFDLYKYSSFTTLVAGSRSRRDLRGTLPHPLQRLRVPPPPHGARRARSVASSLRDNNPQVDWKDWKIGFQLCNQNKSDCFYQTYSSGVDAVREWYRFHYINILSRLPETLPSLEEDTLGNFIFACRFNQVSCNQANYSHFHHPMYGNCYTFNDKNNSNLWMSSMPGINNGLSLMLRAEQNDFIPLLSTVTGARVMVHGQDEPAFMDDGGFNLRPGVETSISMRKETLDRLGGDYGDCTKNGSDVPVENLYPSKYTQQVCIHSCFQESMIKECGCAYIFYPRPQNVEYCDYRKHSSWGYCYYKLQVDFSSDHLGCFTKCRKPCSVTSYQLSAGYSRWPSVTSQEWVFQMLSRQNNYTVNNKRNGVAKVNIFFKELNYKTNSESPSVTMVTLLSNLGSQWSLWFGSSVLSVVEMAELVFDLLVIMFLMLLRRFRSRYWSPGRGGRGAQEVASTLASSPPSHFCPHPMSLSLSQPGPAPSPALTAPPPAYATLGPRPSPGGSAGASSSTCPLGGP

SEQ ID NO: 80185 - protein, 245 aa, Homo sapiens
  Payload ID: 15985
  Gene Symbol: SCNN1A
  Gene Name: sodium channel, non voltage gated 1 alpha subunit
  ENSP ID: ENSP00000345028
MEGNKLEEQDSSPPQSTPGLMKGNKREEQGLGPEPAAPQQPTAEEEALIEFHRSYRELFEFFCNNTTIHGAIRLVCSQHNRMKTAFWAVLWLCTFGMMYWQFGLLFGEYFSYPVSLNINLNSDKLVFPAVTICTLNPYRYPEIKEELEELDRITEQTLFDLYKYSSFTTLVAGSRSRRDLRGTLPHPLQRLRVPPPPHGARRARSVASSLRDNNPQVDWKDWKIGFQLELLSLPPPDVWKLLYFQ

SEQ ID NO: 80186 - protein, 728 aa, Homo sapiens
  Payload ID: 15985
  Gene Symbol: SCNN1A
  Gene Name: sodium channel, non voltage gated 1 alpha subunit
  Uniprot ID: P37088
  ENSP ID: ENSP00000353292
MGMARGSLTRVPGVMGEGTQGPELSLDPDPCSPQSTPGLMKGNKLEEQDPRPLQPIPGLMEGNKLEEQDSSPPQSTPGLMKGNKREEQGLGPEPAAPQQPTAEEEALIEFHRSYRELFEFFCNNTTIHGAIRLVCSQHNRMKTAFWAVLWLCTFGMMYWQFGLLFGEYFSYPVSLNINLNSDKLVFPAVTICTLNPYRYPEIKEELEELDRITEQTLFDLYKYSSFTTLVAGSRSRRDLRGTLPHPLQRLRVPPPPHGARRARSVASSLRDNNPQVDWKDWKIGFQLCNQNKSDCFYQTYSSGVDAVREWYRFHYINILSRLPETLPSLEEDTLGNFIFACRFNQVSCNQANYSHFHHPMYGNCYTFNDKNNSNLWMSSMPGINNGLSLMLRAEQNDFIPLLSTVTGARVMVHGQDEPAFMDDGGFNLRPGVETSISMRKETLDRLGGDYGDCTKNGSDVPVENLYPSKYTQQVCIHSCFQESMIKECGCAYIFYPRPQNVEYCDYRKHSSWGYCYYKLQVDFSSDHLGCFTKCRKPCSVTSYQLSAGYSRWPSVTSQEWVFQMLSRQNNYTVNNKRNGVAKVNIFFKELNYKTNSESPSVTMVTLLSNLGSQWSLWFGSSVLSVVEMAELVFDLLVIMFLMLLRRFRSRYWSPGRGGRGAQEVASTLASSPPSHFCPHPMSLSLSQPGPAPSPALTAPPPAYATLGPRPSPGGSAGASSSTCPLGGP

SEQ ID NO: 80187 - protein, 511 aa, Homo sapiens
  Payload ID: 15985
  Gene Symbol: SCNN1A
  Gene Name: sodium channel, non voltage gated 1 alpha subunit
  ENSP ID: ENSP00000380166
MEGNKLEEQDSSPPQSTPGLMKGNKREEQGLGPEPAAPQQPTAEEEALIEFHRSYRELFEFFCNNTTIHGAIRLVCSQHNRMKTAFWAVLWLCTFGMMYWQFGLLFGEYFSYPVSLNINLNSDKLVFPAVTICTLNPYRYPEIKEELEELDRITEQTLFDLYKYSSFTTLVAGSRSRRDLRGTLPHPLQRLRVPPPPHGARRARSVASSLRDNNPQVDWKDWKIGFQLCNQNKSDCFYQTYSSGVDAVREWYRFHYINILSRLPETLPSLEEDTLGNFIFACRFNQVSCNQANYSHFHHPMYGNCYTFNDKNNSNLWMSSMPGINNGLSLMLRAEQNDFIPLLSTVTGARVMVHGQDEPAFMDDGGFNLRPGVETSISMRKETLDRLGGDYGDCTKNGSDVPVENLYPSKYTQQVCIHSCFQESMIKECGCAYIFYPRPQNVEYCDYRKHSSWGYCYYKLQVDFSSDHLGCFTKCRKPCRNGSSRCYRDRTITPSTTREMEWPKSTSSSRS

SEQ ID NO: 80188 - protein, 692 aa, Homo sapiens
  Payload ID: 15985
  Gene Symbol: SCNN1A
  Gene Name: sodium channel, non voltage gated 1 alpha subunit
  Uniprot ID: P37088
  ENSP ID: ENSP00000438739
MSSIKGNKLEEQDPRPLQPIPGLMEGNKLEEQDSSPPQSTPGLMKGNKREEQGLGPEPAAPQQPTAEEEALIEFHRSYRELFEFFCNNTTIHGAIRLVCSQHNRMKTAFWAVLWLCTFGMMYWQFGLLFGEYFSYPVSLNINLNSDKLVFPAVTICTLNPYRYPEIKEELEELDRITEQTLFDLYKYSSFTTLVAGSRSRRDLRGTLPHPLQRLRVPPPPHGARRARSVASSLRDNNPQVDWKDWKIGFQLCNQNKSDCFYQTYSSGVDAVREWYRFHYINILSRLPETLPSLEEDTLGNFIFACRFNQVSCNQANYSHFHHPMYGNCYTFNDKNNSNLWMSSMPGINNGLSLMLRAEQNDFIPLLSTVTGARVMVHGQDEPAFMDDGGFNLRPGVETSISMRKETLDRLGGDYGDCTKNGSDVPVENLYPSKYTQQVCIHSCFQESMIKECGCAYIFYPRPQNVEYCDYRKHSSWGYCYYKLQVDFSSDHLGCFTKCRKPCSVTSYQLSAGYSRWPSVTSQEWVFQMLSRQNNYTVNNKRNGVAKVNIFFKELNYKTNSESPSVTMVTLLSNLGSQWSLWFGSSVLSVVEMAELVFDLLVIMFLMLLRRFRSRYWSPGRGGRGAQEVASTLASSPPSHFCPHPMSLSLSQPGPAPSPALTAPPPAYATLGPRPSPGGSAGASSSTCPLGGP

SEQ ID NO: 80189 - protein, 369 aa, Homo sapiens
  Payload ID: 15985
  Gene Symbol: SCNN1A
  Gene Name: sodium channel, non voltage gated 1 alpha subunit
  ENSP ID: ENSP00000440876
MYGNCYTFNDKNNSNLWMSSMPGINNGLSLMLRAEQNDFIPLLSTVTGARVMVHGQDEPAFMDDGGFNLRPGVETSISMRKETLDRLGGDYGDCTKNGSDVPVENLYPSKYTQQVCIHSCFQESMIKECGCAYIFYPRPQNVEYCDYRKHSSWGYCYYKLQVDFSSDHLGCFTKCRKPCSVTSYQLSAGYSRWPSVTSQEWVFQMLSRQNNYTVNNKRNGVAKVNIFFKELNYKTNSESPSVTMVTLLSNLGSQWSLWFGSSVLSVVEMAELVFDLLVIMFLMLLRRFRSRYWSPGRGGRGAQEVASTLASSPPSHFCPHPMSLSLSQPGPAPSPALTAPPPAYATLGPRPSPGGSAGASSSTCPLGGP

SEQ ID NO: 80190 - protein, 159 aa, Homo sapiens
  Payload ID: 15985
  Gene Symbol: SCNN1A
  Gene Name: sodium channel, non voltage gated 1 alpha subunit
  ENSP ID: ENSP00000443434
MPNGNKLEEQDPRPLQPIPGLMEGNKLEEQDSSPPQSTPGLMKGNKREEQGLGPEPAAPQQPTAEEEALIEFHRSYRELFEFFCNNTTIHGAIRLVCSQHNRMKTAFWAVLWLCTFGMMYWQFGLLFGEYFSYPVSLNINLNSDKLVFPAVTICTLNPY

SEQ ID NO: 80191 - protein, 685 aa, Homo sapiens
  Payload ID: 15986
  Gene Symbol: SCNN1B
  Gene Name: sodium channel, non voltage gated 1 beta subunit
  Uniprot ID: P51168
  ENSP ID: ENSP00000302874
MLLHINPAYLFKLLHGFPPWIMPTDGNLGDKNFQMGKPGHREGATMHVKKYLLKGLHRLQKGPGYTYKELLVWYCDNTNTHGPKRIICEGPKKKAMWFLLTLLFAALVCWQWGIFIRTYLSWEVSVSLSVGFKTMDFPAVTICNASPFKYSKIKHLLKDLDELMEAVLERILAPELSHANATRNLNFSIWNHTPLVLIDERNPHHPMVLDLFGDNHNGLTSSSASEKICNAHGCKMAMRLCSLNRTQCTFRNFTSATQALTEWYILQATNIFAQVPQQELVEMSYPGEQMILACLFGAEPCNYRNFTSIFYPHYGNCYIFNWGMTEKALPSANPGTEFGLKLILDIGQEDYVPFLASTAGVRLMLHEQRSYPFIRDEGIYAMSGTETSIGVLVDKLQRMGEPYSPCTVNGSEVPVQNFYSDYNTTYSIQACLRSCFQDHMIRNCNCGHYLYPLPRGEKYCNNRDFPDWAHCYSDLQMSVAQRETCIGMCKESCNDTQYKMTISMADWPSEASEDWIFHVLSQERDQSTNITLSRKGIVKLNIYFQEFNYRTIEESAANNIVWLLSNLGGQFGFWMGGSVLCLIEFGEIIIDFVWITIIKLVALAKSLRQRRAQASYAGPPPTVAELVEAHTNFGFQPDTAPRSPNTGPYPSEQALPIPGTPPPNYDSLRLQPLDVIESDSEGDAI

SEQ ID NO: 80192 - protein, 640 aa, Homo sapiens
  Payload ID: 15986
  Gene Symbol: SCNN1B
  Gene Name: sodium channel, non voltage gated 1 beta subunit
  Uniprot ID: P51168
  ENSP ID: ENSP00000345751
MHVKKYLLKGLHRLQKGPGYTYKELLVWYCDNTNTHGPKRIICEGPKKKAMWFLLTLLFAALVCWQWGIFIRTYLSWEVSVSLSVGFKTMDFPAVTICNASPFKYSKIKHLLKDLDELMEAVLERILAPELSHANATRNLNFSIWNHTPLVLIDERNPHHPMVLDLFGDNHNGLTSSSASEKICNAHGCKMAMRLCSLNRTQCTFRNFTSATQALTEWYILQATNIFAQVPQQELVEMSYPGEQMILACLFGAEPCNYRNFTSIFYPHYGNCYIFNWGMTEKALPSANPGTEFGLKLILDIGQEDYVPFLASTAGVRLMLHEQRSYPFIRDEGIYAMSGTETSIGVLVDKLQRMGEPYSPCTVNGSEVPVQNFYSDYNTTYSIQACLRSCFQDHMIRNCNCGHYLYPLPRGEKYCNNRDFPDWAHCYSDLQMSVAQRETCIGMCKESCNDTQYKMTISMADWPSEASEDWIFHVLSQERDQSTNITLSRKGIVKLNIYFQEFNYRTIEESAANNIVWLLSNLGGQFGFWMGGSVLCLIEFGEIIIDFVWITIIKLVALAKSLRQRRAQASYAGPPPTVAELVEAHTNFGFQPDTAPRSPNTGPYPSEQALPIPGTPPPNYDSLRLQPLDVIESDSEGDAI

SEQ ID NO: 80193 - protein, 604 aa, Homo sapiens
  Payload ID: 15986
  Gene Symbol: SCNN1B
  Gene Name: sodium channel, non voltage gated 1 beta subunit
  ENSP ID: ENSP00000455673
MHVKKYLLKGLHRLQKGPGYTYKELLVWYCDNTNTHGPKRIICEGPKKKAMWFLLTLLFAALVCWQWGIFIRTYLSWEVSVSLSVGFKTMDFPAVTICNASPFKYSKIKHLLKDLDELMEAVLERILAPELSHANATRNLNFSIWNHTPLVLIDERNPHHPMVLDLFGDNHNGLTSSSASEKICNAHGCKMAMRLCSLNRTQCTFRNFTSATQALTEWYILQATNIFAQVPQQELVEMSYPGEQMILACLFGAEPCNYRNFTSIFYPHYGNCYIFNWGMTEKALPSANPGTEFGLKLILDIGQEDYVPFLASTAGVRLMLHEQRSYPFIRDEGIYAMSGTETSIGVLVACLRSCFQDHMIRNCNCGHYLYPLPRGEKYCNNRDFPDWAHCYSDLQMSVAQRETCIGMCKESCNDTQYKMTISMADWPSEASEDWIFHVLSQERDQSTNITLSRKGIVKLNIYFQEFNYRTIEESAANNIVWLLSNLGGQFGFWMGGSVLCLIEFGEIIIDFVWITIIKLVALAKSLRQRRAQASYAGPPPTVAELVEAHTNFGFQPDTAPRSPNTGPYPSEQALPIPGTPPPNYDSLRLQPLDVIESDSEGDAI

SEQ ID NO: 80194 - protein, 613 aa, Homo sapiens
  Payload ID: 15986
  Gene Symbol: SCNN1B
  Gene Name: sodium channel, non voltage gated 1 beta subunit
  ENSP ID: ENSP00000456309
MHVKKYLLKGLHRLQKGPGYTYKELLVWYCDNTNTHGPKRIICEGPKKKAMWFLLTLLFAALVCWQWGIFIRTYLSWEVSVSLSVGFKTMDFPAVTICNASPFKYSKIKHLLKDLDELMEAVLERILAPELSHANATRNLNFSIWNHTPLVLIDERNPHHPMVLDLFGDNHNGLTSSSASEKICNAHGCKMAMRLATNIFAQVPQQELVEMSYPGEQMILACLFGAEPCNYRNFTSIFYPHYGNCYIFNWGMTEKALPSANPGTEFGLKLILDIGQEDYVPFLASTAGVRLMLHEQRSYPFIRDEGIYAMSGTETSIGVLVDKLQRMGEPYSPCTVNGSEVPVQNFYSDYNTTYSIQACLRSCFQDHMIRNCNCGHYLYPLPRGEKYCNNRDFPDWAHCYSDLQMSVAQRETCIGMCKESCNDTQYKMTISMADWPSEASEDWIFHVLSQERDQSTNITLSRKGIVKLNIYFQEFNYRTIEESAANNIVWLLSNLGGQFGFWMGGSVLCLIEFGEIIIDFVWITIIKLVALAKSLRQRRAQASYAGPPPTVAELVEAHTNFGFQPDTAPRSPNTGPYPSEQALPIPGTPPPNYDSLRLQPLDVIESDSEGDAI

SEQ ID NO: 80195 - protein, 296 aa, Homo sapiens
  Payload ID: 15986
  Gene Symbol: SCNN1B
  Gene Name: sodium channel, non voltage gated 1 beta subunit
  ENSP ID: ENSP00000457754
MHVKKYLLKGLHRLQKGPGYTYKELLVWYCDNTNTHGPKRIICEGPKKKAMWFLLTLLFAALVCWQWGIFIRTYLSWEVSVSLSVGFKTMDFPAVTICNASPFKYSKIKHLLKDLDELMEAVLERILAPELSHANATRNLNFSIWNHTPLVLIDERNPHHPMVLDLFGDNHNGLTSSSASEKICNAHGCKMAMRLCSLNRTQCTFRNFTSATQALTEWYILQATNIFAQVPQQELVEMSYPGEQMILACLFGAEPCNYRPEVDPGHRPGRLRPLPCVHGRGQADASRAEVIPLHQR

SEQ ID NO: 80196 - protein, 188 aa, Homo sapiens
  Payload ID: 15986
  Gene Symbol: SCNN1B
  Gene Name: sodium channel, non voltage gated 1 beta subunit
  ENSP ID: ENSP00000482681
  MOD_RES (1)..(1): Any amino acid
XVEMSYPGEQMILACLFGAEPCNYRNFTSIFYPHYGNCYIFNWGMTEKALPSANPGTEFGLKLILDIGQEDYVPFLASTAGVRLMLHEQRSYPFIRDEGIYAMSGTETSIGVLVDKLQRMGEPYSPCTVNGSEVPVQNFYSDYNTTYSIQVGRWCTPHAPGPLSGFMGPRPQYSGRAGPSKSGSAGPL

SEQ ID NO: 80197 - protein, 704 aa, Homo sapiens
  Payload ID: 15987
  Gene Symbol: SCNN1D
  Gene Name: sodium channel, non voltage gated 1 delta subunit
  Uniprot ID: P51172
  ENSP ID: ENSP00000321594
MAFLSRTSPVAAASFQSRQEARGSILLQSCQLPPQWLSTEAWTGEWKQPHGGALTSRSPGPVAPQRPCHLKGWQHRPTQHNAACKQGQAAAQTPPRPGPPSAPPPPPKEGHQEGLVELPASFRELLTFFCTNATIHGAIRLVCSRGNRLKTTSWGLLSLGALVALCWQLGLLFERHWHRPVLMAVSVHSERKLLPLVTLCDGNPRRPSPVLRHLELLDEFARENIDSLYNVNLSKGRAALSATVPRHEPPFHLDREIRLQRLSHSGSRVRVGFRLCNSTGGDCFYRGYTSGVAAVQDWYHFHYVDILALLPAAWEDSHGSQDGHFVLSCSYDGLDCQARQFRTFHHPTYGSCYTVDGVWTAQRPGITHGVGLVLRVEQQPHLPLLSTLAGIRVMVHGRNHTPFLGHHSFSVRPGTEATISIREDEVHRLGSPYGHCTAGGEGVEVELLHNTSYTRQACLVSCFQQLMVETCSCGYYLHPLPAGAEYCSSARHPAWGHCFYRLYQDLETHRLPCTSRCPRPCRESAFKLSTGTSRWPSAKSAGWTLATLGEQGLPHQSHRQRSSLAKINIVYQELNYRSVEEAPVYSVPQLLSAMGSLCSLWFGASVLSLLELLELLLDASALTLVLGGRRLRRAWFSWPRASPASGASSIKPEASQMPPPAGGTSDDPEPSGPHLPRVMLPGVLAGVSAEESWAGPQPLETLDT

SEQ ID NO: 80198 - protein, 638 aa, Homo sapiens
  Payload ID: 15987
  Gene Symbol: SCNN1D
  Gene Name: sodium channel, non voltage gated 1 delta subunit
  Uniprot ID: P51172
  ENSP ID: ENSP00000339504
MAEHRSMDGRMEAATRGGSHLQAAAQTPPRPGPPSAPPPPPKEGHQEGLVELPASFRELLTFFCTNATIHGAIRLVCSRGNRLKTTSWGLLSLGALVALCWQLGLLFERHWHRPVLMAVSVHSERKLLPLVTLCDGNPRRPSPVLRHLELLDEFARENIDSLYNVNLSKGRAALSATVPRHEPPFHLDREIRLQRLSHSGSRVRVGFRLCNSTGGDCFYRGYTSGVAAVQDWYHFHYVDILALLPAAWEDSHGSQDGHFVLSCSYDGLDCQARQFRTFHHPTYGSCYTVDGVWTAQRPGITHGVGLVLRVEQQPHLPLLSTLAGIRVMVHGRNHTPFLGHHSFSVRPGTEATISIREDEVHRLGSPYGHCTAGGEGVEVELLHNTSYTRQACLVSCFQQLMVETCSCGYYLHPLPAGAEYCSSARHPAWGHCFYRLYQDLETHRLPCTSRCPRPCRESAFKLSTGTSRWPSAKSAGWTLATLGEQGLPHQSHRQRSSLAKINIVYQELNYRSVEEAPVYSVPQLLSAMGSLCSLWFGASVLSLLELLELLLDASALTLVLGGRRLRRAWFSWPRASPASGASSIKPEASQMPPPAGGTSDDPEPSGPHLPRVMLPGVLAGVSAEESWAGPQPLETLDT

SEQ ID NO: 80199 - protein, 308 aa, Homo sapiens
  Payload ID: 15987
  Gene Symbol: SCNN1D
  Gene Name: sodium channel, non voltage gated 1 delta subunit
  ENSP ID: ENSP00000368393
  MOD_RES (1)..(1): Any amino acid
XATARAATAFTEATRQAWRLSRTGTTSTMWISWPCCPRHGRTATGARTATSSSPAVTMAWTARPDSSGPSTTPPTAAATRSMASGQLSAPASPTVGASPWPVRGQGCRSGGLTPALGLPGVGLVLRVEQQPHLPLLSTLAGIRVMVHGRNHTPFLGHHSFSVRPGTEATISIREDEVHRLGSPYGHCTAGGEGVEVELLHNTSYTRQACLVSCFQQLMVETCSCGYYLHPLPAGAEYCSSARHPAWGHCFYRLYQDLETHRLPCTSRCPRPCRESAFKLSTGTSRWPSAKSAGWTLATLGEQGLPHQS

SEQ ID NO: 80200 - protein, 802 aa, Homo sapiens
  Payload ID: 15987
  Gene Symbol: SCNN1D
  Gene Name: sodium channel, non voltage gated 1 delta subunit
  ENSP ID: ENSP00000368411
MRAVLSQKTTPLPRYLWPGHLSGPRRLTWSWCSDHRTPTCRELGSPHPTPCTGPARGWPRRGGGPCGFTSAGHVLCGYPLCLLSGPIQGCGTGLGDSSMAFLSRTSPVAAASFQSRQEARGSILLQSCQLPPQWLSTEAWTGEWKQPHGGALTSRSPGPVAPQRPCHLKGWQHRPTQHNAACKQGQAAAQTPPRPGPPSAPPPPPKEGHQEGLVELPASFRELLTFFCTNATIHGAIRLVCSRGNRLKTTSWGLLSLGALVALCWQLGLLFERHWHRPVLMAVSVHSERKLLPLVTLCDGNPRRPSPVLRHLELLDEFARENIDSLYNVNLSKGRAALSATVPRHEPPFHLDREIRLQRLSHSGSRVRVGFRLCNSTGGDCFYRGYTSGVAAVQDWYHFHYVDILALLPAAWEDSHGSQDGHFVLSCSYDGLDCQARQFRTFHHPTYGSCYTVDGVWTAQRPGITHGVGLVLRVEQQPHLPLLSTLAGIRVMVHGRNHTPFLGHHSFSVRPGTEATISIREDEVHRLGSPYGHCTAGGEGVEVELLHNTSYTRQACLVSCFQQLMVETCSCGYYLHPLPAGAEYCSSARHPAWGHCFYRLYQDLETHRLPCTSRCPRPCRESAFKLSTGTSRWPSAKSAGWTLATLGEQGLPHQSHRQRSSLAKINIVYQELNYRSVEEAPVYSVPQLLSAMGSLCSLWFGASVLSLLELLELLLDASALTLVLGGRRLRRAWFSWPRASPASGASSIKPEASQMPPPAGGTSDDPEPSGPHLPRVMLPGVLAGVSAEESWAGPQPLETLDT

SEQ ID NO: 80201 - protein, 638 aa, Homo sapiens; identical to SEQ ID NO: 80198
  Payload ID: 15987
  Gene Symbol: SCNN1D
  Gene Name: sodium channel, non voltage gated 1 delta subunit
  Uniprot ID: P51172
  ENSP ID: ENSP00000383717

SEQ ID NO: 80202 - protein, 139 aa, Homo sapiens
  Payload ID: 15987
  Gene Symbol: SCNN1D
  Gene Name: sodium channel, non voltage gated 1 delta subunit
  ENSP ID: ENSP00000420548
MAFLSRTSPVAAASFQSRQAGGQRLHPASELPAAPAMAEHRSMDGRMEAATRGGSHLQAAAQTPPRPGPPSAPPPPPKEGHQEGLVELPASFRELLTFFCTNATIHGAIRLVCSRGNRLKTTSWGLLSLGALVALCWQL

SEQ ID NO: 80203 - protein, 328 aa, Homo sapiens
  Payload ID: 15987
  Gene Symbol: SCNN1D
  Gene Name: sodium channel, non voltage gated 1 delta subunit
  ENSP ID: ENSP00000449804
MRAVLSQKTTPLPRYLWPGHLSGPRRLTWSWCSDHRTPTCRELGSPHPTPCTGPARGWPRRGGGPCGFTSAGHVLCGYPLCLLSGPIQGCGTGLGDSSMAFLSRTSPVAAASFQSRQEARGSILLQSCQLPPQWLSTEAWTGEWKQPHGGALTSRLQPRRPPGRGHHQHHHHHPRRGTRRGWWSCPPRSGSCSPSSAPMPPSTAPSAWSAPAGTASRRRPGGCCPWEPWSRSAGSWGSSLSVTGTARSSWPSLCTRSASCSRWSPCVTGTHVGRVRSSAIWSCWTSLPGRTLTPCTTSTSAKAEPPSPPLSPATSPPSTWTGRSVCRG

SEQ ID NO: 80204 - protein, 803 aa, Homo sapiens
  Payload ID: 15987
  Gene Symbol: SCNN1D
  Gene Name: sodium channel, non voltage gated 1 delta subunit
  ENSP ID: ENSP00000478543
ISRAVLSQKTTPLPRYLWPGHLSGPRRLTWSWCSDHRTPTCRELGSPHPTPCTGPARGWPRRGGGPCGFTSAGHVLCGYPLCLLSGPIQGCGTGLGDSSMAFLSRTSPVAAASFQSRQEARGSILLQSCQLPPQWLSTEAWTGEWKQPHGGALTSRSPGPVAPQRPCHLKGWQHRPTQHNAACKQGQAAAQTPPRPGPPSAPPPPPKEGHQEGLVELPASFRELLTFFCTNATIHGAIRLVCSRGNRLKTTSWGLLSLGALVALCWQLGLLFERHWHRPVLMAVSVHSERKLLPLVTLCDGNPRRPSPVLRHLELLDEFARENIDSLYNVNLSKGRAALSATVPRHEPPFHLDREIRLQRLSHSGSRVRVGFRLCNSTGGDCFYRGYTSGVAAVQDWYHFHYVDILALLPAAWEDSHGSQDGHFVLSCSYDGLDCQARQFRTFHHPTYGSCYTVDGVWTAQRPGITHGVGLVLRVEQQPHLPLLSTLAGIRVMVHGRNHTPFLGHHSFSVRPGTEATISIREDEVHRLGSPYGHCTAGGEGVEVELLHNTSYTRQACLVSCFQQLMVETCSCGYYLHPLPAGAEYCSSARHPAWGHCFYRLYQDLETHRLPCTSRCPRPCRESAFKLSTGTSRWPSAKSAGWTLATLGEQGLPHQSHRQRSSLAKINIVYQELNYRSVEEAPVYSVPQLLSAMGSLCSLWFGASVLSLLELLELLLDASALTLVLGGRRLRRAWFSWPRASPASGASSIKPEASQMPPPAGGTSDDPEPSGPHLPRVMLPGVLAGVSAEESWAGPQPLETLDT

SEQ ID NO: 80205 - protein, 649 aa, Homo sapiens
  Payload ID: 15988
  Gene Symbol: SCNN1G
  Gene Name: sodium channel, non voltage gated 1 gamma subunit
  Uniprot ID: P51170
  ENSP ID: ENSP00000300061
MAPGEKIKAKIKKNLPVTGPQAPTIKELMRWYCLNTNTHGCRRIVVSRGRLRRLLWIGFTLTAVALILWQCALLVFSFYTVSVSIKVHFRKLDFPAVTICNINPYKYSTVRHLLADLEQETREALKSLYGFPESRKRREAESWNSVSEGKQPRFSHRIPLLIFDQDEKGKARDFFTGRKRKVGGSIIHKASNVMHIESKQVVGFQLCSNDTSDCATYTFSSGINAIQEWYKLHYMNIMAQVPLEKKINMSYSAEELLVTCFFDGVSCDARNFTLFHHPMHGNCYTFNNRENETILSTSMGGSEYGLQVILYINEEEYNPFLVSSTGAKVIIHRQDEYPFVEDVGTEIETAMVTSIGMHLTESFKLSEPYSQCTEDGSDVPIRNIYNAAYSLQICLHSCFQTKMVEKCGCAQYSQPLPPAANYCNYQQHPNWMYCYYQLHRAFVQEELGCQSVCKEACSFKEWTLTTSLAQWPSVVSEKWLLPVLTWDQGRQVNKKLNKTDLAKLLIFYKDLNQRSIMESPANSIEMLLSNFGGQLGLWMSCSVVCVIEIIEVFFIDFFSIIARRQWQKAKEWWAWKQAPPCPEAPRSPQGQDNPALDIDDDLPTFNSALHLPPALGTQVPGTPPPKYNTLRLERAFSNQLTDTQMLDEL

SEQ ID NO: 80206 - protein, 2009 aa, Homo sapiens
  Payload ID: 15989
  Gene Symbol: SCN1A
  Gene Name: sodium channel, voltage gated, type I alpha subunit
  Uniprot ID: P35498
  ENSP ID: ENSP00000303540
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKGKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTAEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEESLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 80207 - protein, 1998 aa, Homo sapiens
  Payload ID: 15989
  Gene Symbol: SCN1A
  Gene Name: sodium channel, voltage gated, type I alpha subunit
  Uniprot ID: P35498
  ENSP ID: ENSP00000364554
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKGKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTAEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEESLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 80208 - protein, 1981 aa, Homo sapiens
  Payload ID: 15989
  Gene Symbol: SCN1A
  Gene Name: sodium channel, voltage gated, type I alpha subunit
  Uniprot ID: P35498
  ENSP ID: ENSP00000386312
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKGKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTAEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEESLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 80209 - protein, 2009 aa, Homo sapiens; identical to SEQ ID NO: 80206
  Payload ID: 15989
  Gene Symbol: SCN1A
  Gene Name: sodium channel, voltage gated, type I alpha subunit
  Uniprot ID: P35498
  ENSP ID: ENSP00000407030

SEQ ID NO: 80210 - protein, 218 aa, Homo sapiens
  Payload ID: 15990
  Gene Symbol: SCN1B
  Gene Name: sodium channel, voltage gated, type I beta subunit
  Uniprot ID: Q07699
  ENSP ID: ENSP00000262631
MGRLLALVVGAALVSSACGGCVEVDSETEAVYGMTFKILCISCKRRSETNAETFTEWTFRQKGTEEFVKILRYENEVLQLEEDERFEGRVVWNGSRGTKDLQDLSIFITNVTYNHSGDYECHVYRLLFFENYEHNTSVVKKIHIEVVDKANRDMASIVSEIMMYVLIVVLTIWLVAEMIYCYKKIAAATETAAQENASEYLAITSESKENCTGVQVAE

SEQ ID NO: 80211 - protein, 268 aa, Homo sapiens
  Payload ID: 15990
  Gene Symbol: SCN1B
  Gene Name: sodium channel, voltage gated, type I beta subunit
  Uniprot ID: Q07699
  ENSP ID: ENSP00000396915
MGRLLALVVGAALVSSACGGCVEVDSETEAVYGMTFKILCISCKRRSETNAETFTEWTFRQKGTEEFVKILRYENEVLQLEEDERFEGRVVWNGSRGTKDLQDLSIFITNVTYNHSGDYECHVYRLLFFENYEHNTSVVKKIHIEVVDKGESGAACPFTVTHRRARWRDRWQAVDRTGWLCAWPANRPQQRAEGEGSSPSCPLQLWPLFLSSPRRGQSMPVPHRRSGYRTQLCHLCCMTSGRCLLSLSQRVVLGLPGIIIRCVSRGVV

SEQ ID NO: 80212 - protein, 147 aa, Homo sapiens
  Payload ID: 15990
  Gene Symbol: SCN1B
  Gene Name: sodium channel, voltage gated, type I beta subunit
  ENSP ID: ENSP00000468848
MGRLLALVVGAALVSSACGGCVEVDSETEAVYGMTFKILCISCKRRSETNAETFTEWTFRQKGTEEFVKKIHIEVVDKANRDMASIVSEIMMYVLIVVLTIWLVAEMIYCYKKIAAATETAAQENASEYLAITSESKENCTGVQVAE

SEQ ID NO: 80213 - protein, 2005 aa, Homo sapiens
  Payload ID: 15991
  Gene Symbol: SCN2A
  Gene Name: sodium channel, voltage gated, type II alpha subunit
  Uniprot ID: Q99250
  ENSP ID: ENSP00000283256
MAQSVLVPPGPDSFRFFTRESLAAIEQRIAEEKAKRPKQERKDEDDENGPKPNSDLEAGKSLPFIYGDIPPEMVSVPLEDLDPYYINKKTFIVLNKGKAISRFSATPALYILTPFNPIRKLAIKILVHSLFNMLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSIFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQSGEEEKNDRVRKSESEDSIRRKGFRFSLEGSRLTYEKRFSSPHQSLLSIRGSLFSPRRNSRASLFSFRGRAKDIGSENDFADDEHSTFEDNDSRRDSLFVPHRHGERRHSNVSQASRASRVLPILPMNGKMHSAVDCNGVVSLVGGPSTLTSAGQLLPEGTTTETEIRKRRSSSYHVSMDLLEDPTSRQRAMSIASILTNTMEELEESRQKCPPCWYKFANMCLIWDCCKPWLKVKHLVNLVVMDPFVDLAITICIVLNTLFMAMEHYPMTEQFSSVLSVGNLVFTGIFTAEMFLKIIAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDFVKRKIREFIQKAFVRKQKALDEIKPLEDLNNKKDSCISNHTTIEIGKDLNYLKDGNGTTSGIGSSVEKYVVDESDYMSFINNPSLTVTVPIAVGESDFENLNTEEFSSESDMEESKEKLNATSSSEGSTVDIGAPAEGEQPEVEPEESLEPEACFTEDCVRKFKCCQISIEEGKGKLWWNLRKTCYKIVEHNWFETFIVFMILLSSGALAFEDIYIEQRKTIKTMLEYADKVFTYIFILEMLLKWVAYGFQVYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECKALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRYYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPDKDHPGSSVKGDCGNPSVGIFFFVSYIIISFLVVVNMYIAVILENFSVATEESAEPLSEDDFEMFYEVWEKFDPDATQFIEFAKLSDFADALDPPLLIAKPNKVQLIAMDLPMVSGDRIHCLDILFAFTKRVLGESGEMDALRIQMEERFMASNPSKVSYEPITTTLKRKQEEVSAIIIQRAYRRYLLKQKVKKVSSIYKKDKGKECDGTPIKEDTLIDKLNENSTPEKTDMTPSTTSPPSYDSVTKPEKEKFEKDKSEKEDKGKDIRESKK

SEQ ID NO: 80214 - protein, 2005 aa, Homo sapiens
  Payload ID: 15991
  Gene Symbol: SCN2A
  Gene Name: sodium channel, voltage gated, type II alpha subunit
  Uniprot ID: Q99250
  ENSP ID: ENSP00000364576
MAQSVLVPPGPDSFRFFTRESLAAIEQRIAEEKAKRPKQERKDEDDENGPKPNSDLEAGKSLPFIYGDIPPEMVSVPLEDLDPYYINKKTFIVLNKGKAISRFSATPALYILTPFNPIRKLAIKILVHSLFNMLIMCTILTNCVFMTMSNPPDWTKNVEYTFTGIYTFESLIKILARGFCLEDFTFLRDPWNWLDFTVITFAYVTEFVNLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSIFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQSGEEEKNDRVRKSESEDSIRRKGFRFSLEGSRLTYEKRFSSPHQSLLSIRGSLFSPRRNSRASLFSFRGRAKDIGSENDFADDEHSTFEDNDSRRDSLFVPHRHGERRHSNVSQASRASRVLPILPMNGKMHSAVDCNGVVSLVGGPSTLTSAGQLLPEGTTTETEIRKRRSSSYHVSMDLLEDPTSRQRAMSIASILTNTMEELEESRQKCPPCWYKFANMCLIWDCCKPWLKVKHLVNLVVMDPFVDLAITICIVLNTLFMAMEHYPMTEQFSSVLSVGNLVFTGIFTAEMFLKIIAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDFVKRKIREFIQKAFVRKQKALDEIKPLEDLNNKKDSCISNHTTIEIGKDLNYLKDGNGTTSGIGSSVEKYVVDESDYMSFINNPSLTVTVPIAVGESDFENLNTEEFSSESDMEESKEKLNATSSSEGSTVDIGAPAEGEQPEVEPEESLEPEACFTEDCVRKFKCCQISIEEGKGKLWWNLRKTCYKIVEHNWFETFIVFMILLSSGALAFEDIYIEQRKTIKTMLEYADKVFTYIFILEMLLKWVAYGFQVYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECKALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRYYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPDKDHPGSSVKGDCGNPSVGIFFFVSYIIISFLVVVNMYIAVILENFSVATEESAEPLSEDDFEMFYEVWEKFDPDATQFIEFAKLSDFADALDPPLLIAKPNKVQLIAMDLPMVSGDRIHCLDILFAFTKRVLGESGEMDALRIQMEERFMASNPSKVSYEPITTTLKRKQEEVSAIIIQRAYRRYLLKQKVKKVSSIYKKDKGKECDGTPIKEDTLIDKLNENSTPEKTDMTPSTTSPPSYDSVTKPEKEKFEKDKSEKEDKGKDIRESKK

SEQ ID NO: 80215 - protein, 2005 aa, Homo sapiens; identical to SEQ ID NO: 80213
  Payload ID: 15991
  Gene Symbol: SCN2A
  Gene Name: sodium channel, voltage gated, type II alpha subunit
  Uniprot ID: Q99250
  ENSP ID: ENSP00000364586

SEQ ID NO: 80216 - protein, 505 aa, Homo sapiens
  Payload ID: 15991
  Gene Symbol: SCN2A
  Gene Name: sodium channel, voltage gated, type II alpha subunit
  ENSP ID: ENSP00000406454
MAQSVLVPPGPDSFRFFTRESLAAIEQRIAEEKAKRPKQERKDEDDENGPKPNSDLEAGKSLPFIYGDIPPEMVSVPLEDLDPYYINKKTFIVLNKGKAISRFSATPALYILTPFNPIRKLAIKILVHSLFNMLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSIFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRR

SEQ ID NO: 80217 - protein, 2005 aa, Homo sapiens; identical to SEQ ID NO: 80214
  Payload ID: 15991
  Gene Symbol: SCN2A
  Gene Name: sodium channel, voltage gated, type II alpha subunit
  Uniprot ID: Q99250
  ENSP ID: ENSP00000486885

SEQ ID NO: 80218 - protein, 178 aa, Homo sapiens
  Payload ID: 15991
  Gene Symbol: SCN2A
  Gene Name: sodium channel, voltage gated, type II alpha subunit
  ENSP ID: ENSP00000487466
WTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSIFNWDEYIEDKSKIYSINH

SEQ ID NO: 80219 - protein, 215 aa, Homo sapiens
  Payload ID: 15992
  Gene Symbol: SCN2B
  Gene Name: sodium channel, voltage gated, type II beta subunit
  Uniprot ID: O60939
  ENSP ID: ENSP00000278947
MHRDAWLPRPAFSLTGLSLFFSLVPPGRSMEVTVPATLNVLNGSDARLPCTFNSCYTVNHKQFSLNWTYQECNNCSEEMFLQFRMKIINLKLERFQDRVEFSGNPSKYDVSVMLRNVQPEDEGIYNCYIMNPPDRHRGHGKIHLQVLMEEPPERDSTVAVIVGASVGGFLAVVILVLMVVKCVRRKKEQKLSTDDLKTEEEGKTDGEGNPDDGAK

SEQ ID NO: 80220 - protein, 2000 aa, Homo sapiens
  Payload ID: 15993
  Gene Symbol: SCN3A
  Gene Name: sodium channel, voltage gated, type III alpha subunit
  Uniprot ID: Q9NY46
  ENSP ID: ENSP00000283254
MAQALLVPPGPESFRLFTRESLAAIEKRAAEEKAKKPKKEQDNDDENKPKPNSDLEAGKNLPFIYGDIPPEMVSEPLEDLDPYYINKKTFIVMNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVMAYVTEFVDLGNVSALRTFRVLRALKTISVIPGLKTIVGALIQSVKKLSDVMILTVFCLSVFALIGLQLFMGNLRNKCLQWPPSDSAFETNTTSYFNGTMDSNGTFVNVTMSTFNWKDYIGDDSHFYVLDGQKDPLLCGNGSDAGQCPEGYICVKAGRNPNYGYTSFDTFSWAFLSLFRLMTQDYWENLYQLTLRAAGKTYMIFFVLVIFLGSFYLVNLILAVVAMAYEEQNQATLEEAEQKEAEFQQMLEQLKKQQEEAQAVAAASAASRDFSGIGGLGELLESSSEASKLSSKSAKEWRNRRKKRRQREHLEGNNKGERDSFPKSESEDSVKRSSFLFSMDGNRLTSDKKFCSPHQSLLSIRGSLFSPRRNSKTSIFSFRGRAKDVGSENDFADDEHSTFEDSESRRDSLFVPHRHGERRNSNVSQASMSSRMVPGLPANGKMHSTVDCNGVVSLVGGPSALTSPTGQLPPEGTTTETEVRKRRLSSYQISMEMLEDSSGRQRAVSIASILTNTMEELEESRQKCPPCWYRFANVFLIWDCCDAWLKVKHLVNLIVMDPFVDLAITICIVLNTLFMAMEHYPMTEQFSSVLTVGNLVFTGIFTAEMVLKIIAMDPYYYFQEGWNIFDGIIVSLSLMELGLSNVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQTMCLIVFMLVMVIGNLVVLNLFLALLLSSFSSDNLAATDDDNEMNNLQIAVGRMQKGIDYVKNKMRECFQKAFFRKPKVIEIHEGNKIDSCMSNNTGIEISKELNYLRDGNGTTSGVGTGSSVEKYVIDENDYMSFINNPSLTVTVPIAVGESDFENLNTEEFSSESELEESKEKLNATSSSEGSTVDVVLPREGEQAETEPEEDLKPEACFTEGCIKKFPFCQVSTEEGKGKIWWNLRKTCYSIVEHNWFETFIVFMILLSSGALAFEDIYIEQRKTIKTMLEYADKVFTYIFILEMLLKWVAYGFQTYFTNAWCWLDFLIVDVSLVSLVANALGYSELGAIKSLRTLRALRPLRALSRFEGMRVVVNALVGAIPSIMNVLLVCLIFWLIFSIMGVNLFAGKFYHCVNMTTGNMFDISDVNNLSDCQALGKQARWKNVKVNFDNVGAGYLALLQVATFKGWMDIMYAAVDSRDVKLQPVYEENLYMYLYFVIFIIFGSFFTLNLFIGVIIDNFNQQKKKFGGQDIFMTEEQKKYYNAMKKLGSKKPQKPIPRPANKFQGMVFDFVTRQVFDISIMILICLNMVTMMVETDDQGKYMTLVLSRINLVFIVLFTGEFVLKLVSLRHYYFTIGWNIFDFVVVILSIVGMFLAEMIEKYFVSPTLFRVIRLARIGRILRLIKGAKGIRTLLFALMMSLPALFNIGLLLFLVMFIYAIFGMSNFAYVKKEAGIDDMFNFETFGNSMICLFQITTSAGWDGLLAPILNSAPPDCDPDTIHPGSSVKGDCGNPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLGESGEMDALRIQMEDRFMASNPSKVSYEPITTTLKRKQEEVSAAIIQRNFRCYLLKQRLKNISSNYNKEAIKGRIDLPIKQDMIIDKLNGNSTPEKTDGSSSTTSPPSYDSVTKPDKEKFEKDKPEKESKGKEVRENQK

SEQ ID NO: 80221 - protein, 2000 aa, Homo sapiens
  Payload ID: 15993
  Gene Symbol: SCN3A
  Gene Name: sodium channel, voltage gated, type III alpha subunit
  Uniprot ID: Q9NY46
  ENSP ID: ENSP00000353206
MAQALLVPPGPESFRLFTRESLAAIEKRAAEEKAKKPKKEQDNDDENKPKPNSDLEAGKNLPFIYGDIPPEMVSEPLEDLDPYYINKKTFIVMNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVMAYVTEFVSLGNVSALRTFRVLRALKTISVIPGLKTIVGALIQSVKKLSDVMILTVFCLSVFALIGLQLFMGNLRNKCLQWPPSDSAFETNTTSYFNGTMDSNGTFVNVTMSTFNWKDYIGDDSHFYVLDGQKDPLLCGNGSDAGQCPEGYICVKAGRNPNYGYTSFDTFSWAFLSLFRLMTQDYWENLYQLTLRAAGKTYMIFFVLVIFLGSFYLVNLILAVVAMAYEEQNQATLEEAEQKEAEFQQMLEQLKKQQEEAQAVAAASAASRDFSGIGGLGELLESSSEASKLSSKSAKEWRNRRKKRRQREHLEGNNKGERDSFPKSESEDSVKRSSFLFSMDGNRLTSDKKFCSPHQSLLSIRGSLFSPRRNSKTSIFSFRGRAKDVGSENDFADDEHSTFEDSESRRDSLFVPHRHGERRNSNVSQASMSSRMVPGLPANGKMHSTVDCNGVVSLVGGPSALTSPTGQLPPEGTTTETEVRKRRLSSYQISMEMLEDSSGRQRAVSIASILTNTMEELEESRQKCPPCWYRFANVFLIWDCCDAWLKVKHLVNLIVMDPFVDLAITICIVLNTLFMAMEHYPMTEQFSSVLTVGNLVFTGIFTAEMVLKIIAMDPYYYFQEGWNIFDGIIVSLSLMELGLSNVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQTMCLIVFMLVMVIGNLVVLNLFLALLLSSFSSDNLAATDDDNEMNNLQIAVGRMQKGIDYVKNKMRECFQKAFFRKPKVIEIHEGNKIDSCMSNNTGIEISKELNYLRDGNGTTSGVGTGSSVEKYVIDENDYMSFINNPSLTVTVPIAVGESDFENLNTEEFSSESELEESKEKLNATSSSEGSTVDVVLPREGEQAETEPEEDLKPEACFTEGCIKKFPFCQVSTEEGKGKIWWNLRKTCYSIVEHNWFETFIVFMILLSSGALAFEDIYIEQRKTIKTMLEYADKVFTYIFILEMLLKWVAYGFQTYFTNAWCWLDFLIVDVSLVSLVANALGYSELGAIKSLRTLRALRPLRALSRFEGMRVVVNALVGAIPSIMNVLLVCLIFWLIFSIMGVNLFAGKFYHCVNMTTGNMFDISDVNNLSDCQALGKQARWKNVKVNFDNVGAGYLALLQVATFKGWMDIMYAAVDSRDVKLQPVYEENLYMYLYFVIFIIFGSFFTLNLFIGVIIDNFNQQKKKFGGQDIFMTEEQKKYYNAMKKLGSKKPQKPIPRPANKFQGMVFDFVTRQVFDISIMILICLNMVTMMVETDDQGKYMTLVLSRINLVFIVLFTGEFVLKLVSLRHYYFTIGWNIFDFVVVILSIVGMFLAEMIEKYFVSPTLFRVIRLARIGRILRLIKGAKGIRTLLFALMMSLPALFNIGLLLFLVMFIYAIFGMSNFAYVKKEAGIDDMFNFETFGNSMICLFQITTSAGWDGLLAPILNSAPPDCDPDTIHPGSSVKGDCGNPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLGESGEMDALRIQMEDRFMASNPSKVSYEPITTTLKRKQEEVSAAIIQRNFRCYLLKQRLKNISSNYNKEAIKGRIDLPIKQDMIIDKLNGNSTPEKTDGSSSTTSPPSYDSVTKPDKEKFEKDKPEKESKGKEVRENQK

SEQ ID NO: 80222 - protein, 1951 aa, Homo sapiens
  Payload ID: 15993
  Gene Symbol: SCN3A
  Gene Name: sodium channel, voltage gated, type III alpha subunit
  Uniprot ID: Q9NY46
  ENSP ID: ENSP00000386726
MAQALLVPPGPESFRLFTRESLAAIEKRAAEEKAKKPKKEQDNDDENKPKPNSDLEAGKNLPFIYGDIPPEMVSEPLEDLDPYYINKKTFIVMNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVMAYVTEFVSLGNVSALRTFRVLRALKTISVIPGLKTIVGALIQSVKKLSDVMILTVFCLSVFALIGLQLFMGNLRNKCLQWPPSDSAFETNTTSYFNGTMDSNGTFVNVTMSTFNWKDYIGDDSHFYVLDGQKDPLLCGNGSDAGQCPEGYICVKAGRNPNYGYTSFDTFSWAFLSLFRLMTQDYWENLYQLTLRAAGKTYMIFFVLVIFLGSFYLVNLILAVVAMAYEEQNQATLEEAEQKEAEFQQMLEQLKKQQEEAQAVAAASAASRDFSGIGGLGELLESSSEASKLSSKSAKEWRNRRKKRRQREHLEGNNKGERDSFPKSESEDSVKRSSFLFSMDGNRLTSDKKFCSPHQSLLSIRGSLFSPRRNSKTSIFSFRGRAKDVGSENDFADDEHSTFEDSESRRDSLFVPHRHGERRNSNGTTTETEVRKRRLSSYQISMEMLEDSSGRQRAVSIASILTNTMEELEESRQKCPPCWYRFANVFLIWDCCDAWLKVKHLVNLIVMDPFVDLAITICIVLNTLFMAMEHYPMTEQFSSVLTVGNLVFTGIFTAEMVLKIIAMDPYYYFQEGWNIFDGIIVSLSLMELGLSNVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQTMCLIVFMLVMVIGNLVVLNLFLALLLSSFSSDNLAATDDDNEMNNLQIAVGRMQKGIDYVKNKMRECFQKAFFRKPKVIEIHEGNKIDSCMSNNTGIEISKELNYLRDGNGTTSGVGTGSSVEKYVIDENDYMSFINNPSLTVTVPIAVGESDFENLNTEEFSSESELEESKEKLNATSSSEGSTVDVVLPREGEQAETEPEEDLKPEACFTEGCIKKFPFCQVSTEEGKGKIWWNLRKTCYSIVEHNWFETFIVFMILLSSGALAFEDIYIEQRKTIKTMLEYADKVFTYIFILEMLLKWVAYGFQTYFTNAWCWLDFLIVDVSLVSLVANALGYSELGAIKSLRTLRALRPLRALSRFEGMRVVVNALVGAIPSIMNVLLVCLIFWLIFSIMGVNLFAGKFYHCVNMTTGNMFDISDVNNLSDCQALGKQARWKNVKVNFDNVGAGYLALLQVATFKGWMDIMYAAVDSRDVKLQPVYEENLYMYLYFVIFIIFGSFFTLNLFIGVIIDNFNQQKKKFGGQDIFMTEEQKKYYNAMKKLGSKKPQKPIPRPANKFQGMVFDFVTRQVFDISIMILICLNMVTMMVETDDQGKYMTLVLSRINLVFIVLFTGEFVLKLVSLRHYYFTIGWNIFDFVVVILSIVGMFLAEMIEKYFVSPTLFRVIRLARIGRILRLIKGAKGIRTLLFALMMSLPALFNIGLLLFLVMFIYAIFGMSNFAYVKKEAGIDDMFNFETFGNSMICLFQITTSAGWDGLLAPILNSAPPDCDPDTIHPGSSVKGDCGNPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLGESGEMDALRIQMEDRFMASNPSKVSYEPITTTLKRKQEEVSAAIIQRNFRCYLLKQRLKNISSNYNKEAIKGRIDLPIKQDMIIDKLNGNSTPEKTDGSSSTTSPPSYDSVTKPDKEKFEKDKPEKESKGKEVRENQK

SEQ ID NO: 80223 - protein, 200 aa, Homo sapiens
  Payload ID: 15993
  Gene Symbol: SCN3A
  Gene Name: sodium channel, voltage gated, type III alpha subunit
  ENSP ID: ENSP00000391569
MAQALLVPPGPESFRLFTRESLAAIEKRAAEEKAKKPKKEQDNDDENKPKPNSDLEAGKNLPFIYGDIPPEMVSEPLEDLDPYYINKKTFIVMNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVM

SEQ ID NO: 80224 - protein, 1364 aa, Homo sapiens
  Payload ID: 15993
  Gene Symbol: SCN3A
  Gene Name: sodium channel, voltage gated, type III alpha subunit
  ENSP ID: ENSP00000403348
MAQALLVPPGPESFRLFTRESLAAIEKRAAEEKAKKPKKEQDNDDENKPKPNSDLEAGKNLPFIYGDIPPEMVSEPLEDLDPYYINKKTFIVMNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVMAYVTEFVDLGNVSALRTFRVLRALKTISVIPGLKTIVGALIQSVKKLSDVMILTVFCLSVFALIGLQLFMGNLRNKCLQWPPSDSAFETNTTSYFNGTMDSNGTFVNVTMSTFNWKDYIGDDSHFYVLDGQKDPLLCGNGSDAGQCPEGYICVKAGRNPNYGYTSFDTFSWAFLSLFRLMTQDYWENLYQLTLRAAGKTYMIFFVLVIFLGSFYLVNLILAVVAMAYEEQNQATLEEAEQKEAEFQQMLEQLKKQQEEAQAVAAASAASRDFSGIGGLGELLESSSEASKLSSKSAKEWRNRRKKRRQREHLEGNNKGERDSFPKSESEDSVKRSSFLFSMDGNRLTSDKKFCSPHQSLLSIRGSLFSPRRNSKTSIFSFRGRAKDVGSENDFADDEHSTFEDSESRRDSLFVPHRHGERRNSNGTTTETEVRKRRLSSYQISMEMLEDSSGRQRAVSIASILTNTMEELEESRQKCPPCWYRFANVFLIWDCCDAWLKVKHLVNLIVMDPFVDLAITICIVLNTLFMAMEHYPMTEQFSSVLTVGNLVFTGIFTAEMVLKIIAMDPYYYFQEGWNIFDGIIVSLSLMELGLSNVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQTMCLIVFMLVMVIGNLVVLNLFLALLLSSFSSDNLAATDDDNEMNNLQIAVGRMQKGIDYVKNKMRECFQKAFFRKPKVIEIHEGNKIDSCMSNNTGIEISKELNYLRDGNGTTSGVGTGSSVEKYVIDENDYMSFINNPSLTVTVPIAVGESDFENLNTEEFSSESELEESKEKLNATSSSEGSTVDVVLPREGEQAETEPEEDLKPEACFTEGCIKKFPFCQVSTEEGKGKIWWNLRKTCYSIVEHNWFETFIVFMILLSSGALAFEDIYIEQRKTIKTMLEYADKVFTYIFILEMLLKWVAYGFQTYFTNAWCWLDFLIVDVSLVSLVANALGYSELGAIKSLRTLRALRPLRALSRFEGMRVVVNALVGAIPSIMNVLLVCLIFWLIFSIMGVNLFAGKFYHCVNMTTGNMFDISDVNNLSDCQALGKQARWKNVKVNFDNVGAGYLALLQV

SEQ ID NO: 80225 - protein, 215 aa, Homo sapiens
  Payload ID: 15994
  Gene Symbol: SCN3B
  Gene Name: sodium channel, voltage gated, type III beta subunit
  Uniprot ID: Q9NY72
  ENSP ID: ENSP00000299333
MPAFNRLFPLASLVLIYWVSVCFPVCVEVPSETEAVQGNPMKLRCISCMKREEVEATTVVEWFYRPEGGKDFLIYEYRNGHQEVESPFQGRLQWNGSKDLQDVSITVLNVTLNDSGLYTCNVSREFEFEAHRPFVKTTRLIPLRVTEEAGEDFTSVVSEIMMYILLVFLTLWLLIEMIYCYRKVSKAEEAAQENASDYLAIPSENKENSAVPVEE

SEQ ID NO: 80226 - protein, 215 aa, Homo sapiens; identical to SEQ ID NO: 80225
  Payload ID: 15994
  Gene Symbol: SCN3B
  Gene Name: sodium channel, voltage gated, type III beta subunit
  Uniprot ID: Q9NY72
  ENSP ID: ENSP00000376523

SEQ ID NO: 80227 - protein, 215 aa, Homo sapiens; identical to SEQ ID NO: 80225
  Payload ID: 15994
  Gene Symbol: SCN3B
  Gene Name: sodium channel, voltage gated, type III beta subunit
  Uniprot ID: Q9NY72
  ENSP ID: ENSP00000432785

SEQ ID NO: 80228 - protein, 93 aa, Homo sapiens
  Payload ID: 15994
  Gene Symbol: SCN3B
  Gene Name: sodium channel, voltage gated, type III beta subunit
  ENSP ID: ENSP00000434363
MPAFNRLFPLASLVLIYWVSVCFPVCVEVPSETEAVQGNPMKLRCISCMKREEVEATTVVEWFYRPEGGKDFLIYEYRNGHQEVESPFQGRLQ

SEQ ID NO: 80229 - protein, 141 aa, Homo sapiens
  Payload ID: 15994
  Gene Symbol: SCN3B
  Gene Name: sodium channel, voltage gated, type III beta subunit
  ENSP ID: ENSP00000435554
MPAFNRLFPLASLVLIYWVSVCFPVCVEVPSETEAVQGNPMKLRCISCMKREEVEATTVVEWFYRPEGGKDFLIYEYRNGHQEVESPFQGRLQWNGSKDLQDVSITVLNVTLNDSGLYTCNVSREFEFEAHRPFVKTTRLI

SEQ ID NO: 80230 - protein, 1836 aa, Homo sapiens
  Payload ID: 15995
  Gene Symbol: SCN4A
  Gene Name: sodium channel, voltage gated, type IV alpha subunit
  Uniprot ID: P35499
  ENSP ID: ENSP00000396320
MARPSLCTLVPLGPECLRPFTRESLAAIEQRAVEEEARLQRNKQMEIEEPERKPRSDLEAGKNLPMIYGDPPPEVIGIPLEDLDPYYSNKKTFIVLNKGKAIFRFSATPALYLLSPFSVVRRGAIKVLIHALFSMFIMITILTNCVFMTMSDPPPWSKNVEYTFTGIYTFESLIKILARGFCVDDFTFLRDPWNWLDFSVIMMAYLTEFVDLGNISALRTFRVLRALKTITVIPGLKTIVGALIQSVKKLSDVMILTVFCLSVFALVGLQLFMGNLRQKCVRWPPPFNDTNTTWYSNDTWYGNDTWYGNEMWYGNDSWYANDTWNSHASWATNDTFDWDAYISDEGNFYFLEGSNDALLCGNSSDAGHCPEGYECIKTGRNPNYGYTSYDTFSWAFLALFRLMTQDYWENLFQLTLRAAGKTYMIFFVVIIFLGSFYLINLILAVVAMAYAEQNEATLAEDKEKEEEFQQMLEKFKKHQEELEKAKAAQALEGGEADGDPAHGKDCNGSLDTSQGEKGAPRQSSSGDSGISDAMEELEEAHQKCPPWWYKCAHKVLIWNCCAPWLKFKNIIHLIVMDPFVDLGITICIVLNTLFMAMEHYPMTEHFDNVLTVGNLVFTGIFTAEMVLKLIAMDPYEYFQQGWNIFDSIIVTLSLVELGLANVQGLSVLRSFRLLRVFKLAKSWPTLNMLIKIIGNSVGALGNLTLVLAIIVFIFAVVGMQLFGKSYKECVCKIALDCNLPRWHMHDFFHSFLIVFRILCGEWIETMWDCMEVAGQAMCLTVFLMVMVIGNLVVLNLFLALLLSSFSADSLAASDEDGEMNNLQIAIGRIKLGIGFAKAFLLGLLHGKILSPKDIMLSLGEADGAGEAGEAGETAPEDEKKEPPEEDLKKDNHILNHMGLADGPPSSLELDHLNFINNPYLTIQVPIASEESDLEMPTEEETDTFSEPEDSKKPPQPLYDGNSSVCSTADYKPPEEDPEEQAEENPEGEQPEECFTEACVQRWPCLYVDISQGRGKKWWTLRRACFKIVEHNWFETFIVFMILLSSGALAFEDIYIEQRRVIRTILEYADKVFTYIFIMEMLLKWVAYGFKVYFTNAWCWLDFLIVDVSIISLVANWLGYSELGPIKSLRTLRALRPLRALSRFEGMRVVVNALLGAIPSIMNVLLVCLIFWLIFSIMGVNLFAGKFYYCINTTTSERFDISEVNNKSECESLMHTGQVRWLNVKVNYDNVGLGYLSLLQVATFKGWMDIMYAAVDSREKEEQPQYEVNLYMYLYFVIFIIFGSFFTLNLFIGVIIDNFNQQKKKLGGKDIFMTEEQKKYYNAMKKLGSKKPQKPIPRPQNKIQGMVYDLVTKQAFDITIMILICLNMVTMMVETDNQSQLKVDILYNINMIFIIIFTGECVLKMLALRQYYFTVGWNIFDFVVVILSIVGLALSDLIQKYFVSPTLFRVIRLARIGRVLRLIRGAKGIRTLLFALMMSLPALFNIGLLLFLVMFIYSIFGMSNFAYVKKESGIDDMFNFETFGNSIICLFEITTSAGWDGLLNPILNSGPPDCDPNLENPGTSVKGDCGNPSIGICFFCSYIIISFLIVVNMYIAIILENFNVATEESSEPLGEDDFEMFYETWEKFDPDATQFIAYSRLSDFVDTLQEPLRIAKPNKIKLITLDLPMVPGDKIHCLDILFALTKEVLGDSGEMDALKQTMEEKFMAANPSKVSYEPITTTLKRKHEEVCAIKIQRAYRRHLLQRSMKQASYMYRHSHDGSGDDAPEKEGLLANTMSKMYGHENGNSSSPSPEEKGEAGDAGPTMGLMPISPSDTAWPPAPPPGQTVRPGVKESLV

SEQ ID NO: 80231 - protein, 1836 aa, Homo sapiens
  Payload ID: 15995
  Gene Symbol: SCN4A
  Gene Name: sodium channel, voltage gated, type IV alpha subunit
  ENSP ID: ENSP00000463963
MARPSLCTLVPLGPECLRPFTRESLAAIEQRAVEEEARLQRNKQMEIEEPERKPRSDLEAGKNLPMIYGDPPPEVIGIPLEDLDPYYSNKKTFIVLNKGKAIFRFSATPALYLLSPFSVVRRGAIKVLIHALFSMFIMITILTNCVFMTMSDPPPWSKNVEYTFTGIYTFESLIKILARGFCVDDFTFLRDPWNWLDFSVIMMAYLTEFVDLGNISALRTFRVLRALKTITVIPGLKTIVGALIQSVKKLSDVMILTVFCLSVFALVGLQLFMGNLRQKCVRWPPPFNDTNTTWYSNDTWYGNDTWYGNEMWYGNDSWYANDTWNSHASWATNDTFDWDAYISDEGNFYFLEGSNDALLCGNSSDAGHCPEGYECIKTGRNPNYGYTSYDTFSWAFLALFRLMTQDYWENLFQLTLRAAGKTYMIFFVVIIFLGSFYLINLILAVVAMAYAEQNEATLAEDKEKEEEFQQMLEKFKKHQEELEKAKAAQALEGGEADGDPAHGKDCNGSLDTSQGEKGAPRQSSSGDSGISDAMEELEEAHQKCPPWWYKCAHKVLIWNCCAPWLKFKNIIHLIVMDPFVDLGITICIVLNTLFMAMEHYPMTEHFDNVLTVGNLVFTGIFTAEMVLKLIAMDPYEYFQQGWNIFDSIIVTLSLVELGLANVQGLSVLRSFRLLRVFKLAKSWPTLNMLIKIIGNSVGALGNLTLVLAIIVFIFAVVGMQLFGKSYKECVCKIALDCNLPRWHMHDFFHSFLIVFRILCGEWIETMWDCMEVAGQAMCLTVFLMVMVIGNLVVLNLFLALLLSSFSADSLAASDEDGEMNNLQIAIGRIKLGIGFAKAFLLGLLHGKILSPKDIMLSLGEADGAGEAGEAGETAPEDEKKEPPEEDLKKDNHILNHMGLADGPPSSLELDHLNFINNPYLTIQVPIASEESDLEMPTEEETDTFSEPEDSKKPPQPLYDGNSSVCSTADYKPPEEDPEEQAEENPEGEQPEECFTEACVQRWPCLYVDISQGRGKKWWTLRRACFKIVEHNWFETFIVFMILLSSGALAFEDIYIEQRRVIRTILEYADKVFTYIFIMEMLLKWVAYGFKVYFTNAWCWLDFLIVDVSIISLVANWLGYSELGPIKSLRTLRALRPLRALSRFEGMRVVVNALLGAIPSIMNVLLVCLIFWLIFSIMGVNLFAGKFYYCINTTTSERFDISEVNNKSECESLMHTGQVRWLNVKVNYDNVGLGYLSLLQVATFKGWMDIMYAAVDSREKEEQPQYEVNLYMYLYFVIFIIFGSFFTLNLFIGVIIDNFNQQKKKMRGKDIFMTEEQKKYYNAMKKLGSKKPQKPIPRPQNKIQGMVYDLVTKQAFDITIMILICLNMVTMMVETDNQSQLKVDILYNINMIFIIIFTGECVLKMLALRQYYFTVGWNIFDFVVVILSIVGLALSDLIQKYFVSPTLFRVIRLARIGRVLRLIRGAKGIRTLLFALMMSLPALFNIGLLLFLVMFIYSIFGMSNFAYVKKESGIDDMFNFETFGNSIICLFEITTSAGWDGLLNPILNSGPPDCDPNLENPGTSVKGDCGNPSIGICFFCSYIIISFLIVVNMYIAIILENFNVATEESSEPLGEDDFEMFYETWEKFDPDATQFIAYSRLSDFVDTLQEPLRIAKPNKIKLITLDLPMVPGDKIHCLDILFALTKEVLGDSGEMDALKQTMEEKFMAANPSKVSYEPITTTLKRKHEEVCAIKIQRAYRRHLLQRSMKQASYMYRHSHDGSGDDAPEKEGLLANTMSKMYGHENGNSSSPSPEEKGEAGDAGPTMGLMPISPSDTAWPPAPPPGQTVRPGVKESLV

SEQ ID NO: 80232 - protein, 228 aa, Homo sapiens
  Payload ID: 15996
  Gene Symbol: SCN4B
  Gene Name: sodium channel, voltage gated, type IV beta subunit
  Uniprot ID: Q8IWT1
  ENSP ID: ENSP00000322460
MPGAGDGGKAPARWLGTGLLGLFLLPVTLSLEVSVGKATDIYAVNGTEILLPCTFSSCFGFEDLHFRWTYNSSDAFKILIEGTVKNEKSDPKVTLKDDDRITLVGSTKEKMNNISIVLRDLEFSDTGKYTCHVKNPKENNLQHHATIFLQVVDRLEEVDNTVTLIILAVVGGVIGLLILILLIKKLIIFILKKTREKKKECLVSSSGNDNTENGLPGSKAEEKPPSKV

SEQ ID NO: 80233 - protein, 94 aa, Homo sapiens
  Payload ID: 15996
  Gene Symbol: SCN4B
  Gene Name: sodium channel, voltage gated, type IV beta subunit
  Uniprot ID: Q8IWT1
  ENSP ID: ENSP00000436343
MPGAGDGGKAPARWLGTGLLVEEVDNTVTLIILAVVGGVIGLLILILLIKKLIIFILKKTREKKKECLVSSSGNDNTENGLPGSKAEEKPPSKV

SEQ ID NO: 80234 - protein, 1988 aa, Homo sapiens
  Payload ID: 15997
  Gene Symbol: SCN9A
  Gene Name: sodium channel, voltage gated, type IX alpha subunit
  Uniprot ID: Q15858
  ENSP ID: ENSP00000304748
MAMLPPPGPQSFVHFTKQSLALIEQRIAERKSKEPKEEKKDDDEEAPKPSSDLEAGKQLPFIYGDIPPGMVSEPLEDLDPYYADKKTFIVLNKGKTIFRFNATPALYMLSPFSPLRRISIKILVHSLFSMLIMCTILTNCIFMTMNNPPDWTKNVEYTFTGIYTFESLVKILARGFCVGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCFRNSLENNETLESIMNTLESEEDFRKYFYYLEGSKDALLCGFSTDSGQCPEGYTCVKIGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIRRSRIMGLSESSSETSKLSSKSAKERRNRRKKKNQKKLSSGEEKGDAEKLSKSESEDSIRRKSFHLGVEGHRRAHEKRLSTPNQSPLSIRGSLFSARRSSRTSLFSFKGRGRDIGSETEFADDEHSIFGDNESRRGSLFVPHRPQERRSSNISQASRSPPMLPVNGKMHSAVDCNGVVSLVDGRSALMLPNGQLLPEVIIDKATSDDSGTTNQIHKKRRCSSYLLSEDMLNDPNLRQRAMSRASILTNTVEELEESRQKCPPWWYRFAHKFLIWNCSPYWIKFKKCIYFIVMDPFVDLAITICIVLNTLFMAMEHHPMTEEFKNVLAIGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQAMCLIVYMMVMVIGNLVVLNLFLALLLSSFSSDNLTAIEEDPDANNLQIAVTRIKKGINYVKQTLREFILKAFSKKPKISREIRQAEDLNTKKENYISNHTLAEMSKGHNFLKEKDKISGFGSSVDKHLMEDSDGQSFIHNPSLTVTVPIAPGESDLENMNAEELSSDSDSEYSKVRLNRSSSSECSTVDNPLPGEGEEAEAEPMNSDEPEACFTDGCVWRFSCCQVNIESGKGKIWWNIRKTCYKIVEHSWFESFIVLMILLSSGALAFEDIYIERKKTIKIILEYADKIFTYIFILEMLLKWIAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECINTTDGSRFPASQVPNRSECFALMNVSQNVRWKNLKVNFDNVGLGYLSLLQVATFKGWTIIMYAAVDSVNVDKQPKYEYSLYMYIYFVVFIIFGSFFTLNLFIGVIIDNFNQQKKKLGGQDIFMTEEQKKYYNAMKKLGSKKPQKPIPRPGNKIQGCIFDLVTNQAFDISIMVLICLNMVTMMVEKEGQSQHMTEVLYWINVVFIILFTGECVLKLISLRHYYFTVGWNIFDFVVVIISIVGMFLADLIETYFVSPTLFRVIRLARIGRILRLVKGAKGIRTLLFALMMSLPALFNIGLLLFLVMFIYAIFGMSNFAYVKKEDGINDMFNFETFGNSMICLFQITTSAGWDGLLAPILNSKPPDCDPKKVHPGSSVEGDCGNPSVGIFYFVSYIIISFLVVVNMYIAVILENFSVATEESTEPLSEDDFEMFYEVWEKFDPDATQFIEFSKLSDFAAALDPPLLIAKPNKVQLIAMDLPMVSGDRIHCLDILFAFTKRVLGESGEMDSLRSQMEERFMSANPSKVSYEPITTTLKRKQEDVSATVIQRAYRRYRLRQNVKNISSIYIKDGDRDDDLLNKKDMAFDNVNENSSPEKTDATSSTTSPPSYDSVTKPDKEKYEQDRTEKEDKGKDSKESKK

SEQ ID NO: 80235 - protein, 1977 aa, Homo sapiens
  Payload ID: 15997
  Gene Symbol: SCN9A
  Gene Name: sodium channel, voltage gated, type IX alpha subunit
  Uniprot ID: Q15858
  ENSP ID: ENSP00000386306
MAMLPPPGPQSFVHFTKQSLALIEQRIAERKSKEPKEEKKDDDEEAPKPSSDLEAGKQLPFIYGDIPPGMVSEPLEDLDPYYADKKTFIVLNKGKTIFRFNATPALYMLSPFSPLRRISIKILVHSLFSMLIMCTILTNCIFMTMNNPPDWTKNVEYTFTGIYTFESLVKILARGFCVGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCFRNSLENNETLESIMNTLESEEDFRKYFYYLEGSKDALLCGFSTDSGQCPEGYTCVKIGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIRRSRIMGLSESSSETSKLSSKSAKERRNRRKKKNQKKLSSGEEKGDAEKLSKSESEDSIRRKSFHLGVEGHRRAHEKRLSTPNQSPLSIRGSLFSARRSSRTSLFSFKGRGRDIGSETEFADDEHSIFGDNESRRGSLFVPHRPQERRSSNISQASRSPPMLPVNGKMHSAVDCNGVVSLVDGRSALMLPNGQLLPEGTTNQIHKKRRCSSYLLSEDMLNDPNLRQRAMSRASILTNTVEELEESRQKCPPWWYRFAHKFLIWNCSPYWIKFKKCIYFIVMDPFVDLAITICIVLNTLFMAMEHHPMTEEFKNVLAIGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQAMCLIVYMMVMVIGNLVVLNLFLALLLSSFSSDNLTAIEEDPDANNLQIAVTRIKKGINYVKQTLREFILKAFSKKPKISREIRQAEDLNTKKENYISNHTLAEMSKGHNFLKEKDKISGFGSSVDKHLMEDSDGQSFIHNPSLTVTVPIAPGESDLENMNAEELSSDSDSEYSKVRLNRSSSSECSTVDNPLPGEGEEAEAEPMNSDEPEACFTDGCVWRFSCCQVNIESGKGKIWWNIRKTCYKIVEHSWFESFIVLMILLSSGALAFEDIYIERKKTIKIILEYADKIFTYIFILEMLLKWIAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECINTTDGSRFPASQVPNRSECFALMNVSQNVRWKNLKVNFDNVGLGYLSLLQVATFKGWTIIMYAAVDSVNVDKQPKYEYSLYMYIYFVVFIIFGSFFTLNLFIGVIIDNFNQQKKKLGGQDIFMTEEQKKYYNAMKKLGSKKPQKPIPRPGNKIQGCIFDLVTNQAFDISIMVLICLNMVTMMVEKEGQSQHMTEVLYWINVVFIILFTGECVLKLISLRHYYFTVGWNIFDFVVVIISIVGMFLADLIETYFVSPTLFRVIRLARIGRILRLVKGAKGIRTLLFALMMSLPALFNIGLLLFLVMFIYAIFGMSNFAYVKKEDGINDMFNFETFGNSMICLFQITTSAGWDGLLAPILNSKPPDCDPKKVHPGSSVEGDCGNPSVGIFYFVSYIIISFLVVVNMYIAVILENFSVATEESTEPLSEDDFEMFYEVWEKFDPDATQFIEFSKLSDFAAALDPPLLIAKPNKVQLIAMDLPMVSGDRIHCLDILFAFTKRVLGESGEMDSLRSQMEERFMSANPSKVSYEPITTTLKRKQEDVSATVIQRAYRRYRLRQNVKNISSIYIKDGDRDDDLLNKKDMAFDNVNENSSPEKTDATSSTTSPPSYDSVTKPDKEKYEQDRTEKEDKGKDSKESKK

SEQ ID NO: 80236 - protein, 1988 aa, Homo sapiens; identical to SEQ ID NO: 80234
  Payload ID: 15997
  Gene Symbol: SCN9A
  Gene Name: sodium channel, voltage gated, type IX alpha subunit
  Uniprot ID: Q15858
  ENSP ID: ENSP00000386330

SEQ ID NO: 80237 - protein, 539 aa, Homo sapiens
  Payload ID: 15997
  Gene Symbol: SCN9A
  Gene Name: sodium channel, voltage gated, type IX alpha subunit
  ENSP ID: ENSP00000393141
ILTNCIFMTMNNPPDWTKNVEYTFTGIYTFESLVKILARGFCVGEFTFLRDPWNWLDFVVIVFAYVTEFVDLGNVSALRTFRVLRALKTISVIPGLKTIVGALIQSVKKLSDVMILTVFCLSVFALIGLQLFMGNLKHKCFRNSLENNETLESIMNTLESEEDFRKYFYYLEGSKDALLCGFSTDSGQCPEGYTCVKIGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIRRSRIMGLSESSSETSKLSSKSAKERRNRRKKKNQKKLSSGEEKGDAEKLSKSESEDSIRRKSFHLGVEGHRRAHEKRLSTPNQSPLSIRGSLFSARRSSRTSLFSFKGRGRDIGSETEFADDEHSIFGDNESRRGSLFVPHRPQERRSSNISQASRSPPMLPVNGKMHSAVDCNGVVSLVDGRSALMLPNGQLLPEVIIDKATSDDSGTTNQIHKKRRCSSYL

SEQ ID NO: 80238 - protein, 528 aa, Homo sapiens
  Payload ID: 15997
  Gene Symbol: SCN9A
  Gene Name: sodium channel, voltage gated, type IX alpha subunit
  ENSP ID: ENSP00000413212
ILTNCIFMTMNNPPDWTKNVEYTFTGIYTFESLVKILARGFCVGEFTFLRDPWNWLDFVVIVFAYVTEFVDLGNVSALRTFRVLRALKTISVIPGLKTIVGALIQSVKKLSDVMILTVFCLSVFALIGLQLFMGNLKHKCFRNSLENNETLESIMNTLESEEDFRKYFYYLEGSKDALLCGFSTDSGQCPEGYTCVKIGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIRRSRIMGLSESSSETSKLSSKSAKERRNRRKKKNQKKLSSGEEKGDAEKLSKSESEDSIRRKSFHLGVEGHRRAHEKRLSTPNQSPLSIRGSLFSARRSSRTSLFSFKGRGRDIGSETEFADDEHSIFGDNESRRGSLFVPHRPQERRSSNISQASRSPPMLPVNGKMHSAVDCNGVVSLVDGRSALMLPNGQLLPEGTTNQIHKKRRCSSYL

SEQ ID NO: 80239 - protein, 2016 aa, Homo sapiens [sequence omitted]

SEQ ID NO: 80240 - protein, 65 aa, Homo sapiens
  Payload ID: 15998
  Gene Symbol: SCN5A
  Gene Name: sodium channel, voltage gated, type V alpha subunit
  ENSP ID: ENSP00000333674
MANFLLPRGTSSFRRFTRESLAAIEKRMAEKQARGSTTLQESREGLPEEEAPRPQLDLQASKKLP

SEQ ID NO: 80241 - protein, 1962 aa, Homo sapiens
  Payload ID: 15998
  Gene Symbol: SCN5A
  Gene Name: sodium channel, voltage gated, type V alpha subunit
  ENSP ID: ENSP00000388797
MANFLLPRGTSSFRRFTRESLAAIEKRMAEKQARGSTTLQESREGLPEEEAPRPQLDLQASKKLPDLYGNPPQELIGEPLEDLDPFYSTQKTFIVLNKGKTIFRFSATNALYVLSPFHPIRRAAVKILVHSLFNMLIMCTILTNCVFMAQHDPPPWTKYVEYTFTAIYTFESLVKILARGFCLHAFTFLRDPWNWLDFSVIIMAYVSENIKLGNLSALRTFRVLRALKTISVIPGLKTIVGALIQSVKKLADVMVLTVFCLSVFALIGLQLFMGNLRHKCVRNFTALNGTNGSVEADGLVWESLDLYLSDPENYLLKNGTSDVLLCGNSSDAGTCPEGYRCLKAGENPDHGYTSFDSFAWAFLALFRLMTQDCWERLYQQTLRSAGKIYMIFFMLVIFLGSFYLVNLILAVVAMAYEEQNQATIAETEEKEKRFQEAMEMLKKEHEALTIRGVDTVSRSSLEMSPLAPVNSHERRSKRRKRMSSGTEECGEDRLPKSDSEDGPRAMNHLSLTRGLSRTSMKPRSSRGSIFTFRRRDLGSEADFADDENSTAGESESHHTSLLVPWPLRRTSAQGQPSPGTSAPGHALHGKKNSTVDCNGVVSLLGAGDPEATSPGSHLLRPVMLEHPPDTTTPSEEPGGPQMLTSQAPCVDGFEEPGARQRALSAVSVLTSALEELEESRHKCPPCWNRLAQRYLIWECCPLWMSIKQGVKLVVMDPFTDLTITMCIVLNTLFMALEHYNMTSEFEEMLQVGNLVFTGIFTAEMTFKIIALDPYYYFQQGWNIFDSIIVILSLMELGLSRMSNLSVLRSFRLLRVFKLAKSWPTLNTLIKIIGNSVGALGNLTLVLAIIVFIFAVVGMQLFGKNYSELRDSDSGLLPRWHMMDFFHAFLIIFRILCGEWIETMWDCMEVSGQSLCLLVFLLVMVIGNLVVLNLFLALLLSSFSADNLTAPDEDREMNNLQLALARIQRGLRFVKRTTWDFCCGLLRQRPQKPAALAAQGQLPSCIATPYSPPPPETEKVPPTRKETRFEEGEQPGQGTPGDPEPVCVPIAVAESDTDDQEEDEENSLGTEEESSKQTPEDSCSEGSTADMTNTAELLEQIPDLGQDVKDPEDCFTEGCVRRCPCCAVDTTQAPGKVWWRLRKTCYHIVEHSWFETFIIFMILLSSGALAFEDIYLEERKTIKVLLEYADKMFTYVFVLEMLLKWVAYGFKKYFTNAWCWLDFLIVDVSLVSLVANTLGFAEMGPIKSLRTLRALRPLRALSRFEGMRVVVNALVGAIPSIMNVLLVCLIFWLIFSIMGVNLFAGKFGRCINQTEGDLPLNYTIVNNKSQCESLNLTGELYWTKVKVNFDNVGAGYLALLQVATFKGWMDIMYAAVDSRGYEEQPQWEYNLYMYIYFVIFIIFGSFFTLNLFIGVIIDNFNQQKKKLGGQDIFMTEEQKKYYNAMKKLGSKKPQKPIPRPLNKYQGFIFDIVTKQAFDVTIMFLICLNMVTMMVETDDQSPEKINILAKINLLFVAIFTGECIVKLAALRHYYFTNSWNIFDFVVVILSIVGTVLSDIIQKYFFSPTLFRVIRLARIGRILRLIRGAKGIRTLLFALMMSLPALFNIGLLLFLVMFIYSIFGMANFAYVKWEAGIDDMFNFQTFANSMLCLFQITTSAGWDGLLSPILNTGPPYCDPTLPNSNGSRGDCGSPAVGILFFTTYIIISFLIVVNMYIAIILENFSVATEESTEPLSEDDFDMFYEIWEKFDPEATQFIEYSVLSDFADALSEPLRIAKPNQISLINMDLPMVSGDRIHCMDILFAFTKRVLGESGEMDALKIQMEEKFMAANPSKISYEPITTTLRRKHEEVSAMVIQRAFRRHLLQRSLKHASFLFRQQAGSGLSEEDAPEREGLIAYVMSENFSRPLGPPSSSSISSTSFPPSYDSVTRATSDNLQVRGSDYSHSEDLADFPPSPDRDRESIV

SEQ ID NO: 80242 - protein, 2015 aa, Homo sapiens [sequence omitted]

SEQ ID NO: 80243 - protein, 1998 aa, Homo sapiens
  Payload ID: 15998
  Gene Symbol: SCN5A
  Gene Name: sodium channel, voltage gated, type V alpha subunit
  ENSP ID: ENSP00000398962
MANFLLPRGTSSFRRFTRESLAAIEKRMAEKQARGSTTLQESREGLPEEEAPRPQLDLQASKKLPDLYGNPPQELIGEPLEDLDPFYSTQKTFIVLNKGKTIFRFSATNALYVLSPFHPIRRAAVKILVHSLFNMLIMCTILTNCVFMAQHDPPPWTKYVEYTFTAIYTFESLVKILARGFCLHAFTFLRDPWNWLDFSVIIMAYVSENIKLGNLSALRTFRVLRALKTISVIPGLKTIVGALIQSVKKLADVMVLTVFCLSVFALIGLQLFMGNLRHKCVRNFTALNGTNGSVEADGLVWESLDLYLSDPENYLLKNGTSDVLLCGNSSDAGTCPEGYRCLKAGENPDHGYTSFDSFAWAFLALFRLMTQDCWERLYQQTLRSAGKIYMIFFMLVIFLGSFYLVNLILAVVAMAYEEQNQATIAETEEKEKRFQEAMEMLKKEHEALTIRGVDTVSRSSLEMSPLAPVNSHERRSKRRKRMSSGTEECGEDRLPKSDSEDGPRAMNHLSLTRGLSRTSMKPRSSRGSIFTFRRRDLGSEADFADDENSTAGESESHHTSLLVPWPLRRTSAQGQPSPGTSAPGHALHGKKNSTVDCNGVVSLLGAGDPEATSPGSHLLRPVMLEHPPDTTTPSEEPGGPQMLTSQAPCVDGFEEPGARQRALSAVSVLTSALEELEESRHKCPPCWNRLAQRYLIWECCPLWMSIKQGVKLVVMDPFTDLTITMCIVLNTLFMALEHYNMTSEFEEMLQVGNLVFTGIFTAEMTFKIIALDPYYYFQQGWNIFDSIIVILSLMELGLSRMSNLSVLRSFRLLRVFKLAKSWPTLNTLIKIIGNSVGALGNLTLVLAIIVFIFAVVGMQLFGKNYSELRDSDSGLLPRWHMMDFFHAFLIIFRILCGEWIETMWDCMEVSGQSLCLLVFLLVMVIGNLVVLNLFLALLLSSFSADNLTAPDEDREMNNLQLALARIQRGLRFVKRTTWDFCCGLLRQRPQKPAALAAQGQLPSCIATPYSPPPPETEKVPPTRKETRFEEGEQPGQGTPGDPEPVCVPIAVAESDTDDQEEDEENSLGTEEESSKQQESQPVSGGPEAPPDSRTWSQVSATASSEAEASASQADWRQQWKAEPQAPGCGETPEDSCSEGSTADMTNTAELLEQIPDLGQDVKDPEDCFTEGCVRRCPCCAVDTTQAPGKVWWRLRKTCYHIVEHSWFETFIIFMILLSSGALAFEDIYLEERKTIKVLLEYADKMFTYVFVLEMLLKWVAYGFKKYFTNAWCWLDFLIVDVSLVSLVANTLGFAEMGPIKSLRTLRALRPLRALSRFEGMRVVVNALVGAIPSIMNVLLVCLIFWLIFSIMGVNLFAGKFGRCINQTEGDLPLNYTIVNNKSQCESLNLTGELYWTKVKVNFDNVGAGYLALLQVYEEQPQWEYNLYMYIYFVIFIIFGSFFTLNLFIGVIIDNFNQQKKKLGGQDIFMTEEQKKYYNAMKKLGSKKPQKPIPRPLNKYQGFIFDIVTKQAFDVTIMFLICLNMVTMMVETDDQSPEKINILAKINLLFVAIFTGECIVKLAALRHYYFTNSWNIFDFVVVILSIVGTVLSDIIQKYFFSPTLFRVIRLARIGRILRLIRGAKGIRTLLFALMMSLPALFNIGLLLFLVMFIYSIFGMANFAYVKWEAGIDDMFNFQTFANSMLCLFQITTSAGWDGLLSPILNTGPPYCDPTLPNSNGSRGDCGSPAVGILFFTTYIIISFLIVVNMYIAIILENFSVATEESTEPLSEDDFDMFYEIWEKFDPEATQFIEYSVLSDFADALSEPLRIAKPNQISLINMDLPMVSGDRIHCMDILFAFTKRVLGESGEMDALKIQMEEKFMAANPSKISYEPITTTLRRKHEEVSAMVIQRAFRRHLLQRSLKHASFLFRQQAGSGLSEEDAPEREGLIAYVMSENFSRPLGPPSSSSISSTSFPPSYDSVTRATSDNLQVRGSDYSHSEDLADFPPSPDRDRESIV

SEQ ID NO: 80244 - protein, 1983 aa, Homo sapiens
  Payload ID: 15998
  Gene Symbol: SCN5A
  Gene Name: sodium channel, voltage gated, type V alpha subunit
  ENSP ID: ENSP00000399524
MANFLLPRGTSSFRRFTRESLAAIEKRMAEKQARGSTTLQESREGLPEEEAPRPQLDLQASKKLPDLYGNPPQELIGEPLEDLDPFYSTQKTFIVLNKGKTIFRFSATNALYVLSPFHPIRRAAVKILVHSLFNMLIMCTILTNCVFMAQHDPPPWTKYVEYTFTAIYTFESLVKILARGFCLHAFTFLRDPWNWLDFSVIIMAYVSENIKLGNLSALRTFRVLRALKTISVIPGLKTIVGALIQSVKKLADVMVLTVFCLSVFALIGLQLFMGNLRHKCVRNFTALNGTNGSVEADGLVWESLDLYLSDPENYLLKNGTSDVLLCGNSSDAGTCPEGYRCLKAGENPDHGYTSFDSFAWAFLALFRLMTQDCWERLYQQTLRSAGKIYMIFFMLVIFLGSFYLVNLILAVVAMAYEEQNQATIAETEEKEKRFQEAMEMLKKEHEALTIRGVDTVSRSSLEMSPLAPVNSHERRSKRRKRMSSGTEECGEDRLPKSDSEDGPRAMNHLSLTRGLSRTSMKPRSSRGSIFTFRRRDLGSEADFADDENSTAGESESHHTSLLVPWPLRRTSAQGQPSPGTSAPGHALHGKKNSTVDCNGVVSLLGAGDPEATSPGSHLLRPVMLEHPPDTTTPSEEPGGPQMLTSQAPCVDGFEEPGARQRALSAVSVLTSALEELEESRHKCPPCWNRLAQRYLIWECCPLWMSIKQGVKLVVMDPFTDLTITMCIVLNTLFMALEHYNMTSEFEEMLQVGNLVFTGIFTAEMTFKIIALDPYYYFQQGWNIFDSIIVILSLMELGLSRMSNLSVLRSFRLLRVFKLAKSWPTLNTLIKIIGNSVGALGNLTLVLAIIVFIFAVVGMQLFGKNYSELRDSDSGLLPRWHMMDFFHAFLIIFRILCGEWIETMWDCMEVSGQSLCLLVFLLVMVIGNLVVLNLFLALLLSSFSADNLTAPDEDREMNNLQLALARIQRGLRFVKRTTWDFCCGLLRQRPQKPAALAAQGQLPSCIATPYSPPPPETEKVPPTRKETRFEEGEQPGQGTPGDPEPVCVPIAVAESDTDDQEEDEENSLGTEEESSKQESQPVSGGPEAPPDSRTWSQVSATASSEAEASASQADWRQQWKAEPQAPGCGETPEDSCSEGSTADMTNTAELLEQIPDLGQDVKDPEDCFTEGCVRRCPCCAVDTTQAPGKVWWRLRKTCYHIVEHSWFETFIIFMILLSSGALAFEDIYLEERKTIKVLLEYADKMFTYVFVLEMLLKWVAYGFKKYFTNAWCWLDFLIVDVSLVSLVANTLGFAEMGPIKSLRTLRALRPLRALSRFEGMRVVVNALVGAIPSIMNVLLVCLIFWLIFSIMGVNLFAGKFGRCINQTEGDLPLNYTIVNNKSQCESLNLTGELYWTKVKVNFDNVGAGYLALLQVATFKGWMDIMYAAVDSRGYEEQPQWEYNLYMYIYFVIFIIFGSFFTLNLFIGVIIDNFNQQKKKLGGQDIFMTEEQKKYYNAMKKLGSKKPQKPIPRPLNKYQGFIFDIVTKQAFDVTIMFLICLNMVTMMVETDDQSPEKINILAKINLLFVAIFTGTVLSDIIQKYFFSPTLFRVIRLARIGRILRLIRGAKGIRTLLFALMMSLPALFNIGLLLFLVMFIYSIFGMANFAYVKWEAGIDDMFNFQTFANSMLCLFQITTSAGWDGLLSPILNTGPPYCDPTLPNSNGSRGDCGSPAVGILFFTTYIIISFLIVVNMYIAIILENFSVATEESTEPLSEDDFDMFYEIWEKFDPEATQFIEYSVLSDFADALSEPLRIAKPNQISLINMDLPMVSGDRIHCMDILFAFTKRVLGESGEMDALKIQMEEKFMAANPSKISYEPITTTLRRKHEEVSAMVIQRAFRRHLLQRSLKHASFLFRQQAGSGLSEEDAPEREGLIAYVMSENFSRPLGPPSSSSISSTSFPPSYDSVTRATSDNLQVRGSDYSHSEDLADFPPSPDRDRESIV

SEQ ID NO: 80245 - protein, 1962 aa, Homo sapiens; identical to SEQ ID NO: 80241
  Payload ID: 15998
  Gene Symbol: SCN5A
  Gene Name: sodium channel, voltage gated, type V alpha subunit
  ENSP ID: ENSP00000403355

SEQ ID NO: 80246 - protein, 2016 aa, Homo sapiens
  Payload ID: 15998
  Gene Symbol: SCN5A
  Gene Name: sodium channel, voltage gated, type V alpha subunit
  ENSP ID: ENSP00000410257
MANFLLPRGTSSFRRFTRESLAAIEKRMAEKQARGSTTLQESREGLPEEEAPRPQLDLQASKKLPDLYGNPPQELIGEPLEDLDPFYSTQKTFIVLNKGKTIFRFSATNALYVLSPFHPIRRAAVKILVHSLFNMLIMCTILTNCVFMAQHDPPPWTKYVEYTFTAIYTFESLVKILARGFCLHAFTFLRDPWNWLDFSVIIMAYVSENIKLGNLSALRTFRVLRALKTISVIPGLKTIVGALIQSVKKLADVMVLTVFCLSVFALIGLQLFMGNLRHKCVRNFTALNGTNGSVEADGLVWESLDLYLSDPENYLLKNGTSDVLLCGNSSDAGTCPEGYRCLKAGENPDHGYTSFDSFAWAFLALFRLMTQDCWERLYQQTLRSAGKIYMIFFMLVIFLGSFYLVNLILAVVAMAYEEQNQATIAETEEKEKRFQEAMEMLKKEHEALTIRGVDTVSRSSLEMSPLAPVNSHERRSKRRKRMSSGTEECGEDRLPKSDSEDGPRAMNHLSLTRGLSRTSMKPRSSRGSIFTFRRRDLGSEADFADDENSTAGESESHHTSLLVPWPLRRTSAQGQPSPGTSAPGHALHGKKNSTVDCNGVVSLLGAGDPEATSPGSHLLRPVMLEHPPDTTTPSEEPGGPQMLTSQAPCVDGFEEPGARQRALSAVSVLTSALEELEESRHKCPPCWNRLAQRYLIWECCPLWMSIKQGVKLVVMDPFTDLTITMCIVLNTLFMALEHYNMTSEFEEMLQVGNLVFTGIFTAEMTFKIIALDPYYYFQQGWNIFDSIIVILSLMELGLSRMSNLSVLRSFRLLRVFKLAKSWPTLNTLIKIIGNSVGALGNLTLVLAIIVFIFAVVGMQLFGKNYSELRDSDSGLLPRWHMMDFFHAFLIIFRILCGEWIETMWDCMEVSGQSLCLLVFLLVMVIGNLVVLNLFLALLLSSFSADNLTAPDEDREMNNLQLALARIQRGLRFVKRTTWDFCCGLLRQRPQKPAALAAQGQLPSCIATPYSPPPPETEKVPPTRKETRFEEGEQPGQGTPGDPEPVCVPIAVAESDTDDQEEDEENSLGTEEESSKQQESQPVSGGPEAPPDSRTWSQVSATASSEAEASASQADWRQQWKAEPQAPGCGETPEDSCSEGSTADMTNTAELLEQIPDLGQDVKDPEDCFTEGCVRRCPCCAVDTTQAPGKVWWRLRKTCYHIVEHSWFETFIIFMILLSSGALAFEDIYLEERKTIKVLLEYADKMFTYVFVLEMLLKWVAYGFKKYFTNAWCWLDFLIVDVSLVSLVANTLGFAEMGPIKSLRTLRALRPLRALSRFEGMRVVVNALVGAIPSIMNVLLVCLIFWLIFSIMGVNLFAGKFGRCINQTEGDLPLNYTIVNNKSQCESLNLTGELYWTKVKVNFDNVGAGYLALLQVATFKGWMDIMYAAVDSRGYEEQPQWEYNLYMYIYFVIFIIFGSFFTLNLFIGVIIDNFNQQKKKLGGQDIFMTEEQKKYYNAMKKLGSKKPQKPIPRPLNKYQGFIFDIVTKQAFDVTIMFLICLNMVTMMVETDDQSPEKINILAKINLLFVAIFTGECIVKLAALRHYYFTNSWNIFDFVVVILSIVGTVLSDIIQKYFFSPTLFRVIRLARIGRILRLIRGAKGIRTLLFALMMSLPALFNIGLLLFLVMFIYSIFGMANFAYVKWEAGIDDMFNFQTFANSMLCLFQITTSAGWDGLLSPILNTGPPYCDPTLPNSNGSRGDCGSPAVGILFFTTYIIISFLIVVNMYIAIILENFSVATEESTEPLSEDDFDMFYEIWEKFDPEATQFIEYSVLSDFADALSEPLRIAKPNQISLINMDLPMVSGDRIHCMDILFAFTKRVLGESGEMDALKIQMEEKFMAANPSKISYEPITTTLRRKHEEVSAMVIQRAFRRHLLQRSLKHASFLFRQQAGSGLSEEDAPEREGLIAYVMSENFSRPLGPPSSSSISSTSFPPSYDSVTRATSDNLQVRGSDYSHSEDLADFPPSPDRDRESIV

SEQ ID NO: 80247 - protein, 1962 aa, Homo sapiens
  Payload ID: 15998
  Gene Symbol: SCN5A
  Gene Name: sodium channel, voltage gated, type V alpha subunit
  ENSP ID: ENSP00000413996
MANFLLPRGTSSFRRFTRESLAAIEKRMAEKQARGSTTLQESREGLPEEEAPRPQLDLQASKKLPDLYGNPPQELIGEPLEDLDPFYSTQKTFIVLNKGKTIFRFSATNALYVLSPFHPIRRAAVKILVHSLFNMLIMCTILTNCVFMAQHDPPPWTKYVEYTFTAIYTFESLVKILARGFCLHAFTFLRDPWNWLDFSVIIMAYTTEFVDLGNVSALRTFRVLRALKTISVISGLKTIVGALIQSVKKLADVMVLTVFCLSVFALIGLQLFMGNLRHKCVRNFTALNGTNGSVEADGLVWESLDLYLSDPENYLLKNGTSDVLLCGNSSDAGTCPEGYRCLKAGENPDHGYTSFDSFAWAFLALFRLMTQDCWERLYQQTLRSAGKIYMIFFMLVIFLGSFYLVNLILAVVAMAYEEQNQATIAETEEKEKRFQEAMEMLKKEHEALTIRGVDTVSRSSLEMSPLAPVNSHERRSKRRKRMSSGTEECGEDRLPKSDSEDGPRAMNHLSLTRGLSRTSMKPRSSRGSIFTFRRRDLGSEADFADDENSTAGESESHHTSLLVPWPLRRTSAQGQPSPGTSAPGHALHGKKNSTVDCNGVVSLLGAGDPEATSPGSHLLRPVMLEHPPDTTTPSEEPGGPQMLTSQAPCVDGFEEPGARQRALSAVSVLTSALEELEESRHKCPPCWNRLAQRYLIWECCPLWMSIKQGVKLVVMDPFTDLTITMCIVLNTLFMALEHYNMTSEFEEMLQVGNLVFTGIFTAEMTFKIIALDPYYYFQQGWNIFDSIIVILSLMELGLSRMSNLSVLRSFRLLRVFKLAKSWPTLNTLIKIIGNSVGALGNLTLVLAIIVFIFAVVGMQLFGKNYSELRDSDSGLLPRWHMMDFFHAFLIIFRILCGEWIETMWDCMEVSGQSLCLLVFLLVMVIGNLVVLNLFLALLLSSFSADNLTAPDEDREMNNLQLALARIQRGLRFVKRTTWDFCCGLLRQRPQKPAALAAQGQLPSCIATPYSPPPPETEKVPPTRKETRFEEGEQPGQGTPGDPEPVCVPIAVAESDTDDQEEDEENSLGTEEESSKQTPEDSCSEGSTADMTNTAELLEQIPDLGQDVKDPEDCFTEGCVRRCPCCAVDTTQAPGKVWWRLRKTCYHIVEHSWFETFIIFMILLSSGALAFEDIYLEERKTIKVLLEYADKMFTYVFVLEMLLKWVAYGFKKYFTNAWCWLDFLIVDVSLVSLVANTLGFAEMGPIKSLRTLRALRPLRALSRFEGMRVVVNALVGAIPSIMNVLLVCLIFWLIFSIMGVNLFAGKFGRCINQTEGDLPLNYTIVNNKSQCESLNLTGELYWTKVKVNFDNVGAGYLALLQVATFKGWMDIMYAAVDSRGYEEQPQWEYNLYMYIYFVIFIIFGSFFTLNLFIGVIIDNFNQQKKKLGGQDIFMTEEQKKYYNAMKKLGSKKPQKPIPRPLNKYQGFIFDIVTKQAFDVTIMFLICLNMVTMMVETDDQSPEKINILAKINLLFVAIFTGECIVKLAALRHYYFTNSWNIFDFVVVILSIVGTVLSDIIQKYFFSPTLFRVIRLARIGRILRLIRGAKGIRTLLFALMMSLPALFNIGLLLFLVMFIYSIFGMANFAYVKWEAGIDDMFNFQTFANSMLCLFQITTSAGWDGLLSPILNTGPPYCDPTLPNSNGSRGDCGSPAVGILFFTTYIIISFLIVVNMYIAIILENFSVATEESTEPLSEDDFDMFYEIWEKFDPEATQFIEYSVLSDFADALSEPLRIAKPNQISLINMDLPMVSGDRIHCMDILFAFTKRVLGESGEMDALKIQMEEKFMAANPSKISYEPITTTLRRKHEEVSAMVIQRAFRRHLLQRSLKHASFLFRQQAGSGLSEEDAPEREGLIAYVMSENFSRPLGPPSSSSISSTSFPPSYDSVTRATSDNLQVRGSDYSHSEDLADFPPSPDRDRESIV

SEQ ID NO: 80248 - protein, 1998 aa, Homo sapiens; identical to SEQ ID NO: 80243
  Payload ID: 15998
  Gene Symbol: SCN5A
  Gene Name: sodium channel, voltage gated, type V alpha subunit
  ENSP ID: ENSP00000416634

SEQ ID NO: 80249 - protein, 223 aa, Homo sapiens
  Payload ID: 15998
  Gene Symbol: SCN5A
  Gene Name: sodium channel, voltage gated, type V alpha subunit
  ENSP ID: ENSP00000479016
MANFLLPRGTSSFRRFTRESLAAIEKRMAEKQARGSTTLQESREGLPEEEAPRPQLDLQASKKLPDLYGNPPQELIGEPLEDLDPFYSTQKTFIVLNKGKTIFRFSATNALYVLSPFHPIRRAAVKILVHSLFNMLIMCTILTNCVFMAQHDPPPWTKYVEYTFTAIYTFESLVKILARGFCLHAFTFLRDPWNWLDFSVIIMAASVLGTLFFPMSIQATSTS

SEQ ID NO: 80250 - protein, 1682 aa, Homo sapiens
  Payload ID: 15999
  Gene Symbol: SCN7A
  Gene Name: sodium channel, voltage gated, type VII alpha subunit
  Uniprot ID: Q01118
  ENSP ID: ENSP00000386796
MLASPEPKGLVPFTKESFELIKQHIAKTHNEDHEEEDLKPTPDLEVGKKLPFIYGNLSQGMVSEPLEDVDPYYYKKKNTFIVLNKNRTIFRFNAASILCTLSPFNCIRRTTIKVLVHPFFQLFILISVLIDCVFMSLTNLPKWRPVLENTLLGIYTFEILVKLFARGVWAGSFSFLGDPWNWLDFSVTVFEVIIRYSPLDFIPTLQTARTLRILKIIPLNQGLKSLVGVLIHCLKQLIGVIILTLFFLSIFSLIGMGLFMGNLKHKCFRWPQENENETLHNRTGNPYYIRETENFYYLEGERYALLCGNRTDAGQCPEGYVCVKAGINPDQGFTNFDSFGWALFALFRLMAQDYPEVLYHQILYASGKVYMIFFVVVSFLFSFYMASLFLGILAMAYEEEKQRVGEISKKIEPKFQQTGKELQEGNETDEAKTIQIEMKKRSPISTDTSLDVLEDATLRHKEELEKSKKICPLYWYKFAKTFLIWNCSPCWLKLKEFVHRIIMAPFTDLFLIICIILNVCFLTLEHYPMSKQTNTLLNIGNLVFIGIFTAEMIFKIIAMHPYGYFQVGWNIFDSMIVFHGLIELCLANVAGMALLRLFRMLRIFKLGKYWPTFQILMWSLSNSWVALKDLVLLLFTFIFFSAAFGMKLFGKNYEEFVCHIDKDCQLPRWHMHDFFHSFLNVFRILCGEWVETLWDCMEVAGQSWCIPFYLMVILIGNLLVLYLFLALVSSFSSCKDVTAEENNEAKNLQLAVARIKKGINYVLLKILCKTQNVPKDTMDHVNEVYVKEDISDHTLSELSNTQDFLKDKEKSSGTEKNATENESQSLIPSPSVSETVPIASGESDIENLDNKEIQSKSGDGGSKEKIKQSSSSECSTVDIAISEEEEMFYGGERSKHLKNGCRRGSSLGQISGASKKGKIWQNIRKTCCKIVENNWFKCFIGLVTLLSTGTLAFEDIYMDQRKTIKILLEYADMIFTYIFILEMLLKWMAYGFKAYFSNGWYRLDFVVVIVFCLSLIGKTREELKPLISMKFLRPLRVLSQFERMKVVVRALIKTTLPTLNVFLVCLMIWLIFSIMGVDLFAGRFYECIDPTSGERFPSSEVMNKSRCESLLFNESMLWENAKMNFDNVGNGFLSLLQVATFNGWITIMNSAIDSVAVNIQPHFEVNIYMYCYFINFIIFGVFLPLSMLITVIIDNFNKHKIKLGGSNIFITVKQRKQYRRLKKLMYEDSQRPVPRPLNKLQGFIFDVVTSQAFNVIVMVLICFQAIAMMIDTDVQSLQMSIALYWINSIFVMLYTMECILKLIAFRCFYFTIAWNIFDFMVVIFSITGLCLPMTVGSYLVPPSLVQLILLSRIIHMLRLGKGPKVFHNLMLPLMLSLPALLNIILLIFLVMFIYAVFGMYNFAYVKKEAGINDVSNFETFGNSMLCLFQVAIFAGWDGMLDAIFNSKWSDCDPDKINPGTQVRGDCGNPSVGIFYFVSYILISWLIIVNMYIVVVMEFLNIASKKKNKTLSEDDFRKFFQVWKRFDPDRTQYIDSSKLSDFAAALDPPLFMAKPNKGQLIALDLPMAVGDRIHCLDILLAFTKRVMGQDVRMEKVVSEIESGFLLANPFKITCEPITTTLKRKQEAVSATIIQRAYKNYRLRRNDKNTSDIHMIDGDRDVHATKEGAYFDKAKEKSPIQSQI

SEQ ID NO: 80251 - protein, 762 aa, Homo sapiens
  Payload ID: 15999
  Gene Symbol: SCN7A
  Gene Name: sodium channel, voltage gated, type VII alpha subunit
  ENSP ID: ENSP00000396600
MLASPEPKGLVPFTKESFELIKQHIAKTHNEDHEEEDLKPTPDLEVGKKLPFIYGNLSQGMVSEPLEDVDPYYYKKKNTFIVLNKNRTIFRFNAASILCTLSPFNCIRRTTIKVLVHPFFQLFILISVLIDCVFMSLTNLPKWRPVLENTLLGIYTFEILVKLFARGVWAGSFSFLGDPWNWLDFSVTVFEVIIRYSPLDFIPTLQTARTLRILKIIPLNQGLKSLVGVLIHCLKQLIGVIILTLFFLSIFSLIGMGLFMGNLKHKCFRWPQENENETLHNRTGNPYYIRETENFYYLEGERYALLCGNRTDAGQCPEGYVCVKAGINPDQGFTNFDSFGWALFALFRLMAQDYPEVLYHQILYASGKVYMIFFVVVSFLFSFYMASLFLGILAMAYEEEKQRVGEISKKIEPKFQQTGKELQEGNETDEAKTIQIEMKKRSPISTDTSLDVLEDATLRHKEELEKSKKICPLYWYKFAKTFLIWNCSPCWLKLKEFVHRIIMAPFTDLFLIICIILNVCFLTLEHYPMSKQTNTLLNIGNLVFIGIFTAEMIFKIIAMHPYGYFQVGWNIFDSMIVFHGLIELCLANVAGMALLRLFRMLRIFKLGKYWPTFQILMWSLSNSWVALKDLVLLLFTFIFFSAAFGMKLFGKNYEEFVCHIDKDCQLPRWHMHDFFHSFLNVFRILCGEWVETLWDCMEVAGQSWCIPFYLMVILIGNLLGLGGLRKLTITVEEEAGMSFTLQQQGEVQSEGTLPVSGIGELI

SEQ ID NO: 80252 - protein, 402 aa, Homo sapiens
  Payload ID: 15999
  Gene Symbol: SCN7A
  Gene Name: sodium channel, voltage gated, type VII alpha subunit
  ENSP ID: ENSP00000403846
MLASPEPKGLVPFTKESFELIKQHIAKTHNEDHEEEDLKPTPDLEVGKKLPFIYGNLSQGMVSEPLEDVDPYYYKKKNTFIVLNKNRTIFRFNAASILCTLSPFNCIRRTTIKVLVHPFFQLFILISVLIDCVFMSLTNLPKWRPVLENTLLGIYTFEILVKLFARGVWAGSFSFLGDPWNWLDFSVTVFEVIIRYSPLDFIPTLQTARTLRILKIIPLNQGLKSLVGVLIHCLKQLIGVIILTLFFLSIFSLIGMGLFMGNLKHKCFRWPQENENETLHNRTGNPYYIRETENFYYLEGERYALLCGNRTDAGQCPEGYVCVKAGINPDQGFTNFDSFGWALFALFRLMAQDYPEVLYHQILYASGKVYMIFFVVVSFLFSFYMASLFLGILAMAYEEEKQ

SEQ ID NO: 80253 - protein, 863 aa, Homo sapiens
  Payload ID: 15999
  Gene Symbol: SCN7A
  Gene Name: sodium channel, voltage gated, type VII alpha subunit
  ENSP ID: ENSP00000413699
MLASPEPKGLVPFTKESFELIKQHIAKTHNEDHEEEDLKPTPDLEVGKKLPFIYGNLSQGMVSEPLEDVDPYYYKKKNTFIVLNKNRTIFRFNAASILCTLSPFNCIRRTTIKVLVHPFFQLFILISVLIDCVFMSLTNLPKWRPVLENTLLGIYTFEILVKLFARGVWAGSFSFLGDPWNWLDFSVTVFEVIIRYSPLDFIPTLQTARTLRILKIIPLNQGLKSLVGVLIHCLKQLIGVIILTLFFLSIFSLIGMGLFMGNLKHKCFRWPQENENETLHNRTGNPYYIRETENFYYLEGERYALLCGNRTDAGQCPEGYVCVKAGINPDQGFTNFDSFGWALFALFRLMAQDYPEVLYHQILYASGKVYMIFFVVVSFLFSFYMASLFLGILAMAYEEEKQRVGEISKKIEPKFQQTGKELQEGNETDEAKTIQIEMKKRSPISTDTSLDVLEDATLRHKEELEKSKKICPLYWYKFAKTFLIWNCSPCWLKLKEFVHRIIMAPFTDLFLIICIILNVCFLTLEHYPMSKQTNTLLNIGNLVFIGIFTAEMIFKIIAMHPYGYFQVGWNIFDSMIVFHGLIELCLANVAGMALLRLFRMLRIFKLGKYWPTFQILMWSLSNSWVALKDLVLLLFTFIFFSAAFGMKLFGKNYEEFVCHIDKDCQLPRWHMHDFFHSFLNVFRILCGEWVETLWDCMEVAGQSWCIPFYLMVILIGNLLVLYLFLALVSSFSSCKDVTAEENNEAKNLQLAVARIKKGINYVLLKILCKTQNVPKDTMDHVNEVYVKEDISDHTLSELSNTQDFLKDKEKSSGTEKNATENESQSLIPSPSVSETVPIASGESDIENLDNKEIQSKSGDGGSK

SEQ ID NO: 80254 - protein, 1682 aa, Homo sapiens; identical to SEQ ID NO: 80250
  Payload ID: 15999
  Gene Symbol: SCN7A
  Gene Name: sodium channel, voltage gated, type VII alpha subunit
  Uniprot ID: Q01118
  ENSP ID: ENSP00000478562

SEQ ID NO: 80255 - protein, 1682 aa, Homo sapiens; identical to SEQ ID NO: 80250
  Payload ID: 15999
  Gene Symbol: SCN7A
  Gene Name: sodium channel, voltage gated, type VII alpha subunit
  Uniprot ID: Q01118
  ENSP ID: ENSP00000481734

SEQ ID NO: 80256 - protein, 1980 aa, Homo sapiens
  Payload ID: 16000
  Gene Symbol: SCN8A
  Gene Name: sodium channel, voltage gated, type VIII alpha subunit
  Uniprot ID: Q9UQD0
  ENSP ID: ENSP00000346534
MAARLLAPPGPDSFKPFTPESLANIERRIAESKLKKPPKADGSHREDDEDSKPKPNSDLEAGKSLPFIYGDIPQGLVAVPLEDFDPYYLTQKTFVVLNRGKTLFRFSATPALYILSPFNLIRRIAIKILIHSVFSMIIMCTILTNCVFMTFSNPPDWSKNVEYTFTGIYTFESLVKIIARGFCIDGFTFLRDPWNWLDFSVIMMAYITEFVNLGNVSALRTFRVLRALKTISVIPGLKTIVGALIQSVKKLSDVMILTVFCLSVFALIGLQLFMGNLRNKCVVWPINFNESYLENGTKGFDWEEYINNKTNFYTVPGMLEPLLCGNSSDAGQCPEGYQCMKAGRNPNYGYTSFDTFSWAFLALFRLMTQDYWENLYQLTLRAAGKTYMIFFVLVIFVGSFYLVNLILAVVAMAYEEQNQATLEEAEQKEAEFKAMLEQLKKQQEEAQAAAMATSAGTVSEDAIEEEGEEGGGSPRSSSEISKLSSKSAKERRNRRKKRKQKELSEGEEKGDPEKVFKSESEDGMRRKAFRLPDNRIGRKFSIMNQSLLSIPGSPFLSRHNSKSSIFSFRGPGRFRDPGSENEFADDEHSTVEESEGRRDSLFIPIRARERRSSYSGYSGYSQGSRSSRIFPSLRRSVKRNSTVDCNGVVSLIGGPGSHIGGRLLPEATTEVEIKKKGPGSLLVSMDQLASYGRKDRINSIMSVVTNTLVEELEESQRKCPPCWYKFANTFLIWECHPYWIKLKEIVNLIVMDPFVDLAITICIVLNTLFMAMEHHPMTPQFEHVLAVGNLVFTGIFTAEMFLKLIAMDPYYYFQEGWNIFDGFIVSLSLMELSLADVEGLSVLRSFRLLRVFKLAKSWPTLNMLIKIIGNSVGALGNLTLVLAIIVFIFAVVGMQLFGKSYKECVCKINQDCELPRWHMHDFFHSFLIVFRVLCGEWIETMWDCMEVAGQAMCLIVFMMVMVIGNLVVLNLFLALLLSSFSADNLAATDDDGEMNNLQISVIRIKKGVAWTKLKVHAFMQAHFKQREADEVKPLDELYEKKANCIANHTGADIHRNGDFQKNGNGTTSGIGSSVEKYIIDEDHMSFINNPNLTVRVPIAVGESDFENLNTEDVSSESDPEGSKDKLDDTSSSEGSTIDIKPEVEEVPVEQPEEYLDPDACFTEGCVQRFKCCQVNIEEGLGKSWWILRKTCFLIVEHNWFETFIIFMILLSSGALAFEDIYIEQRKTIRTILEYADKVFTYIFILEMLLKWTAYGFVKFFTNAWCWLDFLIVAVSLVSLIANALGYSELGAIKSLRTLRALRPLRALSRFEGMRVVVNALVGAIPSIMNVLLVCLIFWLIFSIMGVNLFAGKYHYCFNETSEIRFEIEDVNNKTECEKLMEGNNTEIRWKNVKINFDNVGAGYLALLQVATFKGWMDIMYAAVDSRKPDEQPKYEDNIYMYIYFVIFIIFGSFFTLNLFIGVIIDNFNQQKKKFGGQDIFMTEEQKKYYNAMKKLGSKKPQKPIPRPLNKIQGIVFDFVTQQAFDIVIMMLICLNMVTMMVETDTQSKQMENILYWINLVFVIFFTCECVLKMFALRHYYFTIGWNIFDFVVVILSIVGMFLADIIEKYFVSPTLFRVIRLARIGRILRLIKGAKGIRTLLFALMMSLPALFNIGLLLFLVMFIFSIFGMSNFAYVKHEAGIDDMFNFETFGNSMICLFQITTSAGWDGLLLPILNRPPDCSLDKEHPGSGFKGDCGNPSVGIFFFVSYIIISFLIVVNMYIAIILENFSVATEESADPLSEDDFETFYEIWEKFDPDATQFIEYCKLADFADALEHPLRVPKPNTIELIAMDLPMVSGDRIHCLDILFAFTKRVLGDSGELDILRQQMEERFVASNPSKVSYEPITTTLRRKQEEVSAVVLQRAYRGHLARRGFICKKTTSNKLENGGTHREKKESTPSTASLPSYDSVTKPEKEKQQRAEEGRRERAKRQKEVRESKC

SEQ ID NO: 80257 - protein, 1939 aa, Homo sapiens
  Payload ID: 16000
  Gene Symbol: SCN8A
  Gene Name: sodium channel, voltage gated, type VIII alpha subunit
  Uniprot ID: Q9UQD0
  ENSP ID: ENSP00000347255
MAARLLAPPGPDSFKPFTPESLANIERRIAESKLKKPPKADGSHREDDEDSKPKPNSDLEAGKSLPFIYGDIPQGLVAVPLEDFDPYYLTQKTFVVLNRGKTLFRFSATPALYILSPFNLIRRIAIKILIHSVFSMIIMCTILTNCVFMTFSNPPDWSKNVEYTFTGIYTFESLVKIIARGFCIDGFTFLRDPWNWLDFSVIMMAYITEFVNLGNVSALRTFRVLRALKTISVIPGLKTIVGALIQSVKKLSDVMILTVFCLSVFALIGLQLFMGNLRNKCVVWPINFNESYLENGTKGFDWEEYINNKTNFYTVPGMLEPLLCGNSSDAGQCPEGYQCMKAGRNPNYGYTSFDTFSWAFLALFRLMTQDYWENLYQLTLRAAGKTYMIFFVLVIFVGSFYLVNLILAVVAMAYEEQNQATLEEAEQKEAEFKAMLEQLKKQQEEAQAAAMATSAGTVSEDAIEEEGEEGGGSPRSSSEISKLSSKSAKERRNRRKKRKQKELSEGEEKGDPEKVFKSESEDGMRRKAFRLPDNRIGRKFSIMNQSLLSIPGSPFLSRHNSKSSIFSFRGPGRFRDPGSENEFADDEHSTVEESEGRRDSLFIPIRARERRSSYSGYSGYSQGSRSSRIFPSLRRSVKRNSTVDCNGVVSLIGGPGSHIGGRLLPEATTEVEIKKKGPGSLLVSMDQLASYGRKDRINSIMSVVTNTLVEELEESQRKCPPCWYKFANTFLIWECHPYWIKLKEIVNLIVMDPFVDLAITICIVLNTLFMAMEHHPMTPQFEHVLAVGNLVFTGIFTAEMFLKLIAMDPYYYFQEGWNIFDGFIVSLSLMELSLADVEGLSVLRSFRLLRVFKLAKSWPTLNMLIKIIGNSVGALGNLTLVLAIIVFIFAVVGMQLFGKSYKECVCKINQDCELPRWHMHDFFHSFLIVFRVLCGEWIETMWDCMEVAGQAMCLIVFMMVMVIGNLVVLNLFLALLLSSFSADNLAATDDDGEMNNLQISVIRIKKGVAWTKLKVHAFMQAHFKQREADEVKPLDELYEKKANCIANHTGADIHRNGDFQKNGNGTTSGIGSSVEKYIIDEDHMSFINNPNLTVRVPIAVGESDFENLNTEDVSSESDPEGSKDKLDDTSSSEGSTIDIKPEVEEVPVEQPEEYLDPDACFTEGCVQRFKCCQVNIEEGLGKSWWILRKTCFLIVEHNWFETFIIFMILLSSGALAFEDIYIEQRKTIRTILEYADKVFTYIFILEMLLKWTAYGFVKFFTNAWCWLDFLIVAVVVNALVGAIPSIMNVLLVCLIFWLIFSIMGVNLFAGKYHYCFNETSEIRFEIEDVNNKTECEKLMEGNNTEIRWKNVKINFDNVGAGYLALLQVATFKGWMDIMYAAVDSRKPDEQPKYEDNIYMYIYFVIFIIFGSFFTLNLFIGVIIDNFNQQKKKFGGQDIFMTEEQKKYYNAMKKLGSKKPQKPIPRPLNKIQGIVFDFVTQQAFDIVIMMLICLNMVTMMVETDTQSKQMENILYWINLVFVIFFTCECVLKMFALRHYYFTIGWNIFDFVVVILSIVGMFLADIIEKYFVSPTLFRVIRLARIGRILRLIKGAKGIRTLLFALMMSLPALFNIGLLLFLVMFIFSIFGMSNFAYVKHEAGIDDMFNFETFGNSMICLFQITTSAGWDGLLLPILNRPPDCSLDKEHPGSGFKGDCGNPSVGIFFFVSYIIISFLIVVNMYIAIILENFSVATEESADPLSEDDFETFYEIWEKFDPDATQFIEYCKLADFADALEHPLRVPKPNTIELIAMDLPMVSGDRIHCLDILFAFTKRVLGDSGELDILRQQMEERFVASNPSKVSYEPITTTLRRKQEEVSAVVLQRAYRGHLARRGFICKKTTSNKLENGGTHREKKESTPSTASLPSYDSVTKPEKEKQQRAEEGRRERAKRQKEVRESKC

SEQ ID NO: 80258 - protein, 1939 aa, Homo sapiens; identical to SEQ ID NO: 80257
  Payload ID: 16000
  Gene Symbol: SCN8A
  Gene Name: sodium channel, voltage gated, type VIII alpha subunit
  Uniprot ID: Q9UQD0
  ENSP ID: ENSP00000440360

SEQ ID NO: 80259 - protein, 542 aa, Homo sapiens
  Payload ID: 16000
  Gene Symbol: SCN8A
  Gene Name: sodium channel, voltage gated, type VIII alpha subunit
  ENSP ID: ENSP00000447567
FSNPPDWSKNVEYTFTGIYTFESLVKIIARGFCIDGFTFLRDPWNWLDFSVIMMAYVTEFVDLGNVSALRTFRVLRALKTISVIPGLKTIVGALIQSVKKLSDVMILTVFCLSVFALIGLQLFMGNLRNKCVVWPINFNESYLENGTKGFDWEEYINNKTNFYTVPGMLEPLLCGNSSDAGQCPEGYQCMKAGRNPNYGYTSFDTFSWAFLALFRLMTQDYWENLYQLTLRAAGKTYMIFFVLVIFVGSFYLVNLILAVVAMAYEEQNQATLEEAEQKEAEFKAMLEQLKKQQEEAQAAAMATSAGTVSEDAIEEEGEEGGGSPRSSSEISKLSSKSAKERRNRRKKRKQKELSEGEEKGDPEKVFKSESEDGMRRKAFRLPDNRIGRKFSIMNQSLLSIPGSPFLSRHNSKSSIFSFRGPGRFRDPGSENEFADDEHSTVEESEGRRDSLFIPIRARERRSSYSGYSGYSQGSRSSRIFPSLRRSVKRNSTVDCNGVVSLIGGPGSHIGGRLLPEVKIDKAATDDSATTEVEIKKKGPGSL

SEQ ID NO: 80260 - protein, 1991 aa, Homo sapiens
  Payload ID: 16000
  Gene Symbol: SCN8A
  Gene Name: sodium channel, voltage gated, type VIII alpha subunit
  Uniprot ID: Q9UQD0
  ENSP ID: ENSP00000476447
MAARLLAPPGPDSFKPFTPESLANIERRIAESKLKKPPKADGSHREDDEDSKPKPNSDLEAGKSLPFIYGDIPQGLVAVPLEDFDPYYLTQKTFVVLNRGKTLFRFSATPALYILSPFNLIRRIAIKILIHSVFSMIIMCTILTNCVFMTFSNPPDWSKNVEYTFTGIYTFESLVKIIARGFCIDGFTFLRDPWNWLDFSVIMMAYITEFVNLGNVSALRTFRVLRALKTISVIPGLKTIVGALIQSVKKLSDVMILTVFCLSVFALIGLQLFMGNLRNKCVVWPINFNESYLENGTKGFDWEEYINNKTNFYTVPGMLEPLLCGNSSDAGQCPEGYQCMKAGRNPNYGYTSFDTFSWAFLALFRLMTQDYWENLYQLTLRAAGKTYMIFFVLVIFVGSFYLVNLILAVVAMAYEEQNQATLEEAEQKEAEFKAMLEQLKKQQEEAQAAAMATSAGTVSEDAIEEEGEEGGGSPRSSSEISKLSSKSAKERRNRRKKRKQKELSEGEEKGDPEKVFKSESEDGMRRKAFRLPDNRIGRKFSIMNQSLLSIPGSPFLSRHNSKSSIFSFRGPGRFRDPGSENEFADDEHSTVEESEGRRDSLFIPIRARERRSSYSGYSGYSQGSRSSRIFPSLRRSVKRNSTVDCNGVVSLIGGPGSHIGGRLLPEVKIDKAATDDSATTEVEIKKKGPGSLLVSMDQLASYGRKDRINSIMSVVTNTLVEELEESQRKCPPCWYKFANTFLIWECHPYWIKLKEIVNLIVMDPFVDLAITICIVLNTLFMAMEHHPMTPQFEHVLAVGNLVFTGIFTAEMFLKLIAMDPYYYFQEGWNIFDGFIVSLSLMELSLADVEGLSVLRSFRLLRVFKLAKSWPTLNMLIKIIGNSVGALGNLTLVLAIIVFIFAVVGMQLFGKSYKECVCKINQDCELPRWHMHDFFHSFLIVFRVLCGEWIETMWDCMEVAGQAMCLIVFMMVMVIGNLVVLNLFLALLLSSFSADNLAATDDDGEMNNLQISVIRIKKGVAWTKLKVHAFMQAHFKQREADEVKPLDELYEKKANCIANHTGADIHRNGDFQKNGNGTTSGIGSSVEKYIIDEDHMSFINNPNLTVRVPIAVGESDFENLNTEDVSSESDPEGSKDKLDDTSSSEGSTIDIKPEVEEVPVEQPEEYLDPDACFTEGCVQRFKCCQVNIEEGLGKSWWILRKTCFLIVEHNWFETFIIFMILLSSGALAFEDIYIEQRKTIRTILEYADKVFTYIFILEMLLKWTAYGFVKFFTNAWCWLDFLIVAVSLVSLIANALGYSELGAIKSLRTLRALRPLRALSRFEGMRVVVNALVGAIPSIMNVLLVCLIFWLIFSIMGVNLFAGKYHYCFNETSEIRFEIEDVNNKTECEKLMEGNNTEIRWKNVKINFDNVGAGYLALLQVATFKGWMDIMYAAVDSRKPDEQPKYEDNIYMYIYFVIFIIFGSFFTLNLFIGVIIDNFNQQKKKFGGQDIFMTEEQKKYYNAMKKLGSKKPQKPIPRPLNKIQGIVFDFVTQQAFDIVIMMLICLNMVTMMVETDTQSKQMENILYWINLVFVIFFTCECVLKMFALRHYYFTIGWNIFDFVVVILSIVGMFLADIIEKYFVSPTLFRVIRLARIGRILRLIKGAKGIRTLLFALMMSLPALFNIGLLLFLVMFIFSIFGMSNFAYVKHEAGIDDMFNFETFGNSMICLFQITTSAGWDGLLLPILNRPPDCSLDKEHPGSGFKGDCGNPSVGIFFFVSYIIISFLIVVNMYIAIILENFSVATEESADPLSEDDFETFYEIWEKFDPDATQFIEYCKLADFADALEHPLRVPKPNTIELIAMDLPMVSGDRIHCLDILFAFTKRVLGDSGELDILRQQMEERFVASNPSKVSYEPITTTLRRKQEEVSAVVLQRAYRGHLARRGFICKKTTSNKLENGGTHREKKESTPSTASLPSYDSVTKPEKEKQQRAEEGRRERAKRQKEVRESKC

SEQ ID NO: 80261 - protein, 1 aa, Homo sapiens
  Payload ID: 16000
  Gene Symbol: SCN8A
  Gene Name: sodium channel, voltage gated, type VIII alpha subunit
  ENSP ID: ENSP00000486828
M

SEQ ID NO: 80262 - protein, 1980 aa, Homo sapiens
  Payload ID: 16000
  Gene Symbol: SCN8A
  Gene Name: sodium channel, voltage gated, type VIII alpha subunit
  Uniprot ID: Q9UQD0
  ENSP ID: ENSP00000487583
MAARLLAPPGPDSFKPFTPESLANIERRIAESKLKKPPKADGSHREDDEDSKPKPNSDLEAGKSLPFIYGDIPQGLVAVPLEDFDPYYLTQKTFVVLNRGKTLFRFSATPALYILSPFNLIRRIAIKILIHSVFSMIIMCTILTNCVFMTFSNPPDWSKNVEYTFTGIYTFESLVKIIARGFCIDGFTFLRDPWNWLDFSVIMMAYVTEFVDLGNVSALRTFRVLRALKTISVIPGLKTIVGALIQSVKKLSDVMILTVFCLSVFALIGLQLFMGNLRNKCVVWPINFNESYLENGTKGFDWEEYINNKTNFYTVPGMLEPLLCGNSSDAGQCPEGYQCMKAGRNPNYGYTSFDTFSWAFLALFRLMTQDYWENLYQLTLRAAGKTYMIFFVLVIFVGSFYLVNLILAVVAMAYEEQNQATLEEAEQKEAEFKAMLEQLKKQQEEAQAAAMATSAGTVSEDAIEEEGEEGGGSPRSSSEISKLSSKSAKERRNRRKKRKQKELSEGEEKGDPEKVFKSESEDGMRRKAFRLPDNRIGRKFSIMNQSLLSIPGSPFLSRHNSKSSIFSFRGPGRFRDPGSENEFADDEHSTVEESEGRRDSLFIPIRARERRSSYSGYSGYSQGSRSSRIFPSLRRSVKRNSTVDCNGVVSLIGGPGSHIGGRLLPEATTEVEIKKKGPGSLLVSMDQLASYGRKDRINSIMSVVTNTLVEELEESQRKCPPCWYKFANTFLIWECHPYWIKLKEIVNLIVMDPFVDLAITICIVLNTLFMAMEHHPMTPQFEHVLAVGNLVFTGIFTAEMFLKLIAMDPYYYFQEGWNIFDGFIVSLSLMELSLADVEGLSVLRSFRLLRVFKLAKSWPTLNMLIKIIGNSVGALGNLTLVLAIIVFIFAVVGMQLFGKSYKECVCKINQDCELPRWHMHDFFHSFLIVFRVLCGEWIETMWDCMEVAGQAMCLIVFMMVMVIGNLVVLNLFLALLLSSFSADNLAATDDDGEMNNLQISVIRIKKGVAWTKLKVHAFMQAHFKQREADEVKPLDELYEKKANCIANHTGADIHRNGDFQKNGNGTTSGIGSSVEKYIIDEDHMSFINNPNLTVRVPIAVGESDFENLNTEDVSSESDPEGSKDKLDDTSSSEGSTIDIKPEVEEVPVEQPEEYLDPDACFTEGCVQRFKCCQVNIEEGLGKSWWILRKTCFLIVEHNWFETFIIFMILLSSGALAFEDIYIEQRKTIRTILEYADKVFTYIFILEMLLKWTAYGFVKFFTNAWCWLDFLIVAVSLVSLIANALGYSELGAIKSLRTLRALRPLRALSRFEGMRVVVNALVGAIPSIMNVLLVCLIFWLIFSIMGVNLFAGKYHYCFNETSEIRFEIEDVNNKTECEKLMEGNNTEIRWKNVKINFDNVGAGYLALLQVATFKGWMDIMYAAVDSRKPDEQPKYEDNIYMYIYFVIFIIFGSFFTLNLFIGVIIDNFNQQKKKFGGQDIFMTEEQKKYYNAMKKLGSKKPQKPIPRPLNKIQGIVFDFVTQQAFDIVIMMLICLNMVTMMVETDTQSKQMENILYWINLVFVIFFTCECVLKMFALRHYYFTIGWNIFDFVVVILSIVGMFLADIIEKYFVSPTLFRVIRLARIGRILRLIKGAKGIRTLLFALMMSLPALFNIGLLLFLVMFIFSIFGMSNFAYVKHEAGIDDMFNFETFGNSMICLFQITTSAGWDGLLLPILNRPPDCSLDKEHPGSGFKGDCGNPSVGIFFFVSYIIISFLIVVNMYIAIILENFSVATEESADPLSEDDFETFYEIWEKFDPDATQFIEYCKLADFADALEHPLRVPKPNTIELIAMDLPMVSGDRIHCLDILFAFTKRVLGDSGELDILRQQMEERFVASNPSKVSYEPITTTLRRKQEEVSAVVLQRAYRGHLARRGFICKKTTSNKLENGGTHREKKESTPSTASLPSYDSVTKPEKEKQQRAEEGRRERAKRQKEVRESKC

SEQ ID NO: 80263 - protein, 1956 aa, Homo sapiens
  Payload ID: 16001
  Gene Symbol: SCN10A
  Gene Name: sodium channel, voltage gated, type X alpha subunit
  Uniprot ID: Q9Y5Y9
  ENSP ID: ENSP00000390600
MEFPIGSLETNNFRRFTPESLVEIEKQIAAKQGTKKAREKHREQKDQEEKPRPQLDLKACNQLPKFYGELPAELIGEPLEDLDPFYSTHRTFMVLNKGRTISRFSATRALWLFSPFNLIRRTAIKVSVHSWFSLFITVTILVNCVCMTRTDLPEKIEYVFTVIYTFEALIKILARGFCLNEFTYLRDPWNWLDFSVITLAYVGTAIDLRGISGLRTFRVLRALKTVSVIPGLKVIVGALIHSVKKLADVTILTIFCLSVFALVGLQLFKGNLKNKCVKNDMAVNETTNYSSHRKPDIYINKRGTSDPLLCGNGSDSGHCPDGYICLKTSDNPDFNYTSFDSFAWAFLSLFRLMTQDSWERLYQQTLRTSGKIYMIFFVLVIFLGSFYLVNLILAVVTMAYEEQNQATTDEIEAKEKKFQEALEMLRKEQEVLAALGIDTTSLHSHNGSPLTSKNASERRHRIKPRVSEGSTEDNKSPRSDPYNQRRMSFLGLASGKRRASHGSVFHFRSPGRDISLPEGVTDDGVFPGDHESHRGSLLLGGGAGQQGPLPRSPLPQPSNPDSRHGEDEHQPPPTSELAPGAVDVSAFDAGQKKTFLSAEYLDEPFRAQRAMSVVSIITSVLEELEESEQKCPPCLTSLSQKYLIWDCCPMWVKLKTILFGLVTDPFAELTITLCIVVNTIFMAMEHHGMSPTFEAMLQIGNIVFTIFFTAEMVFKIIAFDPYYYFQKKWNIFDCIIVTVSLLELGVAKKGSLSVLRSFRLLRVFKLAKSWPTLNTLIKIIGNSVGALGNLTIILAIIVFVFALVGKQLLGENYRNNRKNISAPHEDWPRWHMHDFFHSFLIVFRILCGEWIENMWACMEVGQKSICLILFLTVMVLGNLVVLNLFIALLLNSFSADNLTAPEDDGEVNNLQVALARIQVFGHRTKQALCSFFSRSCPFPQPKAEPELVVKLPLSSSKAENHIAANTARGSSGGLQAPRGPRDEHSDFIANPTVWVSVPIAEGESDLDDLEDDGGEDAQSFQQEVIPKGQQEQLQQVERCGDHLTPRSPGTGTSSEDLAPSLGETWKDESVPQVPAEGVDDTSSSEGSTVDCLDPEEILRKIPELADDLEEPDDCFTEGCIRHCPCCKLDTTKSPWDVGWQVRKTCYRIVEHSWFESFIIFMILLSSGSLAFEDYYLDQKPTVKALLEYTDRVFTFIFVFEMLLKWVAYGFKKYFTNAWCWLDFLIVNISLISLTAKILEYSEVAPIKALRTLRALRPLRALSRFEGMRVVVDALVGAIPSIMNVLLVCLIFWLIFSIMGVNLFAGKFWRCINYTDGEFSLVPLSIVNNKSDCKIQNSTGSFFWVNVKVNFDNVAMGYLALLQVATFKGWMDIMYAAVDSREVNMQPKWEDNVYMYLYFVIFIIFGGFFTLNLFVGVIIDNFNQQKKKLGGQDIFMTEEQKKYYNAMKKLGSKKPQKPIPRPLNKFQGFVFDIVTRQAFDITIMVLICLNMITMMVETDDQSEEKTKILGKINQFFVAVFTGECVMKMFALRQYYFTNGWNVFDFIVVVLSIASLIFSAILKSLQSYFSPTLFRVIRLARIGRILRLIRAAKGIRTLLFALMMSLPALFNIGLLLFLVMFIYSIFGMSSFPHVRWEAGIDDMFNFQTFANSMLCLFQITTSAGWDGLLSPILNTGPPYCDPNLPNSNGTRGDCGSPAVGIIFFTTYIIISFLIMVNMYIAVILENFNVATEESTEPLSEDDFDMFYETWEKFDPEATQFITFSALSDFADTLSGPLRIPKPNRNILIQMDLPLVPGDKIHCLDILFAFTKNVLGESGELDSLKANMEEKFMATNLSKSSYEPIATTLRWKQEDISATVIQKAYRSYVLHRSMALSNTPCVPRAEEEAASLPDEGFVAFTANENCVLPDKSETASATSFPPSYESVTRGLSDRVNMRTSSSIQNEDEATSMELIAPGP

SEQ ID NO: 80264 - protein, 1791 aa, Homo sapiens
  Payload ID: 16002
  Gene Symbol: SCN11A
  Gene Name: sodium channel, voltage gated, type XI alpha subunit
  Uniprot ID: Q9UI33
  ENSP ID: ENSP00000307599
MDDRCYPVIFPDERNFRPFTSDSLAAIEKRIAIQKEKKKSKDQTGEVPQPRPQLDLKASRKLPKLYGDIPRELIGKPLEDLDPFYRNHKTFMVLNRKRTIYRFSAKHALFIFGPFNSIRSLAIRVSVHSLFSMFIIGTVIINCVFMATGPAKNSNSNNTDIAECVFTGIYIFEALIKILARGFILDEFSFLRDPWNWLDSIVIGIAIVSYIPGITIKLLPLRTFRVFRALKAISVVSRLKVIVGALLRSVKKLVNVIILTFFCLSIFALVGQQLFMGSLNLKCISRDCKNISNPEAYDHCFEKKENSPEFKMCGIWMGNSACSIQYECKHTKINPDYNYTNFDNFGWSFLAMFRLMTQDSWEKLYQQTLRTTGLYSVFFFIVVIFLGSFYLINLTLAVVTMAYEEQNKNVAAEIEAKEKMFQEAQQLLKEEKEALVAMGIDRSSLTSLETSYFTPKKRKLFGNKKRKSFFLRESGKDQPPGSDSDEDCQKKPQLLEQTKRLSQNLSLDHFDEHGDPLQRQRALSAVSILTITMKEQEKSQEPCLPCGENLASKYLVWNCCPQWLCVKKVLRTVMTDPFTELAITICIIINTVFLAMEHHKMEASFEKMLNIGNLVFTSIFIAEMCLKIIALDPYHYFRRGWNIFDSIVALLSFADVMNCVLQKRSWPFLRSFRVLRVFKLAKSWPTLNTLIKIIGNSVGALGSLTVVLVIVIFIFSVVGMQLFGRSFNSQKSPKLCNPTGPTVSCLRHWHMGDFWHSFLVVFRILCGEWIENMWECMQEANASSSLCVIVFILITVIGKLVVLNLFIALLLNSFSNEERNGNLEGEARKTKVQLALDRFRRAFCFVRHTLEHFCHKWCRKQNLPQQKEVAGGCAAQSKDIIPLVMEMKRGSETQEELGILTSVPKTLGVRHDWTWLAPLAEEEDDVEFSGEDNAQRITQPEPEQQAYELHQENKKPTSQRVQSVEIDMFSEDEPHLTIQDPRKKSDVTSILSECSTIDLQDGFGWLPEMVPKKQPERCLPKGFGCCFPCCSVDKRKPPWVIWWNLRKTCYQIVKHSWFESFIIFVILLSSGALIFEDVHLENQPKIQELLNCTDIIFTHIFILEMVLKWVAFGFGKYFTSAWCCLDFIIVIVSVTTLINLMELKSFRTLRALRPLRALSQFEGMKVVVNALIGAIPAILNVLLVCLIFWLVFCILGVYFFSGKFGKCINGTDSVINYTIITNKSQCESGNFSWINQKVNFDNVGNAYLALLQVATFKGWMDIIYAAVDSTEKEQQPEFESNSLGYIYFVVFIIFGSFFTLNLFIGVIIDNFNQQQKKLGGQDIFMTEEQKKYYNAMKKLGSKKPQKPIPRPLNKCQGLVFDIVTSQIFDIIIISLIILNMISMMAESYNQPKAMKSILDHLNWVFVVIFTLECLIKIFALRQYYFTNGWNLFDCVVVLLSIVSTMISTLENQEHIPFPPTLFRIVRLARIGRILRLVRAARGIRTLLFALMMSLPSLFNIGLLLFLIMFIYAILGMNWFSKVNPESGIDDIFNFKTFASSMLCLFQISTSAGWDSLLSPMLRSKESCNSSSENCHLPGIATSYFVSYIIISFLIVVNMYIAVILENFNTATEESEDPLGEDDFDIFYEVWEKFDPEATQFIKYSALSDFADALPEPLRVAKPNKYQFLVMDLPMVSEDRLHCMDILFAFTARVLGGSDGLDSMKAMMEEKFMEANPLKKLYEPIVTTTKRKEEERGAAIIQKAFRKYMMKVTKGDQGDQNDLENGPHSPLQTLCNGDLSSFGVAKGKVHCD

SEQ ID NO: 80265 - protein, 1444 aa, Homo sapiens
  Payload ID: 16002
  Gene Symbol: SCN11A
  Gene Name: sodium channel, voltage gated, type XI alpha subunit
  Uniprot ID: Q9UI33
  ENSP ID: ENSP00000408028
MDDRCYPVIFPDERNFRPFTSDSLAAIEKRIAIQKEKKKSKDQTGEVPQPRPQLDLKASRKLPKLYGDIPRELIGKPLEDLDPFYRNHKTFMVLNRKRTIYRFSAKHALFIFGPFNSIRSLAIRVSVHSLFSMFIIGTVIINCVFMATGPAKNSNSNNTDIAECVFTGIYIFEALIKILARGFILDEFSFLRDPWNWLDSIVIGIAIVSYIPGITIKLLPLRTFRVFRALKAISVVSRLKVIVGALLRSVKKLVNVIILTFFCLSIFALVGQQLFMGSLNLKCISRDCKNISNPEAYDHCFEKKENSPEFKMCGIWMGNSACSIQYECKHTKINPDYNYTNFDNFGWSFLAMFRLMTQDSWEKLYQQTLRTTGLYSVFFFIVVIFLGSFYLINLTLAVVTMAYEEQNKNVAAEIEAKEKMFQEAQQLLKEEKEALVAMGIDRSSLTSLETSYFTPKKRKLFGNKKRKSFFLRESGKDQPPGSDSDEDCQKKPQLLEQTKRLSQNLSLDHFDEHGDPLQRQRALSAVSILTITMKEQEKSQEPCLPCGENLASKYLVWNCCPQWLCVKKVLRTVMTDPFTELAITICIIINTVFLAMEHHKMEASFEKMLNIGNLVFTSIFIAEMCLKIIALDPYHYFRRGWNIFDSIVALLSFADVMNCVLQKRSWPFLRSFRVLRVFKLAKSWPTLNTLIKIIGNSVGALGSLTVVLVIVIFIFSVVGMQLFGRSFNSQKSPKLCNPTGPTVSCLRHWHMGDFWHSFLVVFRILCGEWIENMWECMQEANASSSLCVIVFILITVIGKLVVLNLFIALLLNSFSNEERNGNLEGEARKTKVQLALDRFRRAFCFVRHTLEHFCHKWCRKQNLPQQKEVAGGCAAQSKDIIPLVMEMKRGSETQEELGILTSVPKTLGVRHDWTWLAPLAEEEDDVEFSGEDNAQRITQPEPEQQAYELHQENKKPTSQRVQSVEIDMFSEDEPHLTIQDPRKKSDVTSILSECSTIDLQDGFGWLPEMVPKKQPERCLPKGFGCCFPCCSVDKRKPPWVIWWNLRKTCYQIVKHSWFESFIIFVILLSSGALIFEDVHLENQPKIQELLNCTDIIFTHIFILEMVLKWVAFGFGKYFTSAWCCLDFIIVIVSVTTLINLMELKSFRTLRALRPLRALSQFEGMKVVVNALIGAIPAILNVLLVCLIFWLVFCILGVYFFSGKFGKCINGTDSVINYTIITNKSQCESGNFSWINQKVNFDNVGNAYLALLQVATFKGWMDIIYAAVDSTEKEQQPEFESNSLGYIYFVVFIIFGSFFTLNLFIGVIIDNFNQQQKKLGGQDIFMTEEQKKYYNAMKKLGSKKPQKPIPRPLNKCQGLVFDIVTSQIFDIIIISLIILNMISMMAESYNQPKAMKSILDHLNWVFVVIFTLECLIKIFALRQYYFTNGWNLFDCVVVLLSIVSK

SEQ ID NO: 80266 - protein, 1753 aa, Homo sapiens
  Payload ID: 16002
  Gene Symbol: SCN11A
  Gene Name: sodium channel, voltage gated, type XI alpha subunit
  Uniprot ID: Q9UI33
  ENSP ID: ENSP00000416757
MDDRCYPVIFPDERNFRPFTSDSLAAIEKRIAIQKEKKKSKDQTGEVPQPRPQLDLKASRKLPKLYGDIPRELIGKPLEDLDPFYRNHKTFMVLNRKRTIYRFSAKHALFIFGPFNSIRSLAIRVSVHSLFSMFIIGTVIINCVFMATGPAKNSNSNNTDIAECVFTGIYIFEALIKILARGFILDEFSFLRDPWNWLDSIVIGIAIVSYIPGITIKLLPLRTFRVFRALKAISVVSRLKVIVGALLRSVKKLVNVIILTFFCLSIFALVGQQLFMGSLNLKCISRDCKNISNPEAYDHCFEKKENSPEFKMCGIWMGNSACSIQYECKHTKINPDYNYTNFDNFGWSFLAMFRLMTQDSWEKLYQQTLRTTGLYSVFFFIVVIFLGSFYLINLTLAVVTMAYEEQNKNVAAEIEAKEKMFQEAQQLLKEEKEALVAMGIDRSSLTSLETSYFTPKKRKLFGNKKRKSFFLRESGKDQPPGSDSDEDCQKKPQLLEQTKRLSQNLSLDHFDEHGDPLQRQRALSAVSILTITMKEQEKSQEPCLPCGENLASKYLVWNCCPQWLCVKKVLRTVMTDPFTELAITICIIINTVFLAMEHHKMEASFEKMLNIGNLVFTSIFIAEMCLKIIALDPYHYFRRGWNIFDSIVALLSFADVMNCVLQKRSWPFLRSFRVLRVFKLAKSWPTLNTLIKIIGNSVGALGSLTVVLVIVIFIFSVVGMQLFGRSFNSQKSPKLCNPTGPTVSCLRHWHMGDFWHSFLVVFRILCGEWIENMWECMQEANASSSLCVIVFILITVIGKLVVLNLFIALLLNSFSNEERNGNLEGEARKTKVQLALDRFRRAFCFVRHTLEHFCHKWCRKQNLPQQKEVAGGCAAQSKDIIPLVMEMKRGSETQEELGILTSVPKTLGVRHDWTWLAPLAEEEDDVEFSGEDNAQRITQPEPEQQKSDVTSILSECSTIDLQDGFGWLPEMVPKKQPERCLPKGFGCCFPCCSVDKRKPPWVIWWNLRKTCYQIVKHSWFESFIIFVILLSSGALIFEDVHLENQPKIQELLNCTDIIFTHIFILEMVLKWVAFGFGKYFTSAWCCLDFIIVIVSVTTLINLMELKSFRTLRALRPLRALSQFEGMKVVVNALIGAIPAILNVLLVCLIFWLVFCILGVYFFSGKFGKCINGTDSVINYTIITNKSQCESGNFSWINQKVNFDNVGNAYLALLQVATFKGWMDIIYAAVDSTEKEQQPEFESNSLGYIYFVVFIIFGSFFTLNLFIGVIIDNFNQQQKKLGGQDIFMTEEQKKYYNAMKKLGSKKPQKPIPRPLNKCQGLVFDIVTSQIFDIIIISLIILNMISMMAESYNQPKAMKSILDHLNWVFVVIFTLECLIKIFALRQYYFTNGWNLFDCVVVLLSIVSTMISTLENQEHIPFPPTLFRIVRLARIGRILRLVRAARGIRTLLFALMMSLPSLFNIGLLLFLIMFIYAILGMNWFSKVNPESGIDDIFNFKTFASSMLCLFQISTSAGWDSLLSPMLRSKESCNSSSENCHLPGIATSYFVSYIIISFLIVVNMYIAVILENFNTATEESEDPLGEDDFDIFYEVWEKFDPEATQFIKYSALSDFADALPEPLRVAKPNKYQFLVMDLPMVSEDRLHCMDILFAFTARVLGGSDGLDSMKAMMEEKFMEANPLKKLYEPIVTTTKRKEEERGAAIIQKAFRKYMMKVTKGDQGDQNDLENGPHSPLQTLCNGDLSSFGVAKGKVHCD

SEQ ID NO: 80267 - protein, 1738 aa, Homo sapiens
  Payload ID: 16003
  Gene Symbol: NALCN
  Gene Name: sodium leak channel, non selective
  Uniprot ID: Q8IZF0
  ENSP ID: ENSP00000251127
MLKRKQSSRVEAQPVTDFGPDESLSDNADILWINKPWVHSLLRICAIISVISVCMNTPMTFEHYPPLQYVTFTLDTLLMFLYTAEMIAKMHIRGIVKGDSSYVKDRWCVFDGFMVFCLWVSLVLQVFEIADIVDQMSPWGMLRIPRPLIMIRAFRIYFRFELPRTRITNILKRSGEQIWSVSIFLLFFLLLYGILGVQMFGTFTYHCVVNDTKPGNVTWNSLAIPDTHCSPELEEGYQCPPGFKCMDLEDLGLSRQELGYSGFNEIGTSIFTVYEAASQEGWVFLMYRAIDSFPRWRSYFYFITLIFFLAWLVKNVFIAVIIETFAEIRVQFQQMWGSRSSTTSTATTQMFHEDAAGGWQLVAVDVNKPQGRAPACLQKMMRSSVFHMFILSMVTVDVIVAASNYYKGENFRRQYDEFYLAEVAFTVLFDLEALLKIWCLGFTGYISSSLHKFELLLVIGTTLHVYPDLYHSQFTYFQVLRVVRLIKISPALEDFVYKIFGPGKKLGSLVVFTASLLIVMSAISLQMFCFVEELDRFTTFPRAFMSMFQILTQEGWVDVMDQTLNAVGHMWAPVVAIYFILYHLFATLILLSLFVAVILDNLELDEDLKKLKQLKQSEANADTKEKLPLRLRIFEKFPNRPQMVKISKLPSDFTVPKIRESFMKQFIDRQQQDTCCLLRSLPTTSSSSCDHSKRSAIEDNKYIDQKLRKSVFSIRARNLLEKETAVTKILRACTRQRMLSGSFEGQPAKERSILSVQHHIRQERRSLRHGSNSQRISRGKSLETLTQDHSNTVRYRNAQREDSEIKMIQEKKEQAEMKRKVQEEELRENHPYFDKPLFIVGREHRFRNFCRVVVRARFNASKTDPVTGAVKNTKYHQLYDLLGLVTYLDWVMIIVTICSCISMMFESPFRRVMHAPTLQIAEYVFVIFMSIELNLKIMADGLFFTPTAVIRDFGGVMDIFIYLVSLIFLCWMPQNVPAESGAQLLMVLRCLRPLRIFKLVPQMRKVVRELFSGFKEIFLVSILLLTLMLVFASFGVQLFAGKLAKCNDPNIIRREDCNGIFRINVSVSKNLNLKLRPGEKKPGFWVPRVWANPRNFNFDNVGNAMLALFEVLSLKGWVEVRDVIIHRVGPIHGIYIHVFVFLGCMIGLTLFVGVVIANFNENKGTALLTVDQRRWEDLKSRLKIAQPLHLPPRPDNDGFRAKMYDITQHPFFKRTIALLVLAQSVLLSVKWDVEDPVTVPLATMSVVFTFIFVLEVTMKIIAMSPAGFWQSRRNRYDLLVTSLGVVWVVLHFALLNAYTYMMGACVIVFRFFSICGKHVTLKMLLLTVVVSMYKSFFIIVGMFLLLLCYAFAGVVLFGTVKYGENINRHANFSSAGKAITVLFRIVTGEDWNKIMHDCMVQPPFCTPDEFTYWATDCGNYAGALMYFCSFYVIIAYIMLNLLVAIIVENFSLFYSTEEDQLLSYNDLRHFQIIWNMVDDKREGVIPTFRVKFLLRLLRGRLEVDLDKDKLLFKHMCYEMERLHNGGDVTFHDVLSMLSYRSVDIRKSLQLEELLAREQLEYTIEEEVAKQTIRMWLKKCLKRIRAKQQQSCSIIHSLRESQQQELSRFLNPPSIETTQPSEDTNANSQDNSMQPETSSQQQLLSPTLSDRGGSRQDAADAGKPQRKFGQWRLPSAPKPISHSVSSVNLRFGGRTTMKSVVCKMNPMTDAASCGSEVKKWWTRQLTVESDESGDDLLDI

SEQ ID NO: 80268 - protein, 218 aa, Homo sapiens
  Payload ID: 16003
  Gene Symbol: NALCN
  Gene Name: sodium leak channel, non selective
  Uniprot ID: Q8IZF0
  ENSP ID: ENSP00000365373
MLKRKQSSRVEAQPVTDFGPDESLSDNADILWINKPWVHSLLRICAIISVISVCMNTPMTFEHYPPLQYVTFTLDTLLMFLYTAEMIAKMHIRGIVKGDSSYVKDRWCVFDGFMVFCLWVSLVLQVFEIADIVDQMSPWGMLRIPRPLIMIRAFRIYFRFELPRTRITNILKRSGEQIWSVSIFLLFFLLLYGILGVQMFGTFTYHCVVNDTKPGLSL

SEQ ID NO: 80269 - protein, 10 aa, Homo sapiens
  Payload ID: 16004
  Gene Symbol: SOGA3
  Gene Name: SOGA family member 3
  ENSP ID: ENSP00000431662
MSQPPIGGAA

SEQ ID NO: 80270 - protein, 947 aa, Homo sapiens; identical to SEQ ID NO: 69033
  Payload ID: 16004
  Gene Symbol: SOGA3
  Gene Name: SOGA family member 3
  Uniprot ID: Q5TF21
  ENSP ID: ENSP00000434570

SEQ ID NO: 80271 - protein, 944 aa, Homo sapiens
  Payload ID: 16004
  Gene Symbol: SOGA3
  Gene Name: SOGA family member 3
  ENSP ID: ENSP00000435559
MSQPPIGGAAPATAAASPAAAATEARLHPEGSSRKQQRAQSPARPRDSSLRQTIAATRSPVGAGTKLNSVRQQQLQQQQQQGNKTGSRTGPPASIRGGGGGAEKATPLAPKGAAPGAVQPVAGAEAAPAATLAALGGRRPGPPEEPPRELESVPSKLGEPPPLGEGGGGGGEGGGAGGGSGEREGGAPQPPPPRGWRGKGVRAQQRGGSGGEGASPSPSSSSAGKTPGTGSRNSGSGVAGGGSGGGGSYWKEGCLQSELIQFHLKKERAAAAAAAAQMHAKNGGGSSSRSSPVSGPPAVCETLAVASASPMAAAAEGPQQSAEGSASGGGMQAAAPPSSQPHPQQLQEQEEMQEEMEKLREENETLKNEIDELRTEMDEMRDTFFEEDACQLQEMRHELERANKNCRILQYRLRKAERKRLRYAQTGEIDGELLRSLEQDLKVAKDVSVRLHHELENVEEKRTTTEDENEKLRQQLIEVEIAKQALQNELEKMKELSLKRRGSKDLPKSEKKAQQTPTEEDNEDLKCQLQFVKEEAALMRKKMAKIDKEKDRFEHELQKYRSFYGDLDSPLPKGEAGGPPSTREAELKLRLRLVEEEANILGRKIVELEVENRGLKAELDDLRGDDFNGSANPLMREQSESLSELRQHLQLVEDETELLRRNVADLEEQNKRITAELNKYKYKSGGHDSARHHDNAKTEALQEELKAARLQINELSGKVMQLQYENRVLMSNMQRYDLASHLGIRGSPRDSDAESDAGKKESDDDSRPPHRKREGPIGGESDSEEVRNIRCLTPTRSFYPAPGPWPKSFSDRQQMKDIRSEAERLGKTIDRLIADTSTIITEARIYVANGDLFGLMDEEDDGSRIREHELLYRINAQMKAFRKELQTFIDRLEVPKSADDRGAEEPISMFQPIILLILILVLFSSLSYTTIFKLVFLFTLFFVL

SEQ ID NO: 80272 - protein, 574 aa, Homo sapiens
  Payload ID: 16005
  Gene Symbol: SLC1A2
  Gene Name: solute carrier family 1 (glial high affinity glutamate transporter), member 2
  Uniprot ID: P43004
  ENSP ID: ENSP00000278379
MASTEGANNMPKQVEVRMHDSHLGSEEPKHRHLGLRLCDKLGKNLLLTLTVFGVILGAVCGGLLRLASPIHPDVVMLIAFPGDILMRMLKMLILPLIISSLITGLSGLDAKASGRLGTRAMVYYMSTTIIAAVLGVILVLAIHPGNPKLKKQLGPGKKNDEVSSLDAFLDLIRNLFPENLVQACFQQIQTVTKKVLVAPPPDEEANATSAVVSLLNETVTEVPEETKMVIKKGLEFKDGMNVLGLIGFFIAFGIAMGKMGDQAKLMVDFFNILNEIVMKLVIMIMWYSPLGIACLICGKIIAIKDLEVVARQLGMYMVTVIIGLIIHGGIFLPLIYFVVTRKNPFSFFAGIFQAWITALGTASSAGTLPVTFRCLEENLGIDKRVTRFVLPVGATINMDGTALYEAVAAIFIAQMNGVVLDGGQIVTVSLTATLASVGAASIPSAGLVTMLLILTAVGLPTEDISLLVAVDWLLDRMRTSVNVVGDSFGAGIVYHLSKSELDTIDSQHRVHEDIEMTKTQSIYDDMKNHRESNSNQCVYAAHNSVIVDECKVTLAANGKSADCSVEEEPWKREK

SEQ ID NO: 80273 - protein, 565 aa, Homo sapiens
  Payload ID: 16005
  Gene Symbol: SLC1A2
  Gene Name: solute carrier family 1 (glial high affinity glutamate transporter), member 2
  Uniprot ID: P43004
  ENSP ID: ENSP00000379099
MPKQVEVRMHDSHLGSEEPKHRHLGLRLCDKLGKNLLLTLTVFGVILGAVCGGLLRLASPIHPDVVMLIAFPGDILMRMLKMLILPLIISSLITGLSGLDAKASGRLGTRAMVYYMSTTIIAAVLGVILVLAIHPGNPKLKKQLGPGKKNDEVSSLDAFLDLIRNLFPENLVQACFQQIQTVTKKVLVAPPPDEEANATSAVVSLLNETVTEVPEETKMVIKKGLEFKDGMNVLGLIGFFIAFGIAMGKMGDQAKLMVDFFNILNEIVMKLVIMIMWYSPLGIACLICGKIIAIKDLEVVARQLGMYMVTVIIGLIIHGGIFLPLIYFVVTRKNPFSFFAGIFQAWITALGTASSAGTLPVTFRCLEENLGIDKRVTRFVLPVGATINMDGTALYEAVAAIFIAQMNGVVLDGGQIVTVSLTATLASVGAASIPSAGLVTMLLILTAVGLPTEDISLLVAVDWLLDRMRTSVNVVGDSFGAGIVYHLSKSELDTIDSQHRVHEDIEMTKTQSIYDDMKNHRESNSNQCVYAAHNSVIVDECKVTLAANGKSADCSVEEEPWKREK

SEQ ID NO: 80274 - protein, 565 aa, Homo sapiens; identical to SEQ ID NO: 80273
  Payload ID: 16005
  Gene Symbol: SLC1A2
  Gene Name: solute carrier family 1 (glial high affinity glutamate transporter), member 2
  Uniprot ID: P43004
  ENSP ID: ENSP00000379102

SEQ ID NO: 80275 - protein, 199 aa, Homo sapiens
  Payload ID: 16005
  Gene Symbol: SLC1A2
  Gene Name: solute carrier family 1 (glial high affinity glutamate transporter), member 2
  ENSP ID: ENSP00000406133
MGANNMPKQVEVRMHDSHLGSEEPKHRHLGLRLCDKLGKNLLLTLTVFGVILGAVCGGLLRLASPIHPDVVMLIAFPGDILMRMLKMLILPLIISSLITGLSGLDAKASGRLGTRAMVYYMSTTIIAAVLGVILVLAIHPGNPKLKKQLGPGKKNDEVSSLDAFLDLIRNLFPENLVQACFQQIQTVTKKVLVAPPPDE

SEQ ID NO: 80276 - protein, 91 aa, Homo sapiens
  Payload ID: 16005
  Gene Symbol: SLC1A2
  Gene Name: solute carrier family 1 (glial high affinity glutamate transporter), member 2
  ENSP ID: ENSP00000435406
TSVNVVGDSFGAGIVYHLSKSELDTIDSQHRVHEDIEMTKTQSIYDDMKNHRESNSNQCVYAAHNSVIVDECKGPFVLRIKPAIGTDLTAL

SEQ ID NO: 80277 - protein, 199 aa, Homo sapiens
  Payload ID: 16005
  Gene Symbol: SLC1A2
  Gene Name: solute carrier family 1 (glial high affinity glutamate transporter), member 2
  ENSP ID: ENSP00000436029
  MOD_RES (1)..(1): Any amino acid
XIMWYSPLGIACLICGKIIAIKDLEVVARQLGMYMVTVIIGLIIHGGIFLPLIYFVVTRKNPFSFFAGIFQAWITALGTASSAGTLPVTFRCLEENLGIDKRVTRFVLPVGATINMDGTALYEAVAAIFIAQMNGVVLDGGQIVTVRDRMRTSVNVVGDSFGAGIVYHLSKSELDTIDSQHRVHEDIEMTKTQSIYDDM

SEQ ID NO: 80278 - protein, 563 aa, Homo sapiens
  Payload ID: 16005
  Gene Symbol: SLC1A2
  Gene Name: solute carrier family 1 (glial high affinity glutamate transporter), member 2
  Uniprot ID: P43004
  ENSP ID: ENSP00000476124
MASTEGANNMPKQVEVRMHDSHLGSEEPKHRHLGLRLCDKLGKNLLLTLTVFGVILGAVCGGLLRLASPIHPDVVMLIAFPGDILMRMLKMLILPLIISSLITGLSGLDAKASGRLGTRAMVYYMSTTIIAAVLGVILVLAIHPGNPKLKKQLGPGKKNDEVSSLDAFLDLIRNLFPENLVQACFQQIQTVTKKVLVAPPPDEEANATSAVVSLLNETVTEVPEETKMVIKKGLEFKDGMNVLGLIGFFIAFGIAMGKMGDQAKLMVDFFNILNEIVMKLVIMIMWYSPLGIACLICGKIIAIKDLEVVARQLGMYMVTVIIGLIIHGGIFLPLIYFVVTRKNPFSFFAGIFQAWITALGTASSAGTLPVTFRCLEENLGIDKRVTRFVLPVGATINMDGTALYEAVAAIFIAQMNGVVLDGGQIVTVSLTATLASVGAASIPSAGLVTMLLILTAVGLPTEDISLLVAVDWLLDRMRTSVNVVGDSFGAGIVYHLSKSELDTIDSQHRVHEDIEMTKTQSIYDDMKNHRESNSNQCVYAAHNSVIVDECKVHFPFMDIETCI

SEQ ID NO: 80279 - protein, 542 aa, Homo sapiens
  Payload ID: 16006
  Gene Symbol: SLC1A3
  Gene Name: solute carrier family 1 (glial high affinity glutamate transporter), member 3
  Uniprot ID: P43003
  ENSP ID: ENSP00000265113
MTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLIISSLVTGMAALDSKASGKMGMRAVVYYMTTTIIAVVIGIIIVIIIHPGKGTKENMHREGKIVRVTAADAFLDLIRNMFPPNLVEACFKQFKTNYEKRSFKVPIQANETLVGAVINNVSEAMETLTRITEELVPVPGSVNGVNALGLVVFSMCFGFVIGNMKEQGQALREFFDSLNEAIMRLVAVIMWYAPVGILFLIAGKIVEMEDMGVIGGQLAMYTVTVIVGLLIHAVIVLPLLYFLVTRKNPWVFIGGLLQALITALGTSSSSATLPITFKCLEENNGVDKRVTRFVLPVGATINMDGTALYEALAAIFIAQVNNFELNFGQIITISITATAASIGAAGIPQAGLVTMVIVLTSVGLPTDDITLIIAVDWFLDRLRTTTNVLGDSLGAGIVEHLSRHELKNRDVEMGNSVIEENEMKKPYQLIAQDNETEKPIDSETKM

SEQ ID NO: 80280 - protein, 497 aa, Homo sapiens
  Payload ID: 16006
  Gene Symbol: SLC1A3
  Gene Name: solute carrier family 1 (glial high affinity glutamate transporter), member 3
  Uniprot ID: P43003
  ENSP ID: ENSP00000371343
MTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLIISSLVTGMAALDSKASGKMGMRAVVYYMTTTIIAVVIGIIIVIIIHPGKGTKENMHREGKIVRVTAADAFLDLIRNMFPPNLVEACFKQFKTNYEKRSFKVPIQANETLVGAVINNVSEAMETLTRITEELVPVPGSVNGVNALGLVVFSMCFGFVIGNMKEQGQALREFFDSLNEAIMRLVAVIMWYAPVGILFLIAGKIVEMEDMGVIGGQLAMYTVTVIVGLLIHAVIVLPLLYFLVTRKNPWVFIGGLLQALITALGTSSSSATLPITFKCLEENNGVDKRVTRFVLPVGATINMDGTALYEALAAIFIAQVNNFELNFGQIITIRDRLRTTTNVLGDSLGAGIVEHLSRHELKNRDVEMGNSVIEENEMKKPYQLIAQDNETEKPIDSETKM

SEQ ID NO: 80281 - protein, 106 aa, Homo sapiens
  Payload ID: 16006
  Gene Symbol: SLC1A3
  Gene Name: solute carrier family 1 (glial high affinity glutamate transporter), member 3
  ENSP ID: ENSP00000420992
MTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLIISSLVT

SEQ ID NO: 80282 - protein, 106 aa, Homo sapiens; identical to SEQ ID NO: 80281
  Payload ID: 16006
  Gene Symbol: SLC1A3
  Gene Name: solute carrier family 1 (glial high affinity glutamate transporter), member 3
  ENSP ID: ENSP00000424986

SEQ ID NO: 80283 - protein, 101 aa, Homo sapiens
  Payload ID: 16006
  Gene Symbol: SLC1A3
  Gene Name: solute carrier family 1 (glial high affinity glutamate transporter), member 3
  ENSP ID: ENSP00000427203
MTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLII

SEQ ID NO: 80284 - protein, 496 aa, Homo sapiens
  Payload ID: 16006
  Gene Symbol: SLC1A3
  Gene Name: solute carrier family 1 (glial high affinity glutamate transporter), member 3
  ENSP ID: ENSP00000477672
MTKSNGEEPKMGGRMERFQQGVRKRTLLAKKKVQNITKEDVKSYLFRNAFVLLTVTAVIVGMAALDSKASGKMGMRAVVYYMTTTIIAVVIGIIIVIIIHPGKGTKENMHREGKIVRVTAADAFLDLIRNMFPPNLVEACFKQFKTNYEKRSFKVPIQANETLVGAVINNVSEAMETLTRITEELVPVPGSVNGVNALGLVVFSMCFGFVIGNMKEQGQALREFFDSLNEAIMRLVAVIMWYAPVGILFLIAGKIVEMEDMGVIGGQLAMYTVTVIVGLLIHAVIVLPLLYFLVTRKNPWVFIGGLLQALITALGTSSSSATLPITFKCLEENNGVDKRVTRFVLPVGATINMDGTALYEALAAIFIAQVNNFELNFGQIITISITATAASIGAAGIPQAGLVTMVIVLTSVGLPTDDITLIIAVDWFLDRLRTTTNVLGDSLGAGIVEHLSRHELKNRDVEMGNSVIEENEMKKPYQLIAQDNETEKPIDSETKM

SEQ ID NO: 80285 - protein, 430 aa, Homo sapiens
  Payload ID: 16006
  Gene Symbol: SLC1A3
  Gene Name: solute carrier family 1 (glial high affinity glutamate transporter), member 3
  ENSP ID: ENSP00000483657
MTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLIISSLVTGMAALDSKASGKMGMRAVVYYMTTTIIAVVIGIIIVIIIHPGKGTKENMHREGKIVRVTAADAFLDLIRYAPVGILFLIAGKIVEMEDMGVIGGQLAMYTVTVIVGLLIHAVIVLPLLYFLVTRKNPWVFIGGLLQALITALGTSSSSATLPITFKCLEENNGVDKRVTRFVLPVGATINMDGTALYEALAAIFIAQVNNFELNFGQIITISITATAASIGAAGIPQAGLVTMVIVLTSVGLPTDDITLIIAVDWFLDRLRTTTNVLGDSLGAGIVEHLSRHELKNRDVEMGNSVIEENEMKKPYQLIAQDNETEKPIDSETKM

SEQ ID NO: 80286 - protein, 158 aa, Homo sapiens
  Payload ID: 16007
  Gene Symbol: SLC1A7
  Gene Name: solute carrier family 1 (glutamate transporter), member 7
  Uniprot ID: O00341
  ENSP ID: ENSP00000360546
MVPHAILARGRDVCRRNGLLILSVLSVIVGCLLGFFLRTRRLSPQEISYFQFPGELLMRMLKMMILPLVVSSLMSGLASLDAKTSSRLGVLTVAYYLWTTFMAVIVGIFMVSIIHPGSAAQKETTEQSGKPIMSSADALLDLIRQKEESWRNGPKGPG

SEQ ID NO: 80287 - protein, 560 aa, Homo sapiens
  Payload ID: 16007
  Gene Symbol: SLC1A7
  Gene Name: solute carrier family 1 (glutamate transporter), member 7
  Uniprot ID: O00341
  ENSP ID: ENSP00000360549
MVPHAILARGRDVCRRNGLLILSVLSVIVGCLLGFFLRTRRLSPQEISYFQFPGELLMRMLKMMILPLVVSSLMSGLASLDAKTSSRLGVLTVAYYLWTTFMAVIVGIFMVSIIHPGSAAQKETTEQSGKPIMSSADALLDLIRNMFPANLVEATFKQYRTKTTPVVKSPKVAPEEAPPRRILIYGVQEENGSHVQNFALDLTPPPEVVYKSEPGTSDGMNVLGIVFFSATMGIMLGRMGDSGAPLVSFCQCLNESVMKIVAVAVWYFPFGIVFLIAGKILEMDDPRAVGKKLGFYSVTVVCGLVLHGLFILPLLYFFITKKNPIVFIRGILQALLIALATSSSSATLPITFKCLLENNHIDRRIARFVLPVGATINMDGTALYEAVAAIFIAQVNNYELDFGQIITISITATAASIGAAGIPQAGLVTMVIVLTSVGLPTDDITLIIAVDWALDRFRTMINVLGDALAAGIMAHICRKDFARDTGTEKLLPCETKPVSLQEIVAAQQNGCVKSVAEASELTLGPTCPHHVPVQVEQDEELPAASLNHCTIQISELETNV

SEQ ID NO: 80288 - protein, 619 aa, Homo sapiens
  Payload ID: 16007
  Gene Symbol: SLC1A7
  Gene Name: solute carrier family 1 (glutamate transporter), member 7
  ENSP ID: ENSP00000478639
MVPHAILARGRDVCRRNGLLILSVLSVIVGCLLGFFLRTRRLSPQEISYFQFPGELLMRMLKMMILPLVVSSLMSGLASLDAKTSSRLGVLTVAYYLWTTFMAVIVGIFMVSIIHPGSAAQKETTEQSGKPIMSSADALLDLIRNMFPANLVEATFKQYRTKTTPVVKSPKVAPEEAPPRRILIYGVQEENGSHVQNFALDLTPPPEVVYKSEPGTSDGMNVLGIVFFSATMGIMLGRMGDSGAPLVSFCQCLNESVMKIVAVAVWYFPFGIVFLIAGKILEMDDPRAVGKKLGFYSVTVVCGLVLHGLFILPLLYFFITKKNPIVFIRGILQALLIALATSSRKNQVRALQCPRSLPPAGAALQRHKHSWRGGCLGRGELPDRGPSHPGGGCWADTGPSNRSSATLPITFKCLLENNHIDRRIARFVLPVGATINMDGTALYEAVAAIFIAQVNNYELDFGQIITISITATAASIGAAGIPQAGLVTMVIVLTSVGLPTDDITLIIAVDWALDRFRTMINVLGDALAAGIMAHICRKDFARDTGTEKLLPCETKPVSLQEIVAAQQNGCVKSVAEASELTLGPTCPHHVPVQVEQDEELPAASLNHCTIQISELETNV

SEQ ID NO: 80289 - protein, 158 aa, Homo sapiens
  Payload ID: 16007
  Gene Symbol: SLC1A7
  Gene Name: solute carrier family 1 (glutamate transporter), member 7
  ENSP ID: ENSP00000481341
MVPHAILARGRDVCRRNGLLILSVLSVIVGCLLGFFLRTRRLSPQEISYFQFPGELLMRMLKMMILPLVVSSLMSGLASLDAKTSSRLGVLTVAYYLWTTFMAVIVGIFMVSIIHPGSAAQKETTEQSGKPIMSSADALLDLIRNMFPANLVEATFKQ

SEQ ID NO: 80290 - protein, 472 aa, Homo sapiens
  Payload ID: 16007
  Gene Symbol: SLC1A7
  Gene Name: solute carrier family 1 (glutamate transporter), member 7
  ENSP ID: ENSP00000484987
MVPHAILARGRDVCRRNGLLILSVLSVIVGCLLGFFLRTRRLSPQEISYFQFPGELLMRMLKMMILPLVVSRNMFPANLVEATFKQYRTKTTPVVKSPKVAPEEAPPRRILIYGVQEENGSHVQNFALDLTPPPEVVYKSEPGTSDGMNVLGIVFFSATMGIMLGRMGDSGAPLVSFCQCLNESVMKIVAVAVWYFPFGIVFLIAGKILEMDDPRAVGKKLGFYSVTVVCGLVLHGLFILPLLYFFITKKNPIVFIRGILQALLIALATSSSSATLPITFKCLLENNHIDRRIARFVLPVGATINMDGTALYEAVAAIFIAQVNNYELDFGQIITISITATAASIGAAGIPQAGLVTMVIVLTSVGLPTDDITLIIAVDWALDRFRTMINVLGDALAAGIMAHICRKDFARDTGTETCFPSPETAALRDQASEPPGDRGSPAEWLCEECSRGLRAHPGPHLPPPRPRSSGAG

SEQ ID NO: 80291 - protein, 532 aa, Homo sapiens
  Payload ID: 16008
  Gene Symbol: SLC1A4
  Gene Name: solute carrier family 1 (glutamate/neutral amino acid transporter), member 4
  Uniprot ID: P43007
  ENSP ID: ENSP00000234256
MEKSNETNGYLDSAQAGPAAGPGAPGTAAGRARRCAGFLRRQALVLLTVSGVLAGAGLGAALRGLSLSRTQVTYLAFPGEMLLRMLRMIILPLVVCSLVSGAASLDASCLGRLGGIAVAYFGLTTLSASALAVALAFIIKPGSGAQTLQSSDLGLEDSGPPPVPKETVDSFLDLARNLFPSNLVVAAFRTYATDYKVVTQNSSSGNVTHEKIPIGTEIEGMNILGLVLFALVLGVALKKLGSEGEDLIRFFNSLNEATMVLVSWIMWYVPVGIMFLVGSKIVEMKDIIVLVTSLGKYIFASILGHVIHGGIVLPLIYFVFTRKNPFRFLLGLLAPFATAFATCSSSATLPSMMKCIEENNGVDKRISRFILPIGATVNMDGAAIFQCVAAVFIAQLNNVELNAGQIFTILVTATASSVGAAGVPAGGVLTIAIILEAIGLPTHDLPLILAVDWIVDRTTTVVNVEGDALGAGILHHLNQKATKKGEQELAEVKVEAIPNCKSEEETSPLVTHQNPAGPVASAPELESKESVL

SEQ ID NO: 80292 - protein, 234 aa, Homo sapiens
  Payload ID: 16008
  Gene Symbol: SLC1A4
  Gene Name: solute carrier family 1 (glutamate/neutral amino acid transporter), member 4
  Uniprot ID: P43007
  ENSP ID: ENSP00000431942
MNILGLVLFALVLGVALKKLGSEGEDLIRFFNSLNEATMVLVSWIMCSATLPSMMKCIEENNGVDKRISRFILPIGATVNMDGAAIFQCVAAVFIAQLNNVELNAGQIFTILVTATASSVGAAGVPAGGVLTIAIILEAIGLPTHDLPLILAVDWIVDRTTTVVNVEGDALGAGILHHLNQKATKKGEQELAEVKVEAIPNCKSEEETSPLVTHQNPAGPVASAPELESKESVL

SEQ ID NO: 80293 - protein, 564 aa, Homo sapiens
  Payload ID: 16009
  Gene Symbol: SLC1A6
  Gene Name: solute carrier family 1 (high affinity aspartate/glutamate transporter), member 6
  Uniprot ID: P48664
  ENSP ID: ENSP00000221742
MSSHGNSLFLRESGQRLGRVGWLQRLQESLQQRALRTRLRLQTMTLEHVLRFLRRNAFILLTVSAVVIGVSLAFALRPYQLTYRQIKYFSFPGELLMRMLQMLVLPLIVSSLVTGMASLDNKATGRMGMRAAVYYMVTTIIAVFIGILMVTIIHPGKGSKEGLHREGRIETIPTADAFMDLIRNMFPPNLVEACFKQFKTQYSTRVVTRTMVRTENGSEPGASMPPPFSVENGTSFLENVTRALGTLQEMLSFEETVPVPGSANGINALGLVVFSVAFGLVIGGMKHKGRVLRDFFDSLNEAIMRLVGIIIWYAPVGILFLIAGKILEMEDMAVLGGQLGMYTLTVIVGLFLHAGIVLPLIYFLVTHRNPFPFIGGMLQALITAMGTSSSSATLPITFRCLEEGLGVDRRITRFVLPVGATVNMDGTALYEALAAIFIAQVNNYELNLGQITTISITATAASVGAAGIPQAGLVTMVIVLTSVGLPTEDITLIIAVDWFLDRLRTMTNVLGDSIGAAVIEHLSQRELELQEAELTLPSLGKPYKSLMAQEKGASRGRGGNESAM

SEQ ID NO: 80294 - protein, 500 aa, Homo sapiens
  Payload ID: 16009
  Gene Symbol: SLC1A6
  Gene Name: solute carrier family 1 (high affinity aspartate/glutamate transporter), member 6
  ENSP ID: ENSP00000409386
MSIDHEQPWQQPVPAGERPAAGPGGLAAAAAGKPAAESTAHAPAPADHDPRARAALPAPKRLHSADGQRRGHWGQPGLCPAPISAHLPPDQVLLFSWRASDEDAADAGVTSHCLQPGHRNMFPPNLVEACFKQFKTQYSTRVVTRTMVRTENGSEPGASMPPPFSVENGTSFLENVTRALGTLQEMLSFEETVPVPGSANGINALGLVVFSVAFGLVIGGMKHKGRVLRDFFDSLNEAIMRLVGIIIWYAPVGILFLIAGKILEMEDMAVLGGQLGMYTLTVIVGLFLHAGIVLPLIYFLVTHRNPFPFIGGMLQALITAMGTSSSSATLPITFRCLEEGLGVDRRITRFVLPVGATVNMDGTALYEALAAIFIAQVNNYELNLGQITTISITATAASVGAAGIPQAGLVTMVIVLTSVGLPTEDITLIIAVDWFLDRLRTMTNVLGDSIGAAVIEHLSQRELELQEAELTLPSLGKPYKSLMAQEKGASRGRGGNESAM

SEQ ID NO: 80295 - protein, 312 aa, Homo sapiens
  Payload ID: 16009
  Gene Symbol: SLC1A6
  Gene Name: solute carrier family 1 (high affinity aspartate/glutamate transporter), member 6
  Uniprot ID: P48664
  ENSP ID: ENSP00000446175
MSSHGNSLFLRESGQRLGRVGWLQRLQESLQQRALRTRLRLQTMTLEHVLRFLRRNAFILLTVSAVVIGVSLAFALRPYQLTYRQIKYFSFPGELLMRMLQMLVLPLIVSSLVTGMASLDNKATGRMGMRAAVYYMVTTIIAVFIGILMVTIIHPGKGSKEGLHREGRIETIPTADAFMDLIRNMFPPNLVEACFKQFKTQYSTRVVTRTMVRTENGSEPGASMPPPFSVENGTSFLENVTRALGTLQEMLSFEETVPVPGSANGINALGLVVFSVAFGLVIGGMKHKGRVLRDFFDSLNEAIMRLVGIIIW

SEQ ID NO: 80296 - protein, 110 aa, Homo sapiens
  Payload ID: 16009
  Gene Symbol: SLC1A6
  Gene Name: solute carrier family 1 (high affinity aspartate/glutamate transporter), member 6
  ENSP ID: ENSP00000469551
MSSHGNSLFLRESGQRLGRVGWLQRLQESLQQRALRTRLRLQTMTLEHVLRFLRRNAFILLTVSAVVIGVSLAFALRPYQLTYRQIKYFSFPGELLMRMLQMLVLPLIVS

SEQ ID NO: 80297 - protein, 486 aa, Homo sapiens
  Payload ID: 16009
  Gene Symbol: SLC1A6
  Gene Name: solute carrier family 1 (high affinity aspartate/glutamate transporter), member 6
  ENSP ID: ENSP00000471038
MSSHGNSLFLRESGQRLGRVGWLQRLQESLQQRALRTRLRLQTMTLEHVLRFLRRNAFILLTVSAVVIGVSLAFALRPYQLTYRQIKYFSFPGELLMRMLQMLVLPLIVSSLVTGMASLDNKATGRMGMRAAVYYMVTTIIAVFIGILMVTIIHPGKGSKEGLHREGRIETIPTADAFMDLIRNMFPPNLVEACFKQFKTQYSTRVVTRTMVRTENGSEPGASMPPPFSVENGTSFLENVTRALGTLQEMLSFEETVPVPGSANGINALGLVVFSVAFGLVIGGMKHKGRVLRDFFDSLNEAIMRLVGIIICSATLPITFRCLEEGLGVDRRITRFVLPVGATVNMDGTALYEALAAIFIAQVNNYELNLGQITTISITATAASVGAAGIPQAGLVTMVIVLTSVGLPTEDITLIIAVDWFLDRLRTMTNVLGDSIGAAVIEHLSQRELELQEAELTLPSLGKPYKSLMAQEKGASRGRGGNESAM

SEQ ID NO: 80298 - protein, 74 aa, Homo sapiens
  Payload ID: 16009
  Gene Symbol: SLC1A6
  Gene Name: solute carrier family 1 (high affinity aspartate/glutamate transporter), member 6
  ENSP ID: ENSP00000471129
MSSHGNSLFLRESGQRLGRVGWLQRLQESLQQRALRTRLRLQTMTLEHVLRFLRRNAFILLTVSAVVIGELCLL

SEQ ID NO: 80299 - protein, 160 aa, Homo sapiens
  Payload ID: 16009
  Gene Symbol: SLC1A6
  Gene Name: solute carrier family 1 (high affinity aspartate/glutamate transporter), member 6
  ENSP ID: ENSP00000471562
MSSHGNSLFLRESGQRLGRVGWLQRLQESLQQRALRTRLRLQTMTLEHVLRFLRRNAFILLTVSAVVIGVSLAFALRPYQLTYRQIKYFSFPGELLMRMLQMLVLPLIVSSLVTGMASLDNKATGRMGMRAAVYYMVTTIIAVFIGILMVTIIHPGKGSK

SEQ ID NO: 80300 - protein, 312 aa, Homo sapiens; identical to SEQ ID NO: 80295
  Payload ID: 16009
  Gene Symbol: SLC1A6
  Gene Name: solute carrier family 1 (high affinity aspartate/glutamate transporter), member 6
  Uniprot ID: P48664
  ENSP ID: ENSP00000471781

SEQ ID NO: 80301 - protein, 35 aa, Homo sapiens
  Payload ID: 16009
  Gene Symbol: SLC1A6
  Gene Name: solute carrier family 1 (high affinity aspartate/glutamate transporter), member 6
  ENSP ID: ENSP00000472133
MSSHGNSLFLRESGQRLGRVGWLQRLQESLQQRAL

SEQ ID NO: 80302 - protein, 146 aa, Homo sapiens
  Payload ID: 16009
  Gene Symbol: SLC1A6
  Gene Name: solute carrier family 1 (high affinity aspartate/glutamate transporter), member 6
  ENSP ID: ENSP00000472837
MSIDHEQPWQQPVPAGERPAAGPGGLAAAAAGKPAAESTAHAPAPADHDPRARAALPAPKRLHSADGQRRGHWGQPGLCPAPISAHLPPDQVLLFSWRASDEDAADAGVTSHCLQPGHRYGIPGQQGHGADGDAGSCVLHGDHHHR

SEQ ID NO: 80303 - protein, 524 aa, Homo sapiens
  Payload ID: 16010
  Gene Symbol: SLC1A1
  Gene Name: solute carrier family 1 (neuronal/epithelial high affinity glutamate transporter, system Xag), member 1
  Uniprot ID: P43005
  ENSP ID: ENSP00000262352
MGKPARKGCEWKRFLKNNWVLLSTVAAVVLGITTGVLVREHSNLSTLEKFYFAFPGEILMRMLKLIILPLIISSMITGVAALDSNVSGKIGLRAVVYYFCTTLIAVILGIVLVVSIKPGVTQKVGEIARTGSTPEVSTVDAMLDLIRNMFPENLVQACFQQYKTKREEVKPPSDPEMNMTEESFTAVMTTAISKNKTKEYKIVGMYSDGINVLGLIVFCLVFGLVIGKMGEKGQILVDFFNALSDATMKIVQIIMCYMPLGILFLIAGKIIEVEDWEIFRKLGLYMATVLTGLAIHSIVILPLIYFIVVRKNPFRFAMGMAQALLTALMISSSSATLPVTFRCAEENNQVDKRITRFVLPVGATINMDGTALYEAVAAVFIAQLNDLDLGIGQIITISITATSASIGAAGVPQAGLVTMVIVLSAVGLPAEDVTLIIAVDWLLDRFRTMVNVLGDAFGTGIVEKLSKKELEQMDVSSEVNIVNPFALESTILDNEDSDTKKSYVNGGFAVDKSDTISFTQTSQF

SEQ ID NO: 80304 - protein, 242 aa, Homo sapiens
  Payload ID: 16010
  Gene Symbol: SLC1A1
  Gene Name: solute carrier family 1 (neuronal/epithelial high affinity glutamate transporter, system Xag), member 1
  ENSP ID: ENSP00000414620
  MOD_RES (1)..(1): Any amino acid
XFFNALSDATMKIVQIIMCYMPLGILFLIAGKIIEVEDWEIFRKLGLYMATVLTGLAIHSIVILPLIYFIVVRKNPFRFAMGMAQALLTALMISSSSATLPVTFRCAEENNQVDKRITRFVLPVGATINMDGTALYEAVAAVFIAQLNDLDLGIGQIITIRDRFRTMVNVLGDAFGTGIVEKLSKKELEQMDVSSEVNIVNPFALESTILDNEDSDTKKSYVNGGFAVDKSDTISFTQTSQF

SEQ ID NO: 80305 - protein, 313 aa, Homo sapiens
  Payload ID: 16011
  Gene Symbol: SLC1A5
  Gene Name: solute carrier family 1 (neutral amino acid transporter), member 5
  Uniprot ID: Q15758
  ENSP ID: ENSP00000397924
MNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 80306 - protein, 339 aa, Homo sapiens
  Payload ID: 16011
  Gene Symbol: SLC1A5
  Gene Name: solute carrier family 1 (neutral amino acid transporter), member 5
  Uniprot ID: Q15758
  ENSP ID: ENSP00000406532
MYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 80307 - protein, 541 aa, Homo sapiens
  Payload ID: 16011
  Gene Symbol: SLC1A5
  Gene Name: solute carrier family 1 (neutral amino acid transporter), member 5
  Uniprot ID: Q15758
  ENSP ID: ENSP00000444408
MVADPPRDSKGLAAAEPTANGGLALASIEDQGAAAGGYCGSRDQVRRCLRANLLVLLTVVAVVAGVALGLGVSGAGGALALGPERLSAFVFPGELLLRLLRMIILPLVVCSLIGGAASLDPGALGRLGAWALLFFLVTTLLASALGVGLALALQPGAASAAINASVGAAGSAENAPSKEVLDSFLDLARNIFPSNLVSAAFRSYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 80308 - protein, 258 aa, Homo sapiens
  Payload ID: 16011
  Gene Symbol: SLC1A5
  Gene Name: solute carrier family 1 (neutral amino acid transporter), member 5
  ENSP ID: ENSP00000468890
  MOD_RES (1)..(1): Any amino acid
XHASLLGLKEADSPSPAKGCKPSSNPAGLRNIFPSNLVSAAFRSYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITI

SEQ ID NO: 80309 - protein, 365 aa, Homo sapiens
  Payload ID: 16011
  Gene Symbol: SLC1A5
  Gene Name: solute carrier family 1 (neutral amino acid transporter), member 5
  ENSP ID: ENSP00000469265
MVSNNPLCVCLCRNIFPSNLVSAAFRSYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 80310 - protein, 29 aa, Homo sapiens
  Payload ID: 16011
  Gene Symbol: SLC1A5
  Gene Name: solute carrier family 1 (neutral amino acid transporter), member 5
  ENSP ID: ENSP00000471626
MNILGLVVFAIVFGVALRKLGPEGELLIR

SEQ ID NO: 80311 - protein, 349 aa, Homo sapiens
  Payload ID: 16012
  Gene Symbol: SLC10A1
  Gene Name: solute carrier family 10 (sodium/bile acid cotransporter), member 1
  Uniprot ID: Q14973
  ENSP ID: ENSP00000216540
MEAHNASAPFNFTLPPNFGKRPTDLALSVILVFMLFFIMLSLGCTMEFSKIKAHLWKPKGLAIALVAQYGIMPLTAFVLGKVFRLKNIEALAILVCGCSPGGNLSNVFSLAMKGDMNLSIVMTTCSTFCALGMMPLLLYIYSRGIYDGDLKDKVPYKGIVISLVLVLIPCTIGIVLKSKRPQYMRYVIKGGMIIILLCSVAVTVLSAINVGKSIMFAMTPLLIATSSLMPFIGFLLGYVLSALFCLNGRCRRTVSMETGCQNVQLCSTILNVAFPPEVIGPLFFFPLLYMIFQLGEGLLLIAIFWCYEKFKTPKDKTKMIYTAATTEETIPGALGNGTYKGEDCSPCTA

SEQ ID NO: 80312 - protein, 348 aa, Homo sapiens
  Payload ID: 16013
  Gene Symbol: SLC10A2
  Gene Name: solute carrier family 10 (sodium/bile acid cotransporter), member 2
  Uniprot ID: Q12908
  ENSP ID: ENSP00000245312
MNDPNSCVDNATVCSGASCVVPESNFNNILSVVLSTVLTILLALVMFSMGCNVEIKKFLGHIKRPWGICVGFLCQFGIMPLTGFILSVAFDILPLQAVVVLIIGCCPGGTASNILAYWVDGDMDLSVSMTTCSTLLALGMMPLCLLIYTKMWVDSGSIVIPYDNIGTSLVSLVVPVSIGMFVNHKWPQKAKIILKIGSIAGAILIVLIAVVGGILYQSAWIIAPKLWIIGTIFPVAGYSLGFLLARIAGLPWYRCRTVAFETGMQNTQLCSTIVQLSFTPEELNVVFTFPLIYSIFQLAFAAIFLGFYVAYKKCHGKNKAEIPESKENGTEPESSFYKANGGFQPDEK

SEQ ID NO: 80313 - protein, 377 aa, Homo sapiens
  Payload ID: 16014
  Gene Symbol: SLC10A6
  Gene Name: solute carrier family 10 (sodium/bile acid cotransporter), member 6
  Uniprot ID: Q3KNW5
  ENSP ID: ENSP00000273905
MRANCSSSSACPANSSEEELPVGLEVHGNLELVFTVVSTVMMGLLMFSLGCSVEIRKLWSHIRRPWGIAVGLLCQFGLMPFTAYLLAISFSLKPVQAIAVLIMGCCPGGTISNIFTFWVDGDMDLSISMTTCSTVAALGMMPLCIYLYTWSWSLQQNLTIPYQNIGITLVCLTIPVAFGVYVNYRWPKQSKIILKIGAVVGGVLLLVVAVAGVVLAKGSWNSDITLLTISFIFPLIGHVTGFLLALFTHQSWQRCRTISLETGAQNIQMCITMLQLSFTAEHLVQMLSFPLAYGLFQLIDGFLIVAAYQTYKRRLKNKHGKKNSGCTEVCHTRKSTSSRETNAFLEVNEEGAITPGPPGPMDCHRALEPVGHITSCE

SEQ ID NO: 80314 - protein, 477 aa, Homo sapiens
  Payload ID: 16015
  Gene Symbol: SLC10A3
  Gene Name: solute carrier family 10, member 3
  Uniprot ID: P09131
  ENSP ID: ENSP00000263512
MVLMQDKGSSQQWPGLGGEGGGTGPLSMLRAALLLISLPWGAQGTASTSLSTAGGHTVPPTGGRYLSIGDGSVMEFEFPEDSEGIIVISSQYPGQANRTAPGPMLRVTSLDTEVLTIKNVSAITWGGGGGFVVSIHSGLAGLAPLHIQLVDAHEAPPTLIEERRDFCIKVSPAEDTPATLSADLAHFSENPILYLLLPLIFVNKCSFGCKVELEVLKGLMQSPQPMLLGLLGQFLVMPLYAFLMAKVFMLPKALALGLIITCSSPGGGGSYLFSLLLGGDVTLAISMTFLSTVAATGFLPLSSAIYSRLLSIHETLHVPISKILGTLLFIAIPIAVGVLIKSKLPKFSQLLLQVVKPFSFVLLLGGLFLAYRMGVFILAGIRLPIVLVGITVPLVGLLVGYCLATCLKLPVAQRRTVSIEVGVQNSLLALAMLQLSLRRLQADYASQAPFIVALSGTSEMLALVIGHFIYSSLFPVP

SEQ ID NO: 80315 - protein, 448 aa, Homo sapiens
  Payload ID: 16015
  Gene Symbol: SLC10A3
  Gene Name: solute carrier family 10, member 3
  Uniprot ID: P09131
  ENSP ID: ENSP00000358663
MVLMQDKGSSQQWPGLGGEGGGTGPLSMLRAALLLISLPWGAQGTASTSLSTAGGHTVPPTGGRYLSIGDGSVMEFEFPEDSEGIIVISSQYPGQANRTAPGPMLRVTSLDTEVLTIKNLVDAHEAPPTLIEERRDFCIKVSPAEDTPATLSADLAHFSENPILYLLLPLIFVNKCSFGCKVELEVLKGLMQSPQPMLLGLLGQFLVMPLYAFLMAKVFMLPKALALGLIITCSSPGGGGSYLFSLLLGGDVTLAISMTFLSTVAATGFLPLSSAIYSRLLSIHETLHVPISKILGTLLFIAIPIAVGVLIKSKLPKFSQLLLQVVKPFSFVLLLGGLFLAYRMGVFILAGIRLPIVLVGITVPLVGLLVGYCLATCLKLPVAQRRTVSIEVGVQNSLLALAMLQLSLRRLQADYASQAPFIVALSGTSEMLALVIGHFIYSSLFPVP

SEQ ID NO: 80316 - protein, 532 aa, Homo sapiens
  Payload ID: 16015
  Gene Symbol: SLC10A3
  Gene Name: solute carrier family 10, member 3
  ENSP ID: ENSP00000377211
MAGPRPPGDSPAIKEDSTGLGPTHEPFSGQPNSTSGDVLLSRRGPGHAIRPPGRAMVLMQDKGSSQQWPGLGGEGGGTGPLSMLRAALLLISLPWGAQGTASTSLSTAGGHTVPPTGGRYLSIGDGSVMEFEFPEDSEGIIVISSQYPGQANRTAPGPMLRVTSLDTEVLTIKNVSAITWGGGGGFVVSIHSGLAGLAPLHIQLVDAHEAPPTLIEERRDFCIKVSPAEDTPATLSADLAHFSENPILYLLLPLIFVNKCSFGCKVELEVLKGLMQSPQPMLLGLLGQFLVMPLYAFLMAKVFMLPKALALGLIITCSSPGGGGSYLFSLLLGGDVTLAISMTFLSTVAATGFLPLSSAIYSRLLSIHETLHVPISKILGTLLFIAIPIAVGVLIKSKLPKFSQLLLQVVKPFSFVLLLGGLFLAYRMGVFILAGIRLPIVLVGITVPLVGLLVGYCLATCLKLPVAQRRTVSIEVGVQNSLLALAMLQLSLRRLQADYASQAPFIVALSGTSEMLALVIGHFIYSSLFPVP

SEQ ID NO: 80317 - protein, 477 aa, Homo sapiens; identical to SEQ ID NO: 80314
  Payload ID: 16015
  Gene Symbol: SLC10A3
  Gene Name: solute carrier family 10, member 3
  Uniprot ID: P09131
  ENSP ID: ENSP00000377212

SEQ ID NO: 80318 - protein, 218 aa, Homo sapiens
  Payload ID: 16015
  Gene Symbol: SLC10A3
  Gene Name: solute carrier family 10, member 3
  ENSP ID: ENSP00000395702
MVLMQDKGSSQQWPGLGGEGGGTGPLSMLRAALLLISLPWGAQGTASTSLSTAGGHTVPPTGGRYLSIGDGSVMEFEFPEDSEGIIVISSQYPGQANRTAPGPMLRVTSLDTEVLTIKNVSAITWGGGGGFVVSIHSGLAGLAPLHIQLVDAHEAPPTLIEERRDFCIKVSPAEDTPATLSADLAHFSENPILYLLLPLIFVNKCSFGCKVELEVLKG

SEQ ID NO: 80319 - protein, 437 aa, Homo sapiens
  Payload ID: 16016
  Gene Symbol: SLC10A4
  Gene Name: solute carrier family 10, member 4
  Uniprot ID: Q96EP9
  ENSP ID: ENSP00000273861
MDGNDNVTLLFAPLLRDNYTLAPNASSLGPGTDLALAPASSAGPGPGLSLGPGPSFGFSPGPTPTPEPTTSGLAGGAASHGPSPFPRPWAPHALPFWDTPLNHGLNVFVGAALCITMLGLGCTVDVNHFGAHVRRPVGALLAALCQFGLLPLLAFLLALAFKLDEVAAVAVLLCGCCPGGNLSNLMSLLVDGDMNLSIIMTISSTLLALVLMPLCLWIYSWAWINTPIVQLLPLGTVTLTLCSTLIPIGLGVFIRYKYSRVADYIVKVSLWSLLVTLVVLFIMTGTMLGPELLASIPAAVYVIAIFMPLAGYASGYGLATLFHLPPNCKRTVCLETGSQNVQLCTAILKLAFPPQFIGSMYMFPLLYALFQSAEAGIFVLIYKMYGSEMLHKRDPLDEDEDTDISYKKLKEEEMADTSYGTVKAENIIMMETAQTSL

SEQ ID NO: 80320 - protein, 438 aa, Homo sapiens
  Payload ID: 16017
  Gene Symbol: SLC10A5
  Gene Name: solute carrier family 10, member 5
  Uniprot ID: Q5PT55
  ENSP ID: ENSP00000428612
MIRKLFIVLLLLLVTIEEARMSSLSFLNIEKTEILFFTKTEETILVSSSYENKRPNSSHLFVKIEDPKILQMVNVAKKISSDATNFTINLVTDEEGETNVTIQLWDSEGRQERLIEEIKNVKVKVLKQKDSLLQAPMHIDRNILMLILPLILLNKCAFGCKIELQLFQTVWKRPLPVILGAVTQFFLMPFCGFLLSQIVALPEAQAFGVVMTCTCPGGGGGYLFALLLDGDFTLAILMTCTSTLLALIMMPVNSYIYSRILGLSGTFHIPVSKIVSTLLFILVPVSIGIVIKHRIPEKASFLERIIRPLSFILMFVGIYLTFTVGLVFLKTDNLEVILLGLLVPALGLLFGYSFAKVCTLPLPVCKTVAIESGMLNSFLALAVIQLSFPQSKANLASVAPFTVAMCSGCEMLLIILVYKAKKRCIFFLQDKRKRNFLI

SEQ ID NO: 80321 - protein, 340 aa, Homo sapiens
  Payload ID: 16018
  Gene Symbol: SLC10A7
  Gene Name: solute carrier family 10, member 7
  Uniprot ID: Q0GE19
  ENSP ID: ENSP00000334594
MRLLERMRKDWFMVGIVLAIAGAKLEPSIGVNGGPLKPEITVSYIAVATIFFNSGLSLKTEELTSALVHLKLHLFIQIFTLAFFPATIWLFLQLLSITPINEWLLKGLQTVGCMPPPVSSAVILTKAVGGNEAAAIFNSAFGSFLGIVITPLLLLLFLGSSSSVPFTSIFSQLFMTVVVPLIIGQIVRRYIKDWLERKKPPFGAISSSVLLMIIYTTFCDTFSNPNIDLDKFSLVLILFIIFSIQLSFMLLTFIFSTRNNSGFTPADTVAIIFCSTHKSLTLGIPMLKIVFAGHEHLSLISVPLLIYHPAQILLGSVLVPTIKSWMVSRQKGVKLTRPTV

SEQ ID NO: 80322 - protein, 159 aa, Homo sapiens
  Payload ID: 16018
  Gene Symbol: SLC10A7
  Gene Name: solute carrier family 10, member 7
  Uniprot ID: Q0GE19
  ENSP ID: ENSP00000377623
MRLLERMRKDWFMVGIVLAIAGAKLEPSIGVNGGPLKPEITVSYIAVATIFFNSGLSLKTEELTSALVHLKLHLFIQIFTLAFFPATIWLFLQLLSITPINEWLLKGLQTVGCMPPPVSSAVILTKAVGGNEAAAIFNSAFGSFLVSKHSLTCLLQLLL

SEQ ID NO: 80323 - protein, 327 aa, Homo sapiens
  Payload ID: 16018
  Gene Symbol: SLC10A7
  Gene Name: solute carrier family 10, member 7
  Uniprot ID: Q0GE19
  ENSP ID: ENSP00000411297
MRLLERMRKDWFMVGIVLAIAGAKLEPSIGVNGGPLKPEITVSYIAVATIFFNSGLSLKTEELTSALVHLKLHLFIQIFTLAFFPATIWLFLQLLSITPINEWLLKGLQTVGCMPPPVSSAVILTKAVGGNEGIVITPLLLLLFLGSSSSVPFTSIFSQLFMTVVVPLIIGQIVRRYIKDWLERKKPPFGAISSSVLLMIIYTTFCDTFSNPNIDLDKFSLVLILFIIFSIQLSFMLLTFIFSTRNNSGFTPADTVAIIFCSTHKSLTLGIPMLKIVFAGHEHLSLISVPLLIYHPAQILLGSVLVPTIKSWMVSRQKGVKLTRPTV

SEQ ID NO: 80324 - protein, 358 aa, Homo sapiens
  Payload ID: 16018
  Gene Symbol: SLC10A7
  Gene Name: solute carrier family 10, member 7
  Uniprot ID: Q0GE19
  ENSP ID: ENSP00000421275
MRLLERMRKDWFMVGIVLAIAGAKLEPSIGVNGGPLKPEITVSYIAVATIFFNSGLSLKTEELTSALVHLKLHLFIQIFTLAFFPATIWLFLQLLSITPINEWLLKGLQTVGCMPPPVSSAVILTKAVGGNEAAAIFNSAFGSFLGIVITPLLLLLFLGSSSSVPFTSIFSQLFMTVVVPLIIGQIVRRYIKDWLERKKPPFGAISSSVLLMIIYTTFCDTFSNPNIDLDKFSLVLILFIIFSIQLSFMLLTFIFSTRNNSGFTPADTVAIIFCSTHKSLTLGIPMLKIVFAGHEHLSLISVPLLIYHPAQILLGSVLVPTIKSWMVSRQKKLLQTRGPLANLNNPEGLEYLSIKFGH

SEQ ID NO: 80325 - protein, 85 aa, Homo sapiens
  Payload ID: 16018
  Gene Symbol: SLC10A7
  Gene Name: solute carrier family 10, member 7
  Uniprot ID: Q0GE19
  ENSP ID: ENSP00000421603
MRLLERMRKDWFMVGIVLAIAGAKLEPSIGVNGGPLKPEITVSYIAVATIFFNSGLSLKTEFADSRLHASACVFCSDFNQGSWWK

SEQ ID NO: 80326 - protein, 64 aa, Homo sapiens
  Payload ID: 16018
  Gene Symbol: SLC10A7
  Gene Name: solute carrier family 10, member 7
  Uniprot ID: Q0GE19
  ENSP ID: ENSP00000422577
MRLLERMRKDWFMVGIVLAIAGAKLEPSIGVNGGPLKPEITVSYIAVATIFFNSGLSLKTELLT

SEQ ID NO: 80327 - protein, 550 aa, Homo sapiens
  Payload ID: 16019
  Gene Symbol: SLC11A1
  Gene Name: solute carrier family 11 (proton-coupled divalent metal ion transporter), member 1
  Uniprot ID: P49279
  ENSP ID: ENSP00000233202
MTGDKGPQRLSGSSYGSISSPTSPTSPGPQQAPPRETYLSEKIPIPDTKPGTFSLRKLWAFTGPGFLMSIAFLDPGNIESDLQAGAVAGFKLLWVLLWATVLGLLCQRLAARLGVVTGKDLGEVCHLYYPKVPRTVLWLTIELAIVGSDMQEVIGTAIAFNLLSAGRIPLWGGVLITIVDTFFFLFLDNYGLRKLEAFFGLLITIMALTFGYEYVVARPEQGALLRGLFLPSCPGCGHPELLQAVGIVGAIIMPHNIYLHSALVKSREIDRARRADIREANMYFLIEATIALSVSFIINLFVMAVFGQAFYQKTNQAAFNICANSSLHDYAKIFPMNNATVAVDIYQGGVILGCLFGPAALYIWAIGLLAAGQSSTMTGTYAGQFVMEGFLRLRWSRFARVLLTRSCAILPTVLVAVFRDLRDLSGLNDLLNVLQSLLLPFAVLPILTFTSMPTLMQEFANGLLNKVVTSSIMVLVCAINLYFVVSYLPSLPHPAYFGLAALLAAAYLGLSTYLVWTCCLAHGATFLAHSSHHHFLYGLLEEDQKGETSG

SEQ ID NO: 80328 - protein, 163 aa, Homo sapiens
  Payload ID: 16019
  Gene Symbol: SLC11A1
  Gene Name: solute carrier family 11 (proton-coupled divalent metal ion transporter), member 1
  ENSP ID: ENSP00000346320
MTGDKGPQRLSGSSYGSISSPTSPTSPGPQQAPPRETYLSEKIPIPDTKPGTFSLRKLWAFTGPGFLMSIAFLDPGNIESDLQAGAVAGFKLLWVLLWATVLGLLCQRLAARLGVVTGKDLGEVCHLYYPKSESRSVAQSGVQWCDVSSLQPLPPRCPAPSSG

SEQ ID NO: 80329 - protein, 82 aa, Homo sapiens
  Payload ID: 16019
  Gene Symbol: SLC11A1
  Gene Name: solute carrier family 11 (proton-coupled divalent metal ion transporter), member 1
  ENSP ID: ENSP00000443435
MTGHLQPAEAMGLHGAWLPHEHCFPGPRKHRVRSSGWRRGGIQTSLGAALGHRVGLALPATGCTSGRGDRQGLGRGLPSLLP

SEQ ID NO: 80330 - protein, 41 aa, Homo sapiens
  Payload ID: 16019
  Gene Symbol: SLC11A1
  Gene Name: solute carrier family 11 (proton-coupled divalent metal ion transporter), member 1
  ENSP ID: ENSP00000483970
MTASLGAALGHRVGLALPATGCTSGRGDRQGLGRGLPSLLP

SEQ ID NO: 80331 - protein, 90 aa, Homo sapiens
  Payload ID: 16019
  Gene Symbol: SLC11A1
  Gene Name: solute carrier family 11 (proton-coupled divalent metal ion transporter), member 1
  ENSP ID: ENSP00000484905
MTGDKGPQRLSGSSYGSISSPTSPTSPGPQQAPPRETYLSEKIPIPDTKPETSSQIFRLAPWRDSNFSGCCSGPPCWACSASDWLHVWAW

SEQ ID NO: 80332 - protein, 568 aa, Homo sapiens
  Payload ID: 16020
  Gene Symbol: SLC11A2
  Gene Name: solute carrier family 11 (proton-coupled divalent metal ion transporter), member 2
  Uniprot ID: P49281
  ENSP ID: ENSP00000262051
MVLGPEQKMSDDSVSGDHGESASLGNINPAYSNPSLSQSPGDSEEYFATYFNEKISIPEEEYSCFSFRKLWAFTGPGFLMSIAYLDPGNIESDLQSGAVAGFKLLWILLLATLVGLLLQRLAARLGVVTGLHLAEVCHRQYPKVPRVILWLMVELAIIGSDMQEVIGSAIAINLLSVGRIPLWGGVLITIADTFVFLFLDKYGLRKLEAFFGFLITIMALTFGYEYVTVKPSQSQVLKGMFVPSCSGCRTPQIEQAVGIVGAVIMPHNMYLHSALVKSRQVNRNNKQEVREANKYFFIESCIALFVSFIINVFVVSVFAEAFFGKTNEQVVEVCTNTSSPHAGLFPKDNSTLAVDIYKGGVVLGCYFGPAALYIWAVGILAAGQSSTMTGTYSGQFVMEGFLNLKWSRFARVVLTRSIAIIPTLLVAVFQDVEHLTGMNDFLNVLQSLQLPFALIPILTFTSLRPVMSDFANGLGWRIAGGILVLIICSINMYFVVVYVRDLGHVALYVVAAVVSVAYLGFVFYLGWQCLIALGMSFLDCGHTCHLGLTAQPELYLLNTMDADSLVSR

SEQ ID NO: 80333 - protein, 561 aa, Homo sapiens
  Payload ID: 16020
  Gene Symbol: SLC11A2
  Gene Name: solute carrier family 11 (proton-coupled divalent metal ion transporter), member 2
  Uniprot ID: P49281
  ENSP ID: ENSP00000262052
MVLGPEQKMSDDSVSGDHGESASLGNINPAYSNPSLSQSPGDSEEYFATYFNEKISIPEEEYSCFSFRKLWAFTGPGFLMSIAYLDPGNIESDLQSGAVAGFKLLWILLLATLVGLLLQRLAARLGVVTGLHLAEVCHRQYPKVPRVILWLMVELAIIGSDMQEVIGSAIAINLLSVGRIPLWGGVLITIADTFVFLFLDKYGLRKLEAFFGFLITIMALTFGYEYVTVKPSQSQVLKGMFVPSCSGCRTPQIEQAVGIVGAVIMPHNMYLHSALVKSRQVNRNNKQEVREANKYFFIESCIALFVSFIINVFVVSVFAEAFFGKTNEQVVEVCTNTSSPHAGLFPKDNSTLAVDIYKGGVVLGCYFGPAALYIWAVGILAAGQSSTMTGTYSGQFVMEGFLNLKWSRFARVVLTRSIAIIPTLLVAVFQDVEHLTGMNDFLNVLQSLQLPFALIPILTFTSLRPVMSDFANGLGWRIAGGILVLIICSINMYFVVVYVRDLGHVALYVVAAVVSVAYLGFVFYLGWQCLIALGMSFLDCGHTVSISKGLLTEEATRGYVK

SEQ ID NO: 80334 - protein, 590 aa, Homo sapiens
  Payload ID: 16020
  Gene Symbol: SLC11A2
  Gene Name: solute carrier family 11 (proton-coupled divalent metal ion transporter), member 2
  Uniprot ID: P49281
  ENSP ID: ENSP00000378364
MRKKQLKTEAAPHCELKSYSKNSATQVSTMVLGPEQKMSDDSVSGDHGESASLGNINPAYSNPSLSQSPGDSEEYFATYFNEKISIPEEEYSCFSFRKLWAFTGPGFLMSIAYLDPGNIESDLQSGAVAGFKLLWILLLATLVGLLLQRLAARLGVVTGLHLAEVCHRQYPKVPRVILWLMVELAIIGSDMQEVIGSAIAINLLSVGRIPLWGGVLITIADTFVFLFLDKYGLRKLEAFFGFLITIMALTFGYEYVTVKPSQSQVLKGMFVPSCSGCRTPQIEQAVGIVGAVIMPHNMYLHSALVKSRQVNRNNKQEVREANKYFFIESCIALFVSFIINVFVVSVFAEAFFGKTNEQVVEVCTNTSSPHAGLFPKDNSTLAVDIYKGGVVLGCYFGPAALYIWAVGILAAGQSSTMTGTYSGQFVMEGFLNLKWSRFARVVLTRSIAIIPTLLVAVFQDVEHLTGMNDFLNVLQSLQLPFALIPILTFTSLRPVMSDFANGLGWRIAGGILVLIICSINMYFVVVYVRDLGHVALYVVAAVVSVAYLGFVFYLGWQCLIALGMSFLDCGHTVSISKGLLTEEATRGYVK

SEQ ID NO: 80335 - protein, 557 aa, Homo sapiens
  Payload ID: 16020
  Gene Symbol: SLC11A2
  Gene Name: solute carrier family 11 (proton-coupled divalent metal ion transporter), member 2
  Uniprot ID: P49281
  ENSP ID: ENSP00000442810
MSTVDYLNSVSGDHGESASLGNINPAYSNPSLSQSPGDSEEYFATYFNEKISIPEEEYSCFSFRKLWAFTGPGFLMSIAYLDPGNIESDLQSGAVAGFKLLWILLLATLVGLLLQRLAARLGVVTGLHLAEVCHRQYPKVPRVILWLMVELAIIGSDMQEVIGSAIAINLLSVGRIPLWGGVLITIADTFVFLFLDKYGLRKLEAFFGFLITIMALTFGYEYVTVKPSQSQVLKGMFVPSCSGCRTPQIEQAVGIVGAVIMPHNMYLHSALVKSRQVNRNNKQEVREANKYFFIESCIALFVSFIINVFVVSVFAEAFFGKTNEQVVEVCTNTSSPHAGLFPKDNSTLAVDIYKGGVVLGCYFGPAALYIWAVGILAAGQSSTMTGTYSGQFVMEGFLNLKWSRFARVVLTRSIAIIPTLLVAVFQDVEHLTGMNDFLNVLQSLQLPFALIPILTFTSLRPVMSDFANGLGWRIAGGILVLIICSINMYFVVVYVRDLGHVALYVVAAVVSVAYLGFVFYLGWQCLIALGMSFLDCGHTVSISKGLLTEEATRGYVK

SEQ ID NO: 80336 - protein, 561 aa, Homo sapiens; identical to SEQ ID NO: 80333
  Payload ID: 16020
  Gene Symbol: SLC11A2
  Gene Name: solute carrier family 11 (proton-coupled divalent metal ion transporter), member 2
  Uniprot ID: P49281
  ENSP ID: ENSP00000444542

SEQ ID NO: 80337 - protein, 73 aa, Homo sapiens
  Payload ID: 16020
  Gene Symbol: SLC11A2
  Gene Name: solute carrier family 11 (proton-coupled divalent metal ion transporter), member 2
  ENSP ID: ENSP00000446653
MVLGPEQKMSDDSVSGDHGESASLGNINPAYSNPSLSQSPGDSEEYFATYFNEKISIPEEENKRLMEPAVLLF

SEQ ID NO: 80338 - protein, 568 aa, Homo sapiens; identical to SEQ ID NO: 80332
  Payload ID: 16020
  Gene Symbol: SLC11A2
  Gene Name: solute carrier family 11 (proton-coupled divalent metal ion transporter), member 2
  Uniprot ID: P49281
  ENSP ID: ENSP00000446769

SEQ ID NO: 80339 - protein, 482 aa, Homo sapiens
  Payload ID: 16020
  Gene Symbol: SLC11A2
  Gene Name: solute carrier family 11 (proton-coupled divalent metal ion transporter), member 2
  ENSP ID: ENSP00000446914
MSIAYLDPGNIESDLQSGAVAGFKLLWILLLATLVGLLLQRLAARLGVVTGLHLAEVCHRQYPKVPRVILWLMVELAIIGSDMQEVIGSAIAINLLSVGRIPLWGGVLITIADTFVFLFLDKYGLRKLEAFFGFLITIMALTFGYEYVTVKPSQSQVLKGMFVPSCSGCRTPQIEQAVGIVGAVIMPHNMYLHSALVKSRQVNRNNKQEVREANKYFFIESCIALFVSFIINVFVVSVFAEAFFGKTNEQVVEVCTNTSSPHAGLFPKDNSTLAVDIYKGGVVLGCYFGPAALYIWAVGILAAGQSSTMTGTYSGQFVMEGFLNLKWSRFARVVLTRSIAIIPTLLVAVFQDVEHLTGMNDFLNVLQSLQLPFALIPILTFTSLRPVMSDFANGLGWRIAGGILVLIICSINMYFVVVYVRDLGHVALYVVAAVVSVAYLGFVFYLGWQCLIALGMSFLDCGHTVSISKGLLTEEATRGYVK

SEQ ID NO: 80340 - protein, 147 aa, Homo sapiens
  Payload ID: 16020
  Gene Symbol: SLC11A2
  Gene Name: solute carrier family 11 (proton-coupled divalent metal ion transporter), member 2
  ENSP ID: ENSP00000446984
MTVFLEIMGSLPVLYSCFSFRKLWAFTGPGFLMSIAYLDPGNIESDLQSGAVAGFKLLWILLLATLVGLLLQRLAARLGVVTGLHLAEVCHRQYPKVPRVILWLMVELAIIGSDMQEVIGSAIAINLLSVGRIPLWGGVLITIADTF

SEQ ID NO: 80341 - protein, 98 aa, Homo sapiens
  Payload ID: 16020
  Gene Symbol: SLC11A2
  Gene Name: solute carrier family 11 (proton-coupled divalent metal ion transporter), member 2
  ENSP ID: ENSP00000447102
MSIAYLDPGNIESDLQSGAVAGFKLLWILLLATLVGLLLQRLAARLGVVTGLHLAEVCHRQYPKVPRVILWLMVELAIIGSDMQEVIGSAIAINLLSV

SEQ ID NO: 80342 - protein, 87 aa, Homo sapiens
  Payload ID: 16020
  Gene Symbol: SLC11A2
  Gene Name: solute carrier family 11 (proton-coupled divalent metal ion transporter), member 2
  ENSP ID: ENSP00000447334
MSIAYLDPGNIESDLQSGAVAGFKLLWILLLATLVGLLLQRLAARLGVVTGLHLAEVCHRQYPKVPRVILWLMVELAIIGSDMQEVI

SEQ ID NO: 80343 - protein, 150 aa, Homo sapiens
  Payload ID: 16020
  Gene Symbol: SLC11A2
  Gene Name: solute carrier family 11 (proton-coupled divalent metal ion transporter), member 2
  ENSP ID: ENSP00000447482
MSIAYLDPGNIESDLQSGAVAGFKLLWILLLATLVGLLLQRLAARLGVVTGLHLAEVCHRQYPKVPRVILWLMVELAIIGSDMQEVIGSAIAINLLSVGRIPLWGGVLITIADTFVFLFLDKYGLRKLEAFFGFLITIMALTFGYEYVTV

SEQ ID NO: 80344 - protein, 3 aa, Homo sapiens
  Payload ID: 16020
  Gene Symbol: SLC11A2
  Gene Name: solute carrier family 11 (proton-coupled divalent metal ion transporter), member 2
  ENSP ID: ENSP00000448273
MVL

SEQ ID NO: 80345 - protein, 80 aa, Homo sapiens
  Payload ID: 16020
  Gene Symbol: SLC11A2
  Gene Name: solute carrier family 11 (proton-coupled divalent metal ion transporter), member 2
  ENSP ID: ENSP00000448501
MVLGPEQKMSDDSVSGDHGESASLGNINPAYSNPSLSQSPGDSEEYFATYFNEKISIPEEEARVQWCNPGSPQPPPPAFK

SEQ ID NO: 80346 - protein, 568 aa, Homo sapiens; identical to SEQ ID NO: 80332
  Payload ID: 16020
  Gene Symbol: SLC11A2
  Gene Name: solute carrier family 11 (proton-coupled divalent metal ion transporter), member 2
  Uniprot ID: P49281
  ENSP ID: ENSP00000449008

SEQ ID NO: 80347 - protein, 590 aa, Homo sapiens; identical to SEQ ID NO: 80334
  Payload ID: 16020
  Gene Symbol: SLC11A2
  Gene Name: solute carrier family 11 (proton-coupled divalent metal ion transporter), member 2
  Uniprot ID: P49281
  ENSP ID: ENSP00000449200

SEQ ID NO: 80348 - protein, 149 aa, Homo sapiens
  Payload ID: 16020
  Gene Symbol: SLC11A2
  Gene Name: solute carrier family 11 (proton-coupled divalent metal ion transporter), member 2
  ENSP ID: ENSP00000449209
MVLGPEQKMSDDSVSGDHGESASLGNINPAYSNPSLSQSPGDSEEYFATYFNEKISIPEEEYSCFSFRKLWAFTGPGFLMSIAYLDPGNIESDLQSGAVAGFKLLWILLLATLVGLLLQRLAARLGVVTGLHLAEVCHRQYPKVPRVIL

SEQ ID NO: 80349 - protein, 126 aa, Homo sapiens
  Payload ID: 16020
  Gene Symbol: SLC11A2
  Gene Name: solute carrier family 11 (proton-coupled divalent metal ion transporter), member 2
  ENSP ID: ENSP00000450227
  MOD_RES (1)..(1): Any amino acid
XVLQSLQLPFALIPILTFTSLRPVMSDFANGLGWRIAGGILVLIICSINMYFVVVYVRDLGHVALYVVAAVVSVAYLGFVFYLGWQCLIALGMSFLDCGHTCHLGLTAQPELYLLNTMDADSLVSR

SEQ ID NO: 80350 - protein, 153 aa, Homo sapiens
  Payload ID: 16020
  Gene Symbol: SLC11A2
  Gene Name: solute carrier family 11 (proton-coupled divalent metal ion transporter), member 2
  ENSP ID: ENSP00000450389
MVLGPEQKMSDDSVSGDHGESASLGNINPAYSNPSLSQSPGDSEEYFATYFNEKISIPEEEVPRVILWLMVELAIIGSDMQEVIGSAIAINLLSVGRIPLWGGVLITIADTFVFLFLDKYGLRKLEAFFGFLITIMALTFGYEYVTVKPSQSQ

SEQ ID NO: 80351 - protein, 1085 aa, Homo sapiens
  Payload ID: 16021
  Gene Symbol: SLC12A4
  Gene Name: solute carrier family 12 (potassium/chloride transporter), member 4
  Uniprot ID: Q9UP95
  ENSP ID: ENSP00000318557
MPHFTVVPVDGPRRGDYDNLEGLSWVDYGERAELDDSDGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENYMEFLEVLTEGLERVLLVRGGGREVITIYS

SEQ ID NO: 80352 - protein, 1087 aa, Homo sapiens
  Payload ID: 16021
  Gene Symbol: SLC12A4
  Gene Name: solute carrier family 12 (potassium/chloride transporter), member 4
  Uniprot ID: Q9UP95
  ENSP ID: ENSP00000395983
MRAGGACRPGAAGTAAGTAAGGWDGGCGGAEPARCLTSPWCQWTGRGAATMTTSRGSVGWTTGSAPSWMTRTEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENYMEFLEVLTEGLERVLLVRGGGREVITIYS

SEQ ID NO: 80353 - protein, 1054 aa, Homo sapiens
  Payload ID: 16021
  Gene Symbol: SLC12A4
  Gene Name: solute carrier family 12 (potassium/chloride transporter), member 4
  Uniprot ID: Q9UP95
  ENSP ID: ENSP00000438334
MGDTLSPGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENYMEFLEVLTEGLERVLLVRGGGREVITIYS

SEQ ID NO: 80354 - protein, 1079 aa, Homo sapiens
  Payload ID: 16021
  Gene Symbol: SLC12A4
  Gene Name: solute carrier family 12 (potassium/chloride transporter), member 4
  Uniprot ID: Q9UP95
  ENSP ID: ENSP00000445962
MAAEGAVCGFVYLEGTAWAVPEDTEPLASCTLGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENYMEFLEVLTEGLERVLLVRGGGREVITIYS

SEQ ID NO: 80355 - protein, 1068 aa, Homo sapiens
  Payload ID: 16021
  Gene Symbol: SLC12A4
  Gene Name: solute carrier family 12 (potassium/chloride transporter), member 4
  Uniprot ID: Q9UP95
  ENSP ID: ENSP00000458902
MPHFTVVPVDGPRRGDYDNLEGLSWVDYGERAELDDSDGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENCIPLWRGRQLGGG

SEQ ID NO: 80356 - protein, 54 aa, Homo sapiens
  Payload ID: 16021
  Gene Symbol: SLC12A4
  Gene Name: solute carrier family 12 (potassium/chloride transporter), member 4
  ENSP ID: ENSP00000458975
MPHFTVVPVDGPRRGDYDNLEGLSWVDYGERAELDDSDDLHCPTSCHFLPIGCS

SEQ ID NO: 80357 - protein, 1037 aa, Homo sapiens
  Payload ID: 16021
  Gene Symbol: SLC12A4
  Gene Name: solute carrier family 12 (potassium/chloride transporter), member 4
  ENSP ID: ENSP00000461403
MTTSRGSVGWTTGSAPSWMTRTEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENYMEFLEVLTEGLERVLLVRGGGREVITIYS

SEQ ID NO: 80358 - protein, 19 aa, Homo sapiens
  Payload ID: 16021
  Gene Symbol: SLC12A4
  Gene Name: solute carrier family 12 (potassium/chloride transporter), member 4
  ENSP ID: ENSP00000463148
  MOD_RES (1)..(1): Any amino acid
XPDNFRELVHIKPMAHGDL

SEQ ID NO: 80359 - protein, 178 aa, Homo sapiens
  Payload ID: 16021
  Gene Symbol: SLC12A4
  Gene Name: solute carrier family 12 (potassium/chloride transporter), member 4
  ENSP ID: ENSP00000464168
MGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGG

SEQ ID NO: 80360 - protein, 90 aa, Homo sapiens
  Payload ID: 16021
  Gene Symbol: SLC12A4
  Gene Name: solute carrier family 12 (potassium/chloride transporter), member 4
  ENSP ID: ENSP00000464660
  MOD_RES (1)..(1): Any amino acid
XPQLLVLLKLDEDLHVKYPRLLTFASQLKAGKGLTIVGSVIQGSFLESYGEAQAAEQTPCAALRLPTWPCSCPRTSPSTPATTSATWRAT

SEQ ID NO: 80361 - protein, 1116 aa, Homo sapiens
  Payload ID: 16022
  Gene Symbol: SLC12A5
  Gene Name: solute carrier family 12 (potassium/chloride transporter), member 5
  Uniprot ID: Q9H2X9
  ENSP ID: ENSP00000243964
MLNNLTDCEDGDGGANPGDGNPKESSPFINSTDTEKGKEYDGKNMALFEEEMDTSPMVSSLLSGLANYTNLPQGSREHEEAENNEGGKKKPVQAPRMGTFMGVYLPCLQNIFGVILFLRLTWVVGIAGIMESFCMVFICCSCTMLTAISMSAIATNGVVPAGGSYYMISRSLGPEFGGAVGLCFYLGTTFAGAMYILGTIEILLAYLFPAMAIFKAEDASGEAAAMLNNMRVYGTCVLTCMATVVFVGVKYVNKFALVFLGCVILSILAIYAGVIKSAFDPPNFPICLLGNRTLSRHGFDVCAKLAWEGNETVTTRLWGLFCSSRFLNATCDEYFTRNNVTEIQGIPGAASGLIKENLWSSYLTKGVIVERSGMTSVGLADGTPIDMDHPYVFSDMTSYFTLLVGIYFPSVTGIMAGSNRSGDLRDAQKSIPTGTILAIATTSAVYISSVVLFGACIEGVVLRDKFGEAVNGNLVVGTLAWPSPWVIVIGSFFSTCGAGLQSLTGAPRLLQAISRDGIVPFLQVFGHGKANGEPTWALLLTACICEIGILIASLDEVAPILSMFFLMCYMFVNLACAVQTLLRTPNWRPRFRYYHWTLSFLGMSLCLALMFICSWYYALVAMLIAGLIYKYIEYRGAEKEWGDGIRGLSLSAARYALLRLEEGPPHTKNWRPQLLVLVRVDQDQNVVHPQLLSLTSQLKAGKGLTIVGSVLEGTFLENHPQAQRAEESIRRLMEAEKVKGFCQVVISSNLRDGVSHLIQSGGLGGLQHNTVLVGWPRNWRQKEDHQTWRNFIELVRETTAGHLALLVTKNVSMFPGNPERFSEGSIDVWWIVHDGGMLMLLPFLLRHHKVWRKCKMRIFTVAQMDDNSIQMKKDLTTFLYHLRITAEVEVVEMHESDISAYTYEKTLVMEQRSQILKQMHLTKNEREREIQSITDESRGSIRRKNPANTRLRLNVPEETAGDSEEKPEEEVQLIHDQSAPSCPSSSPSPGEEPEGEGETDPEKVHLTWTKDKSVAEKNKGPSPVSSEGIKDFFSMKPEWENLNQSNVRRMHTAVRLNEVIVKKSRDAKLVLLNMPGPPRNRNGDENYMEFLEVLTEHLDRVMLVRGGGREVITIYS

SEQ ID NO: 80362 - protein, 1139 aa, Homo sapiens
  Payload ID: 16022
  Gene Symbol: SLC12A5
  Gene Name: solute carrier family 12 (potassium/chloride transporter), member 5
  Uniprot ID: Q9H2X9
  ENSP ID: ENSP00000387694
MSRRFTVTSLPPAGPARSPDPESRRHSVADPRHLPGEDVKGDGNPKESSPFINSTDTEKGKEYDGKNMALFEEEMDTSPMVSSLLSGLANYTNLPQGSREHEEAENNEGGKKKPVQAPRMGTFMGVYLPCLQNIFGVILFLRLTWVVGIAGIMESFCMVFICCSCTMLTAISMSAIATNGVVPAGGSYYMISRSLGPEFGGAVGLCFYLGTTFAGAMYILGTIEILLAYLFPAMAIFKAEDASGEAAAMLNNMRVYGTCVLTCMATVVFVGVKYVNKFALVFLGCVILSILAIYAGVIKSAFDPPNFPICLLGNRTLSRHGFDVCAKLAWEGNETVTTRLWGLFCSSRFLNATCDEYFTRNNVTEIQGIPGAASGLIKENLWSSYLTKGVIVERSGMTSVGLADGTPIDMDHPYVFSDMTSYFTLLVGIYFPSVTGIMAGSNRSGDLRDAQKSIPTGTILAIATTSAVYISSVVLFGACIEGVVLRDKFGEAVNGNLVVGTLAWPSPWVIVIGSFFSTCGAGLQSLTGAPRLLQAISRDGIVPFLQVFGHGKANGEPTWALLLTACICEIGILIASLDEVAPILSMFFLMCYMFVNLACAVQTLLRTPNWRPRFRYYHWTLSFLGMSLCLALMFICSWYYALVAMLIAGLIYKYIEYRGAEKEWGDGIRGLSLSAARYALLRLEEGPPHTKNWRPQLLVLVRVDQDQNVVHPQLLSLTSQLKAGKGLTIVGSVLEGTFLENHPQAQRAEESIRRLMEAEKVKGFCQVVISSNLRDGVSHLIQSGGLGGLQHNTVLVGWPRNWRQKEDHQTWRNFIELVRETTAGHLALLVTKNVSMFPGNPERFSEGSIDVWWIVHDGGMLMLLPFLLRHHKVWRKCKMRIFTVAQMDDNSIQMKKDLTTFLYHLRITAEVEVVEMHESDISAYTYEKTLVMEQRSQILKQMHLTKNEREREIQSITDESRGSIRRKNPANTRLRLNVPEETAGDSEEKPEEEVQLIHDQSAPSCPSSSPSPGEEPEGEGETDPEKVHLTWTKDKSVAEKNKGPSPVSSEGIKDFFSMKPEWENLNQSNVRRMHTAVRLNEVIVKKSRDAKLVLLNMPGPPRNRNGDENYMEFLEVLTEHLDRVMLVRGGGREVITIYS

SEQ ID NO: 80363 - protein, 186 aa, Homo sapiens
  Payload ID: 16022
  Gene Symbol: SLC12A5
  Gene Name: solute carrier family 12 (potassium/chloride transporter), member 5
  ENSP ID: ENSP00000446091
MLNNLTDCEDGDGGANPGDGNPKESSPFINSTDTEKGKEYDGKNMALFEEEMDTSPMVSSLLSGLANYTNLPQGSREHEEAENNEGGKKKPVQAPRMGTFMGVYLPCLQNIFGVILFLRLTWVVGIAGIMESFCMVFICCSCTMLTAISMSAIATNGVVPAGGSYYMISRSLAMARPMESRPGPCS

SEQ ID NO: 80364 - protein, 123 aa, Homo sapiens
  Payload ID: 16022
  Gene Symbol: SLC12A5
  Gene Name: solute carrier family 12 (potassium/chloride transporter), member 5
  ENSP ID: ENSP00000476885
MALFEEEMDTSPMVSSLLSGLANYTNLPQGSREHEEAENNEGGKKKPVQAPRMGTFMGVYLPCLQNIFGVILFLRLTWVVGIAGIMESFCMVFICCSCTMLTAISMSAIATNGVVPAGGSYYM

SEQ ID NO: 80365 - protein, 262 aa, Homo sapiens
  Payload ID: 16022
  Gene Symbol: SLC12A5
  Gene Name: solute carrier family 12 (potassium/chloride transporter), member 5
  ENSP ID: ENSP00000477569
MLNNLTDCEDGDGGANPGDGNPKESSPFINSTDTEKGKEYDGKNMALFEEEMDTSPMVSSLLSGLANYTNLPQGSREHEEAENNEGGKKKPVQAPRMGTFMGVYLPCLQNIFGVILFLRLTWVVGIAGIMESFCMVFICCSCTMLTAISMSAIATNGVVPAGGSYYMISRSLGPEFGGAVGLCFYLGTTFAGAMYILGTIEILLSLTLLPRLEGSGAVTDSLDFPGSNDPPHQFSLPSSWLTSSQPWPSSRQKMPVGRQQPC

SEQ ID NO: 80366 - protein, 289 aa, Homo sapiens
  Payload ID: 16022
  Gene Symbol: SLC12A5
  Gene Name: solute carrier family 12 (potassium/chloride transporter), member 5
  ENSP ID: ENSP00000478369
MLNNLTDCEDGDGGANPGDGNPKESSPFINSTDTEKGKEYDGKNMALFEEEMDTSPMVSSLLSGLANYTNLPQGSREHEEAENNEGGKKKPVQAPRMGTFMGVYLPCLQNIFGVILFLRLTWVVGIAGIMESFCMVFICCSCTMLTAISMSAIATNGVVPAGGSYYMISRSLGPEFGGAVGLCFYLGTTFAGAMYILGTIEILLRREQPLLIGSYASWGQDRGGVLLKRKKPRGPRPTEEAPPRCLRWGAGVSPQSACRLLPVSHGSSPKTEIVELEGAPSPEFPPWDK

SEQ ID NO: 80367 - protein, 459 aa, Homo sapiens [sequence omitted]

SEQ ID NO: 80368 - protein, 180 aa, Homo sapiens
  Payload ID: 16022
  Gene Symbol: SLC12A5
  Gene Name: solute carrier family 12 (potassium/chloride transporter), member 5
  ENSP ID: ENSP00000485953
MLNNLTDCEDGDGGANPGDGNPKESSPFINSTDTEKGKEYDGKNMALFEEEMDTSPMVSSLLSGLANYTNLPQGSREHEEAENNEGGKKKPVQAPRMGTFMGVYLPCLQNIFGVILFLRLTWVVGIAGIMESFCMVFICCSCTMLTAISMSAIATNGVVPAGGSYYMISRLSGWQEQSFR

SEQ ID NO: 80369 - protein, 53 aa, Homo sapiens
  Payload ID: 16022
  Gene Symbol: SLC12A5
  Gene Name: solute carrier family 12 (potassium/chloride transporter), member 5
  ENSP ID: ENSP00000486382
MSRRFTVTSLPPAGPARSPDPESRRHSVADPRHLPGEDVKANPTDPHVLAIHL

SEQ ID NO: 80370 - protein, 67 aa, Homo sapiens
  Payload ID: 16022
  Gene Symbol: SLC12A5
  Gene Name: solute carrier family 12 (potassium/chloride transporter), member 5
  ENSP ID: ENSP00000487291
  MOD_RES (1)..(1): Any amino acid
XHSVADPRHLPGEDVKVAPARGGGGGGGGGGGRGGGGRGGGRGGGGEGGGEASPDRQGSLPSRSKSN

SEQ ID NO: 80371 - protein, 120 aa, Homo sapiens
  Payload ID: 16022
  Gene Symbol: SLC12A5
  Gene Name: solute carrier family 12 (potassium/chloride transporter), member 5
  ENSP ID: ENSP00000487372
MSRRFTVTSLPPAGPARSPDPESRRHSVADPRHLPGEDVKVSPQGALIRGPLPGSEALGSGRNKANRLVVAPARGGGGGGGGGGGRGGGGRGGGRGGGGEGGGEASPDRQGSLPSRSKSN

SEQ ID NO: 80372 - protein, 58 aa, Homo sapiens
  Payload ID: 16022
  Gene Symbol: SLC12A5
  Gene Name: solute carrier family 12 (potassium/chloride transporter), member 5
  ENSP ID: ENSP00000487449
MLNNLTDCEDGDGGANPGDGNPKESSPFINSTDTEKGKEYDGKNMALFEPPSTDTLPP

SEQ ID NO: 80373 - protein, 1099 aa, Homo sapiens
  Payload ID: 16023
  Gene Symbol: SLC12A6
  Gene Name: solute carrier family 12 (potassium/chloride transporter), member 6
  Uniprot ID: Q9UHW9
  ENSP ID: ENSP00000290209
MPHFTVTKVEDPEEGAAASISQEPSLADIKARIQDSDEPDLSQNSITGEHSQLLDDGHKKARNAYLNNSNYEEGDEYFDKNLALFEEEMDTRPKVSSLLNRMANYTNLTQGAKEHEEAENITEGKKKPTKTPQMGTFMGVYLPCLQNIFGVILFLRLTWVVGTAGVLQAFAIVLICCCCTMLTAISMSAIATNGVVPAGGSYFMISRALGPEFGGAVGLCFYLGTTFAAAMYILGAIEIFLVYIVPRAAIFHSDDALKESAAMLNNMRVYGTAFLVLMVLVVFIGVRYVNKFASLFLACVIVSILAIYAGAIKSSFAPPHFPVCMLGNRTLSSRHIDVCSKTKEINNMTVPSKLWGFFCNSSQFFNATCDEYFVHNNVTSIQGIPGLASGIITENLWSNYLPKGEIIEKPSAKSSDVLGSLNHEYVLVDITTSFTLLVGIFFPSVTGIMAGSNRSGDLKDAQKSIPIGTILAILTTSFVYLSNVVLFGACIEGVVLRDKFGDAVKGNLVVGTLSWPSPWVIVIGSFFSTCGAGLQSLTGAPRLLQAIAKDNIIPFLRVFGHSKANGEPTWALLLTAAIAELGILIASLDLVAPILSMFFLMCYLFVNLACALQTLLRTPNWRPRFRYYHWALSFMGMSICLALMFISSWYYAIVAMVIAGMIYKYIEYQGAEKEWGDGIRGLSLSAARFALLRLEEGPPHTKNWRPQLLVLLKLDEDLHVKHPRLLTFASQLKAGKGLTIVGSVIVGNFLENYGEALAAEQTIKHLMEAEKVKGFCQLVVAAKLREGISHLIQSCGLGGMKHNTVVMGWPNGWRQSEDARAWKTFIGTVRVTTAAHLALLVAKNISFFPSNVEQFSEGNIDVWWIVHDGGMLMLLPFLLKQHKVWRKCSIRIFTVAQLEDNSIQMKKDLATFLYHLRIEAEVEVVEMHDSDISAYTYERTLMMEQRSQMLRHMRLSKTERDREAQLVKDRNSMLRLTSIGSDEDEETETYQEKVHMTWTKDKYMASRGQKAKSMEGFQDLLNMRPDQSNVRRMHTAVKLNEVIVNKSHEAKLVLLNMPGPPRNPEGDENYMEFLEVLTEGLERVLLVRGGGSEVITIYS

SEQ ID NO: 80374 - protein, 1150 aa, Homo sapiens
  Payload ID: 16023
  Gene Symbol: SLC12A6
  Gene Name: solute carrier family 12 (potassium/chloride transporter), member 6
  Uniprot ID: Q9UHW9
  ENSP ID: ENSP00000346112
MHPPETTTKMASVRFMVTPTKIDDIPGLSDTSPDLSSRSSSRVRFSSRESVPETSRSEPMSEMSGATTSLATVALDPPSDRTSHPQDVIEDLSQNSITGEHSQLLDDGHKKARNAYLNNSNYEEGDEYFDKNLALFEEEMDTRPKVSSLLNRMANYTNLTQGAKEHEEAENITEGKKKPTKTPQMGTFMGVYLPCLQNIFGVILFLRLTWVVGTAGVLQAFAIVLICCCCTMLTAISMSAIATNGVVPAGGSYFMISRALGPEFGGAVGLCFYLGTTFAAAMYILGAIEIFLVYIVPRAAIFHSDDALKESAAMLNNMRVYGTAFLVLMVLVVFIGVRYVNKFASLFLACVIVSILAIYAGAIKSSFAPPHFPVCMLGNRTLSSRHIDVCSKTKEINNMTVPSKLWGFFCNSSQFFNATCDEYFVHNNVTSIQGIPGLASGIITENLWSNYLPKGEIIEKPSAKSSDVLGSLNHEYVLVDITTSFTLLVGIFFPSVTGIMAGSNRSGDLKDAQKSIPIGTILAILTTSFVYLSNVVLFGACIEGVVLRDKFGDAVKGNLVVGTLSWPSPWVIVIGSFFSTCGAGLQSLTGAPRLLQAIAKDNIIPFLRVFGHSKANGEPTWALLLTAAIAELGILIASLDLVAPILSMFFLMCYLFVNLACALQTLLRTPNWRPRFRYYHWALSFMGMSICLALMFISSWYYAIVAMVIAGMIYKYIEYQGAEKEWGDGIRGLSLSAARFALLRLEEGPPHTKNWRPQLLVLLKLDEDLHVKHPRLLTFASQLKAGKGLTIVGSVIVGNFLENYGEALAAEQTIKHLMEAEKVKGFCQLVVAAKLREGISHLIQSCGLGGMKHNTVVMGWPNGWRQSEDARAWKTFIGTVRVTTAAHLALLVAKNISFFPSNVEQFSEGNIDVWWIVHDGGMLMLLPFLLKQHKVWRKCSIRIFTVAQLEDNSIQMKKDLATFLYHLRIEAEVEVVEMHDSDISAYTYERTLMMEQRSQMLRHMRLSKTERDREAQLVKDRNSMLRLTSIGSDEDEETETYQEKVHMTWTKDKYMASRGQKAKSMEGFQDLLNMRPDQSNVRRMHTAVKLNEVIVNKSHEAKLVLLNMPGPPRNPEGDENYMEFLEVLTEGLERVLLVRGGGSEVITIYS

SEQ ID NO: 80375 - protein, 1091 aa, Homo sapiens
  Payload ID: 16023
  Gene Symbol: SLC12A6
  Gene Name: solute carrier family 12 (potassium/chloride transporter), member 6
  Uniprot ID: Q9UHW9
  ENSP ID: ENSP00000380814
MSEMSGATTSLATVALDPPSDRTSHPQDVIEDLSQNSITGEHSQLLDDGHKKARNAYLNNSNYEEGDEYFDKNLALFEEEMDTRPKVSSLLNRMANYTNLTQGAKEHEEAENITEGKKKPTKTPQMGTFMGVYLPCLQNIFGVILFLRLTWVVGTAGVLQAFAIVLICCCCTMLTAISMSAIATNGVVPAGGSYFMISRALGPEFGGAVGLCFYLGTTFAAAMYILGAIEIFLVYIVPRAAIFHSDDALKESAAMLNNMRVYGTAFLVLMVLVVFIGVRYVNKFASLFLACVIVSILAIYAGAIKSSFAPPHFPVCMLGNRTLSSRHIDVCSKTKEINNMTVPSKLWGFFCNSSQFFNATCDEYFVHNNVTSIQGIPGLASGIITENLWSNYLPKGEIIEKPSAKSSDVLGSLNHEYVLVDITTSFTLLVGIFFPSVTGIMAGSNRSGDLKDAQKSIPIGTILAILTTSFVYLSNVVLFGACIEGVVLRDKFGDAVKGNLVVGTLSWPSPWVIVIGSFFSTCGAGLQSLTGAPRLLQAIAKDNIIPFLRVFGHSKANGEPTWALLLTAAIAELGILIASLDLVAPILSMFFLMCYLFVNLACALQTLLRTPNWRPRFRYYHWALSFMGMSICLALMFISSWYYAIVAMVIAGMIYKYIEYQGAEKEWGDGIRGLSLSAARFALLRLEEGPPHTKNWRPQLLVLLKLDEDLHVKHPRLLTFASQLKAGKGLTIVGSVIVGNFLENYGEALAAEQTIKHLMEAEKVKGFCQLVVAAKLREGISHLIQSCGLGGMKHNTVVMGWPNGWRQSEDARAWKTFIGTVRVTTAAHLALLVAKNISFFPSNVEQFSEGNIDVWWIVHDGGMLMLLPFLLKQHKVWRKCSIRIFTVAQLEDNSIQMKKDLATFLYHLRIEAEVEVVEMHDSDISAYTYERTLMMEQRSQMLRHMRLSKTERDREAQLVKDRNSMLRLTSIGSDEDEETETYQEKVHMTWTKDKYMASRGQKAKSMEGFQDLLNMRPDQSNVRRMHTAVKLNEVIVNKSHEAKLVLLNMPGPPRNPEGDENYMEFLEVLTEGLERVLLVRGGGSEVITIYS

SEQ ID NO: 80376 - protein, 1135 aa, Homo sapiens
  Payload ID: 16023
  Gene Symbol: SLC12A6
  Gene Name: solute carrier family 12 (potassium/chloride transporter), member 6
  Uniprot ID: Q9UHW9
  ENSP ID: ENSP00000380819
MHPPETTTKMASVRFMVTPTKIDDIPGLSDTSPDLSSRSSSRVRFSSRESVPETSRSEPMSEMSGATTSLATVALDPPSDRTSHPQDVIEDDGHKKARNAYLNNSNYEEGDEYFDKNLALFEEEMDTRPKVSSLLNRMANYTNLTQGAKEHEEAENITEGKKKPTKTPQMGTFMGVYLPCLQNIFGVILFLRLTWVVGTAGVLQAFAIVLICCCCTMLTAISMSAIATNGVVPAGGSYFMISRALGPEFGGAVGLCFYLGTTFAAAMYILGAIEIFLVYIVPRAAIFHSDDALKESAAMLNNMRVYGTAFLVLMVLVVFIGVRYVNKFASLFLACVIVSILAIYAGAIKSSFAPPHFPVCMLGNRTLSSRHIDVCSKTKEINNMTVPSKLWGFFCNSSQFFNATCDEYFVHNNVTSIQGIPGLASGIITENLWSNYLPKGEIIEKPSAKSSDVLGSLNHEYVLVDITTSFTLLVGIFFPSVTGIMAGSNRSGDLKDAQKSIPIGTILAILTTSFVYLSNVVLFGACIEGVVLRDKFGDAVKGNLVVGTLSWPSPWVIVIGSFFSTCGAGLQSLTGAPRLLQAIAKDNIIPFLRVFGHSKANGEPTWALLLTAAIAELGILIASLDLVAPILSMFFLMCYLFVNLACALQTLLRTPNWRPRFRYYHWALSFMGMSICLALMFISSWYYAIVAMVIAGMIYKYIEYQGAEKEWGDGIRGLSLSAARFALLRLEEGPPHTKNWRPQLLVLLKLDEDLHVKHPRLLTFASQLKAGKGLTIVGSVIVGNFLENYGEALAAEQTIKHLMEAEKVKGFCQLVVAAKLREGISHLIQSCGLGGMKHNTVVMGWPNGWRQSEDARAWKTFIGTVRVTTAAHLALLVAKNISFFPSNVEQFSEGNIDVWWIVHDGGMLMLLPFLLKQHKVWRKCSIRIFTVAQLEDNSIQMKKDLATFLYHLRIEAEVEVVEMHDSDISAYTYERTLMMEQRSQMLRHMRLSKTERDREAQLVKDRNSMLRLTSIGSDEDEETETYQEKVHMTWTKDKYMASRGQKAKSMEGFQDLLNMRPDQSNVRRMHTAVKLNEVIVNKSHEAKLVLLNMPGPPRNPEGDENYMEFLEVLTEGLERVLLVRGGGSEVITIYS

SEQ ID NO: 80377 - protein, 1091 aa, Homo sapiens; identical to SEQ ID NO: 80375
  Payload ID: 16023
  Gene Symbol: SLC12A6
  Gene Name: solute carrier family 12 (potassium/chloride transporter), member 6
  Uniprot ID: Q9UHW9
  ENSP ID: ENSP00000387725

SEQ ID NO: 80378 - protein, 962 aa, Homo sapiens
  Payload ID: 16023
  Gene Symbol: SLC12A6
  Gene Name: solute carrier family 12 (potassium/chloride transporter), member 6
  ENSP ID: ENSP00000452705
MDTRPKVSSLLNRMANYTNLTQGAKEHEEAENITEGKKKPTKTMLTAISMSAIATNGVVPAGGSYFMISRALGPEFGGAVGLCFYLGTTFAAAMYILGAIEIFLVYIVPRAAIFHSDDALKESAAMLNNMRVYGTAFLVLMVLVVFIGVRYVNKFASLFLACVIVSILAIYAGAIKSSFAPPHFPVCMLGNRTLSSRHIDVCSKTKEINNMTVPSKLWGFFCNSSQFFNATCDEYFVHNNVTSIQGIPGLASGIITENLWSNYLPKGEIIEKPSAKSSDVLGSLNHEYVLVDITTSFTLLVGIFFPSVTGIMAGSNRSGDLKDAQKSIPIGTILAILTTSFVYLSNVVLFGACIEGVVLRDKFGDAVKGNLVVGTLSWPSPWVIVIGSFFSTCGAGLQSLTGAPRLLQAIAKDNIIPFLRVFGHSKANGEPTWALLLTAAIAELGILIASLDLVAPILSMFFLMCYLFVNLACALQTLLRTPNWRPRFRYYHWALSFMGMSICLALMFISSWYYAIVAMVIAGMIYKYIEYQGAEKEWGDGIRGLSLSAARFALLRLEEGPPHTKNWRPQLLVLLKLDEDLHVKHPRLLTFASQLKAGKGLTIVGSVIVGNFLENYGEALAAEQTIKHLMEAEKVKGFCQLVVAAKLREGISHLIQSCGLGGMKHNTVVMGWPNGWRQSEDARAWKTFIGTVRVTTAAHLALLVAKNISFFPSNVEQFSEGNIDVWWIVHDGGMLMLLPFLLKQHKVWRKCSIRIFTVAQLEDNSIQMKKDLATFLYHLRIEAEVEVVEMHDSDISAYTYERTLMMEQRSQMLRHMRLSKTERDREAQLVKDRNSMLRLTSIGSDEDEETETYQEKVHMTWTKDKYMASRGQKAKSMEGFQDLLNMRPDQSNVRRMHTAVKLNEVIVNKSHEAKLVLLNMPGPPRNPEGDENYMEFLEVLTEGLERVLLVRGGGSEVITIYS

SEQ ID NO: 80379 - protein, 152 aa, Homo sapiens
  Payload ID: 16023
  Gene Symbol: SLC12A6
  Gene Name: solute carrier family 12 (potassium/chloride transporter), member 6
  ENSP ID: ENSP00000452771
MASVRFMVTPTKIDDIPGLSDTSPDLSSRSSSRVRFSSRESVPETSRSEPMSEMSGATTSLATVALDPPSDRTSHPQDVIEDLSQNSITGEHSQLLDDGHKKARNAYLNNSNYEEGDEYFDKNLALFEEEMDTRPKVSSLLNRMANYTNLTQ

SEQ ID NO: 80380 - protein, 1141 aa, Homo sapiens
  Payload ID: 16023
  Gene Symbol: SLC12A6
  Gene Name: solute carrier family 12 (potassium/chloride transporter), member 6
  Uniprot ID: Q9UHW9
  ENSP ID: ENSP00000452776
MASVRFMVTPTKIDDIPGLSDTSPDLSSRSSSRVRFSSRESVPETSRSEPMSEMSGATTSLATVALDPPSDRTSHPQDVIEDLSQNSITGEHSQLLDDGHKKARNAYLNNSNYEEGDEYFDKNLALFEEEMDTRPKVSSLLNRMANYTNLTQGAKEHEEAENITEGKKKPTKTPQMGTFMGVYLPCLQNIFGVILFLRLTWVVGTAGVLQAFAIVLICCCCTMLTAISMSAIATNGVVPAGGSYFMISRALGPEFGGAVGLCFYLGTTFAAAMYILGAIEIFLVYIVPRAAIFHSDDALKESAAMLNNMRVYGTAFLVLMVLVVFIGVRYVNKFASLFLACVIVSILAIYAGAIKSSFAPPHFPVCMLGNRTLSSRHIDVCSKTKEINNMTVPSKLWGFFCNSSQFFNATCDEYFVHNNVTSIQGIPGLASGIITENLWSNYLPKGEIIEKPSAKSSDVLGSLNHEYVLVDITTSFTLLVGIFFPSVTGIMAGSNRSGDLKDAQKSIPIGTILAILTTSFVYLSNVVLFGACIEGVVLRDKFGDAVKGNLVVGTLSWPSPWVIVIGSFFSTCGAGLQSLTGAPRLLQAIAKDNIIPFLRVFGHSKANGEPTWALLLTAAIAELGILIASLDLVAPILSMFFLMCYLFVNLACALQTLLRTPNWRPRFRYYHWALSFMGMSICLALMFISSWYYAIVAMVIAGMIYKYIEYQGAEKEWGDGIRGLSLSAARFALLRLEEGPPHTKNWRPQLLVLLKLDEDLHVKHPRLLTFASQLKAGKGLTIVGSVIVGNFLENYGEALAAEQTIKHLMEAEKVKGFCQLVVAAKLREGISHLIQSCGLGGMKHNTVVMGWPNGWRQSEDARAWKTFIGTVRVTTAAHLALLVAKNISFFPSNVEQFSEGNIDVWWIVHDGGMLMLLPFLLKQHKVWRKCSIRIFTVAQLEDNSIQMKKDLATFLYHLRIEAEVEVVEMHDSDISAYTYERTLMMEQRSQMLRHMRLSKTERDREAQLVKDRNSMLRLTSIGSDEDEETETYQEKVHMTWTKDKYMASRGQKAKSMEGFQDLLNMRPDQSNVRRMHTAVKLNEVIVNKSHEAKLVLLNMPGPPRNPEGDENYMEFLEVLTEGLERVLLVRGGGSEVITIYS

SEQ ID NO: 80381 - protein, 135 aa, Homo sapiens
  Payload ID: 16023
  Gene Symbol: SLC12A6
  Gene Name: solute carrier family 12 (potassium/chloride transporter), member 6
  ENSP ID: ENSP00000452828
MHPPETTTKMASVRFMVTPTKIDDIPGLSDTSPDLSSRSSSRVRFSSRESVPETSRSEPMSEMSGATTSLATVALDPPSDRTSHPQDVIEDLSQNSITGEHSQLLDDGHKKARNAYLNNSNYEEGDEYFDKNLAL

SEQ ID NO: 80382 - protein, 60 aa, Homo sapiens
  Payload ID: 16023
  Gene Symbol: SLC12A6
  Gene Name: solute carrier family 12 (potassium/chloride transporter), member 6
  ENSP ID: ENSP00000452857
MSEMSGATTSLATVALDPPSDRTSHPQDVIEDLSQNSITGEHSQLLDDGHKKARNAYLNN

SEQ ID NO: 80383 - protein, 942 aa, Homo sapiens
  Payload ID: 16023
  Gene Symbol: SLC12A6
  Gene Name: solute carrier family 12 (potassium/chloride transporter), member 6
  ENSP ID: ENSP00000452904
MSEMSGATTSLATVALDPPSDRTSHPQDVIEDLSQNSITGEHSQLLDDGHKKARNAYLNNSNYEEGDEYFDKNLALFEEEMDTRPKVSSLLNRMANYTNLTQGAKEHEEAENITEGKKKPTKTPQMGTFMGVYLPCLQNIFGVILFLRLTWVVGTAGVLQAFAIVLICCCCTMLTAISMSAIATNGVVPAGGSYFMISRALGPEFGGAVGLCFYLGTTFAAAMYILGAIEIFLVYIVPRAAIFHSDDALKESAAMLNNMRVYGTAFLVLMVLVVFIGVRYVNKFASLFLACVIVSILAIYAGAIKSSFAPPHFPVCMLGNRTLSSRHIDVCSKTKEINNMTVPSKLWGFFCNSSQFFNATCDEYFVHNNVTSIQGIPGLASGIITENLWSNYLPKGEIIEKPSAKSSDVLGSLNHEYVLVDITTSFTLLVGIFFPSVTGIMAGSNRSGDLKDAQKSIPIGTILAILTTSFVYLSNVVLFGACIEGVVLRDKFGDAVKGNLVVGTLSWPSPWVIVIGSFFSTCGAGLQSLTGAPRLLQAIAKDNIIPFLRVFGHSKANGEPTWALLLTAAIAELGILIASLDLVAPILSMFFLMCYLFVNLACALQTLLRTPNWRPRFRYYHWALSFMGMSICLALMFISSWYYAIVAMVIAGMIYKYIEYQGAEKEWGDGIRGLSLSAARFALLRLEEGPPHTKNWRPQLLVLLKLDEDLHVKHPRLLTFASQLKAGKGLTIVGSVIVGNFLENYGEALAAEQTIKHLMEAEKVKGFCQLVVAAKLREGISHLIQSCGLGGMKHNTVVMGWPNGWRQSEDARAWKTFIGTVRVTTAAHLALLVAKNISFFPSNVEQFSEGNIDVWWIVHDGGMLMLLPFLLKQHKVWRKCSIRIFTVAQLEDNSIQMKKDLATFLYHLRIEAEVEVVEMVRKLSLRYKSMTVIYQHILTSAL

SEQ ID NO: 80384 - protein, 1150 aa, Homo sapiens; identical to SEQ ID NO: 80374
  Payload ID: 16023
  Gene Symbol: SLC12A6
  Gene Name: solute carrier family 12 (potassium/chloride transporter), member 6
  Uniprot ID: Q9UHW9
  ENSP ID: ENSP00000453473

SEQ ID NO: 80385 - protein, 906 aa, Homo sapiens
  Payload ID: 16023
  Gene Symbol: SLC12A6
  Gene Name: solute carrier family 12 (potassium/chloride transporter), member 6
  ENSP ID: ENSP00000453702
MHPPETTTKMASVRFMVTPTKIDDIPGLSDTSPDLSSRSSSRVRFSSRESVPETSRSEPMSEMSGATTSLATVALDPPSDRTSHPQDVIEDLSQNSITGEHSQLLDDGHKKARNAYLNNSNYEEGDEYFDKNLALFEEEMDTRPKVSSLLNRMANYTNLTQGAKEHEEAENITEGKKKPTKTPQMGTFMGVYLPCLQNIFGVILFLRLTWVVGTAGVLQAFAIVLICCCCTMLTAISMSAIATNGVVPAGGSYFMISRALGPEFGGAVGLCFYLGTTFAAAMYILGAIEIFLVYIVPRAAIFHSDDALKESAAMLNNMRVYGTAFLVLMVLVVFIGVRYVNKFASLFLACVIVSILAIYAGAIKSSFAPPHFPVCMLGNRTLSSRHIDVCSKTKEINNMTVPSKLWGFFCNSSQFFNATCDEYFVHNNVTSIQGIPGLASGIITENLWSNYLPKGEIIEKPSAKSSDVLGSLNHEYVLVDITTSFTLLVGIFFPSVTGIMAGSNRSGDLKDAQKSIPIGTILAILTTSFVYLSNVVLFGACIEGVVLRDKFGDAVKGNLVVGTLSWPSPWVIVIGSFFSTCGAGLQSLTGAPRLLQAIAKDNIIPFLRVFGHSKANGEPTWALLLTAAIAELGILIASLDLVAPILSMFFLMCYLFVNLACALQTLLRTPNWRPRFRYYHWALSFMGMSICLALMFISSWYYAIVAMVIAGMIYKYIEYQGAEKEWGDGIRGLSLSAARFALLRLEEGPPHTKNWRPQLLVLLKLDEDLHVKHPRLLTFASQLKAGKGLTIVGSVIVGNFLENYGEALAAEQTIKHLMEAEKVKGFCQLVVAAKLREGISHLIQSCGLGGMKHNTVVMGWPNGWRQSEDARAWKTFIAMWSNFLRATLMCGGLCMMGGCLCYYHSY

SEQ ID NO: 80386 - protein, 107 aa, Homo sapiens
  Payload ID: 16023
  Gene Symbol: SLC12A6
  Gene Name: solute carrier family 12 (potassium/chloride transporter), member 6
  ENSP ID: ENSP00000454037
MDTRPKVSSLLNRMANYTNLTQGAKEHEEAENITEGKKKPTKTPQMGTFMGVYLPCLQNIFGVILFLRLTWVVGTAGVLQAFAIVLICCCCTMLTAISMSAIATNGV

SEQ ID NO: 80387 - protein, 906 aa, Homo sapiens; identical to SEQ ID NO: 80385
  Payload ID: 16023
  Gene Symbol: SLC12A6
  Gene Name: solute carrier family 12 (potassium/chloride transporter), member 6
  ENSP ID: ENSP00000454069

SEQ ID NO: 80388 - protein, 1150 aa, Homo sapiens; identical to SEQ ID NO: 80374
  Payload ID: 16023
  Gene Symbol: SLC12A6
  Gene Name: solute carrier family 12 (potassium/chloride transporter), member 6
  Uniprot ID: Q9UHW9
  ENSP ID: ENSP00000454168

SEQ ID NO: 80389 - protein, 1083 aa, Homo sapiens
  Payload ID: 16024
  Gene Symbol: SLC12A7
  Gene Name: solute carrier family 12 (potassium/chloride transporter), member 7
  Uniprot ID: Q9Y666
  ENSP ID: ENSP00000264930
MPTNFTVVPVEAHADGGGDETAERTEAPGTPEGPEPERPSPGDGNPRENSPFLNNVEVEQESFFEGKNMALFEEEMDSNPMVSSLLNKLANYTNLSQGVVEHEEDEESRRREAKAPRMGTFIGVYLPCLQNILGVILFLRLTWIVGVAGVLESFLIVAMCCTCTMLTAISMSAIATNGVVPAGGSYYMISRSLGPEFGGAVGLCFYLGTTFAGAMYILGTIEIFLTYISPGAAIFQAEAAGGEAAAMLHNMRVYGTCTLVLMALVVFVGVKYVNKLALVFLACVVLSILAIYAGVIKSAFDPPDIPVCLLGNRTLSRRSFDACVKAYGIHNNSATSALWGLFCNGSQPSAACDEYFIQNNVTEIQGIPGAASGVFLENLWSTYAHAGAFVEKKGVPSVPVAEESRASALPYVLTDIAASFTLLVGIYFPSVTGIMAGSNRSGDLKDAQKSIPTGTILAIVTTSFIYLSCIVLFGACIEGVVLRDKFGEALQGNLVIGMLAWPSPWVIVIGSFFSTCGAGLQSLTGAPRLLQAIARDGIVPFLQVFGHGKANGEPTWALLLTVLICETGILIASLDSVAPILSMFFLMCYLFVNLACAVQTLLRTPNWRPRFKFYHWTLSFLGMSLCLALMFICSWYYALSAMLIAGCIYKYIEYRGAEKEWGDGIRGLSLNAARYALLRVEHGPPHTKNWRPQVLVMLNLDAEQAVKHPRLLSFTSQLKAGKGLTIVGSVLEGTYLDKHMEAQRAEENIRSLMSTEKTKGFCQLVVSSSLRDGMSHLIQSAGLGGLKHNTVLMAWPASWKQEDNPFSWKNFVDTVRDTTAAHQALLVAKNVDSFPQNQERFGGGHIDVWWIVHDGGMLMLLPFLLRQHKVWRKCRMRIFTVAQVDDNSIQMKKDLQMFLYHLRISAEVEVVEMVENDISAFTYERTLMMEQRSQMLKQMQLSKNEQEREAQLIHDRNTASHTAAAARTQAPPTPDKVQMTWTREKLIAEKYRSRDTSLSGFKDLFSMKPDQSNVRRMHTAVKLNGVVLNKSQDAQLVLLNMPGPPKNRQGDENYMEFLEVLTEGLNRVLLVRGGGREVITIYS

SEQ ID NO: 80390 - protein, 355 aa, Homo sapiens
  Payload ID: 16024
  Gene Symbol: SLC12A7
  Gene Name: solute carrier family 12 (potassium/chloride transporter), member 7
  ENSP ID: ENSP00000428854
  MOD_RES (1)..(1): Any amino acid
XYYALSAMLIAGCIYKYIEYRGAEKEWGDGIRGLSLNAARYALLRVEHGPPHTKNWRPQVLVMLNLDAEQAVKHPRLLSFTSQLKAGKGLTIVGSVLEGTYLDKHMEAQRAEENIRSLMSTEKTKGFCQLVVSSSLRDGMSHLIQSAGLGGLKHNTVLMAWPASWKQEDNPFSWKNFVDTVRDTTAAHQALLVAKNVDSFPQNQERFGGGHIDVWWIVHDGGMLMLLPFLLRQHKVWRKCRMRIFTVAQVDDNSIQMKKDLQMFLYHLRISAEVEVVEMVENDISAFTYERTLMMEQRSQMLKQMQLSKNEQEREAQLIHDRNTASHTAAAARTQAPPTPDKVQMTWTREKLIAE

SEQ ID NO: 80391 - protein, 1083 aa, Homo sapiens
  Payload ID: 16024
  Gene Symbol: SLC12A7
  Gene Name: solute carrier family 12 (potassium/chloride transporter), member 7
  ENSP ID: ENSP00000482242
MPTNFTVVPVEAHADGGGDETAERTEAPGTPEGPEPERPSPGDGNPRENSPFLNNVEVEQESFFEGKNMALFEEEMDSNPMVSSLLNKLANYTNLSQGVVEHEEDEESRRREAKAPRMGTFIGVYLPCLQNILGVILFLRLTWIVGVAGVLESFLIVAMCCTCTMLTAISMSAIATNGVVPAGGSYYMISRSLGPEFGGAVGLCFYLGTTFAGAMYILGTIEIFLTYISPGAAIFQAEAAGGEAAAMLHNMRVYGTCTLVLMALVVFVGVKYVNKLALVFLACVVLSILAIYAGVIKSAFDPPDIPVCLLGNRTLSRRSFDACVKAYGIHNNSATSALWGLFCNGSQPSAACDEYFIQNNVTEIQGIPGAASGVFLENLWSTYAHAGAFVEKKGVPSVPVAEESRASTLPYVLTDIAASFTLLVGIYFPSVTGIMAGSNRSGDLKDAQKSIPTGTILAIVTTSFIYLSCIVLFGACIEGVVLRDKFGEALQGNLVIGMLAWPSPWVIVIGSFFSTCGAGLQSLTGAPRLLQAIARDGIVPFLQVFGHGKANGEPTWALLLTVLICETGILIASLDSVAPILSMFFLMCYLFVNLACAVQTLLRTPNWRPRFKFYHWTLSFLGMSLCLALMFICSWYYALSAMLIAGCIYKYIEYRGAEKEWGDGIRGLSLNAARYALLRVEHGPPHTKNWRPQVLVMLNLDAEQAVKHPRLLSFTSQLKAGKGLTIVGSVLEGTYLDKHMEAQRAEENIRSLMSTEKTKGFCQLVVSSSLRDGMSHLIQSAGLGGLKHNTVLMAWPASWKQEDNPFSWKNFVDTVRDTTAAHQALLVAKNVDSFPQNQERFGGGHIDVWWIVHDGGMLMLLPFLLRQHKVWRKCRMRIFTVAQVDDNSIQMKKDLQMFLYHLRISAEVEVVEMVENDISAFTYERTLMMEQRSQMLKQMQLSKNEQEREAQLIHDRNTASHTAAAARTQAPPTPDKVQMTWTREKLIAEKYRSRDTSLSGFKDLFSMKPDQSNVRRMHTAVKLNGVVLNKSQDAQLVLLNMPGPPKNRQGDENYMEFLEVLTEGLNRVLLVRGGGREVITIYS

SEQ ID NO: 80392 - protein, 347 aa, Homo sapiens
  Payload ID: 16024
  Gene Symbol: SLC12A7
  Gene Name: solute carrier family 12 (potassium/chloride transporter), member 7
  ENSP ID: ENSP00000485792
  MOD_RES (1)..(1): Any amino acid
XVRGWTNPDFLSHRAEKEWGDGIRGLSLNAARYALLRVEHGPPHTKNWRPQVLVMLNLDAEQAVKHPRLLSFTSQLKAGKGLTIVGSVLEGTYLDKHMEAQRAEENIRSLMSTEKTKGFCQLVVSSSLRDGMSHLIQSAGLGGLKHNTVLMAWPASWKQEDNPFSWKNFVDTVRDTTAAHQALLVAKNVDSFPQNQERFGGGHIDVWWIVHDGGMLMLLPFLLRQHKVWRKCRMRIFTVAQVDDNSIQMKKDLQMFLYHLRISAEVEVVEMVENDISAFTYERTLMMEQRSQMLKQMQLSKNEQEREAQLIHDRNTASHTAAAARTQAPPTPDKVQMTWTREKLIAE

SEQ ID NO: 80393 - protein, 63 aa, Homo sapiens
  Payload ID: 16024
  Gene Symbol: SLC12A7
  Gene Name: solute carrier family 12 (potassium/chloride transporter), member 7
  ENSP ID: ENSP00000489272
PTWALLLTVLICETGILIASLDSVAPILSMFFLMCYLFVNLACAVQTLLRTPNWRPRFKFYHW

SEQ ID NO: 80394 - protein, 989 aa, Homo sapiens
  Payload ID: 16024
  Gene Symbol: SLC12A7
  Gene Name: solute carrier family 12 (potassium/chloride transporter), member 7
  ENSP ID: ENSP00000489285
  MOD_RES (1)..(1): Any amino acid
XEHEEDEESRRREAKAPRMGTFIGVYLPCLQNILGVILFLRLTWIVGVAGVLESFLIVAMCCTCTMLTAISMSAIATNGVVPAGGSYYMISRSLGPEFGGAVGLCFYLGTTFAGAMYILGTIEIFLTYISPGAAIFQAEAAGGEAAAMLHNMRVYGTCTLVLMALVVFVGVKYVNKLALVFLACVVLSILAIYAGVIKSAFDPPDIPVCLLGNRTLSRRSFDACVKAYGIHNNSATSALWGLFCNGSQPSAACDEYFIQNNVTEIQGIPGAASGVFLENLWSTYAHAGAFVEKKGVPSVPVAEESRASALPYVLTDIAASFTLLVGIYFPSVTGIMAGSNRSGDLKDAQKSIPTGTILAIVTTSFIYLSCIVLFGACIEGVVLRDKFGEALQGNLVIGMLAWPSPWVIVIGSFFSTCGAGLQSLTGAPRLLQAIARDGIVPFLQVFGHGKANGEPTWALLLTVLICETGILIASLDSVAPILSMFFLMCYLFVNLACAVQTLLRTPNWRPRFKFYHWTLSFLGMSLCLALMFICSWYYALSAMLIAGCIYKYIEYRGAEKEWGDGIRGLSLNAARYALLRVEHGPPHTKNWRPQVLVMLNLDAEQAVKHPRLLSFTSQLKAGKGLTIVGSVLEGTYLDKHMEAQRAEENIRSLMSTEKTKGFCQLVVSSSLRDGMSHLIQSAGLGGLKHNTVLMAWPASWKQEDNPFSWKNFVDTVRDTTAAHQALLVAKNVDSFPQNQERFGGGHIDVWWIVHDGGMLMLLPFLLRQHKVWRKCRMRIFTVAQVDDNSIQMKKDLQMFLYHLRISAEVEVVEMVENDISAFTYERTLMMEQRSQMLKQMQLSKNEQEREAQLIHDRNTASHTAAAARTQAPPTPDKVQMTWTREKLIAEKYRSRDTSLSGFKDLFSMKPEWGNLDQSNVRRMHTAVKLNGVVLNKSQDAQLVLLNMPGPPKNRQGDENYMEFLEVLTEGLNRVLLVRGGGREVITIYS

SEQ ID NO: 80395 - protein, 1020 aa, Homo sapiens
  Payload ID: 16025
  Gene Symbol: SLC12A3
  Gene Name: solute carrier family 12 (sodium/chloride transporter), member 3
  ENSP ID: ENSP00000262502
MAELPTTETPGDATLCSGRFTISTLLSSDEPSPPAAYDSSHPSHLTHSSTFCMRTFGYNTIDVVPTYEHYANSTQPGEPRKVRPTLADLHSFLKEGRHLHALAFDSRPSHEMTDGLVEGEAGTSSEKNPEEPVRFGWVKGVMIRCMLNIWGVILYLRLPWITAQAGIVLTWIIILLSVTVTSITGLSISAISTNGKVKSGGTYFLISRSLGPELGGSIGLIFAFANAVGVAMHTVGFAETVRDLLQEYGAPIVDPINDIRIIAVVSVTVLLAISLAGMEWESKAQVLFFLVIMVSFANYLVGTLIPPSEDKASKGFFSYRADIFVQNLVPDWRGPDGTFFGMFSIFFPSATGILAGANISGDLKDPAIAIPKGTLMAIFWTTISYLAISATIGSCVVRDASGVLNDTVTPGWGACEGLACSYGWNFTECTQQHSCHYGLINYYQTMSMVSGFAPLITAGIFGATLSSALACLVSAAKVFQCLCEDQLYPLIGFFGKGYGKNKEPVRGYLLAYAIAVAFIIIAELNTIAPIISNFFLCSYALINFSCFHASITNSPGWRPSFQYYNKWAALFGAIISVVIMFLLTWWAALIAIGVVLFLLLYVIYKKPEVNWGSSVQAGSYNLALSYSVGLNEVEDHIKNYRPQCLVLTGPPNFRPALVDFVGTFTRNLSLMICGHVLIGPHKQRMPELQLIANGHTKWLNKRKIKAFYSDVIAEDLRRGVQILMQAAGLGRMKPNILVVGFKKNWQSAHPATVEDYIGILHDAFDFNYGVCVMRMREGLNVSKMMQAHINPVFDPAEDGKEASARVDPKALVKEEQATTIFQSEQGKKTIDIYWLFDDGGLTLLIPYLLGRKRRWSKCKIRVFVGGQINRMDQERKAIISLLSKFRLGFHEVHILPDINQNPRAEHTKRFEDMIAPFRLNDGFKDEATVNEMRRDCPWKISDEEITKNRVKSLRQVRLNEIVLDYSRDAALIVITLPIGRKGKCPSSLYMAWLETLSQDLRPPVILIRGNQENVLTFYCQ

SEQ ID NO: 80396 - protein, 1030 aa, Homo sapiens
  Payload ID: 16025
  Gene Symbol: SLC12A3
  Gene Name: solute carrier family 12 (sodium/chloride transporter), member 3
  Uniprot ID: P55017
  ENSP ID: ENSP00000402152
MAELPTTETPGDATLCSGRFTISTLLSSDEPSPPAAYDSSHPSHLTHSSTFCMRTFGYNTIDVVPTYEHYANSTQPGEPRKVRPTLADLHSFLKQEGRHLHALAFDSRPSHEMTDGLVEGEAGTSSEKNPEEPVRFGWVKGVMIRCMLNIWGVILYLRLPWITAQAGIVLTWIIILLSVTVTSITGLSISAISTNGKVKSGGTYFLISRSLGPELGGSIGLIFAFANAVGVAMHTVGFAETVRDLLQEYGAPIVDPINDIRIIAVVSVTVLLAISLAGMEWESKAQVLFFLVIMVSFANYLVGTLIPPSEDKASKGFFSYRADIFVQNLVPDWRGPDGTFFGMFSIFFPSATGILAGANISGDLKDPAIAIPKGTLMAIFWTTISYLAISATIGSCVVRDASGVLNDTVTPGWGACEGLACSYGWNFTECTQQHSCHYGLINYYQTMSMVSGFAPLITAGIFGATLSSALACLVSAAKVFQCLCEDQLYPLIGFFGKGYGKNKEPVRGYLLAYAIAVAFIIIAELNTIAPIISNFFLCSYALINFSCFHASITNSPGWRPSFQYYNKWAALFGAIISVVIMFLLTWWAALIAIGVVLFLLLYVIYKKPEVNWGSSVQAGSYNLALSYSVGLNEVEDHIKNYRPQCLVLTGPPNFRPALVDFVGTFTRNLSLMICGHVLIGPHKQRMPELQLIANGHTKWLNKRKIKAFYSDVIAEDLRRGVQILMQAAGLGRMKPNILVVGFKKNWQSAHPATVEDYIGILHDAFDFNYGVCVMRMREGLNVSKMMQAHINPVFDPAEDGKEASARGARPSVSGALDPKALVKEEQATTIFQSEQGKKTIDIYWLFDDGGLTLLIPYLLGRKRRWSKCKIRVFVGGQINRMDQERKAIISLLSKFRLGFHEVHILPDINQNPRAEHTKRFEDMIAPFRLNDGFKDEATVNEMRRDCPWKISDEEITKNRVKSLRQVRLNEIVLDYSRDAALIVITLPIGRKGKCPSSLYMAWLETLSQDLRPPVILIRGNQENVLTFYCQ

SEQ ID NO: 80397 - protein, 1021 aa, Homo sapiens
  Payload ID: 16025
  Gene Symbol: SLC12A3
  Gene Name: solute carrier family 12 (sodium/chloride transporter), member 3
  Uniprot ID: P55017
  ENSP ID: ENSP00000456149
MAELPTTETPGDATLCSGRFTISTLLSSDEPSPPAAYDSSHPSHLTHSSTFCMRTFGYNTIDVVPTYEHYANSTQPGEPRKVRPTLADLHSFLKQEGRHLHALAFDSRPSHEMTDGLVEGEAGTSSEKNPEEPVRFGWVKGVMIRCMLNIWGVILYLRLPWITAQAGIVLTWIIILLSVTVTSITGLSISAISTNGKVKSGGTYFLISRSLGPELGGSIGLIFAFANAVGVAMHTVGFAETVRDLLQEYGAPIVDPINDIRIIAVVSVTVLLAISLAGMEWESKAQVLFFLVIMVSFANYLVGTLIPPSEDKASKGFFSYRADIFVQNLVPDWRGPDGTFFGMFSIFFPSATGILAGANISGDLKDPAIAIPKGTLMAIFWTTISYLAISATIGSCVVRDASGVLNDTVTPGWGACEGLACSYGWNFTECTQQHSCHYGLINYYQTMSMVSGFAPLITAGIFGATLSSALACLVSAAKVFQCLCEDQLYPLIGFFGKGYGKNKEPVRGYLLAYAIAVAFIIIAELNTIAPIISNFFLCSYALINFSCFHASITNSPGWRPSFQYYNKWAALFGAIISVVIMFLLTWWAALIAIGVVLFLLLYVIYKKPEVNWGSSVQAGSYNLALSYSVGLNEVEDHIKNYRPQCLVLTGPPNFRPALVDFVGTFTRNLSLMICGHVLIGPHKQRMPELQLIANGHTKWLNKRKIKAFYSDVIAEDLRRGVQILMQAAGLGRMKPNILVVGFKKNWQSAHPATVEDYIGILHDAFDFNYGVCVMRMREGLNVSKMMQAHINPVFDPAEDGKEASARVDPKALVKEEQATTIFQSEQGKKTIDIYWLFDDGGLTLLIPYLLGRKRRWSKCKIRVFVGGQINRMDQERKAIISLLSKFRLGFHEVHILPDINQNPRAEHTKRFEDMIAPFRLNDGFKDEATVNEMRRDCPWKISDEEITKNRVKSLRQVRLNEIVLDYSRDAALIVITLPIGRKGKCPSSLYMAWLETLSQDLRPPVILIRGNQENVLTFYCQ

SEQ ID NO: 80398 - protein, 1029 aa, Homo sapiens
  Payload ID: 16025
  Gene Symbol: SLC12A3
  Gene Name: solute carrier family 12 (sodium/chloride transporter), member 3
  Uniprot ID: P55017
  ENSP ID: ENSP00000457552
MAELPTTETPGDATLCSGRFTISTLLSSDEPSPPAAYDSSHPSHLTHSSTFCMRTFGYNTIDVVPTYEHYANSTQPGEPRKVRPTLADLHSFLKEGRHLHALAFDSRPSHEMTDGLVEGEAGTSSEKNPEEPVRFGWVKGVMIRCMLNIWGVILYLRLPWITAQAGIVLTWIIILLSVTVTSITGLSISAISTNGKVKSGGTYFLISRSLGPELGGSIGLIFAFANAVGVAMHTVGFAETVRDLLQEYGAPIVDPINDIRIIAVVSVTVLLAISLAGMEWESKAQVLFFLVIMVSFANYLVGTLIPPSEDKASKGFFSYRADIFVQNLVPDWRGPDGTFFGMFSIFFPSATGILAGANISGDLKDPAIAIPKGTLMAIFWTTISYLAISATIGSCVVRDASGVLNDTVTPGWGACEGLACSYGWNFTECTQQHSCHYGLINYYQTMSMVSGFAPLITAGIFGATLSSALACLVSAAKVFQCLCEDQLYPLIGFFGKGYGKNKEPVRGYLLAYAIAVAFIIIAELNTIAPIISNFFLCSYALINFSCFHASITNSPGWRPSFQYYNKWAALFGAIISVVIMFLLTWWAALIAIGVVLFLLLYVIYKKPEVNWGSSVQAGSYNLALSYSVGLNEVEDHIKNYRPQCLVLTGPPNFRPALVDFVGTFTRNLSLMICGHVLIGPHKQRMPELQLIANGHTKWLNKRKIKAFYSDVIAEDLRRGVQILMQAAGLGRMKPNILVVGFKKNWQSAHPATVEDYIGILHDAFDFNYGVCVMRMREGLNVSKMMQAHINPVFDPAEDGKEASARGARPSVSGALDPKALVKEEQATTIFQSEQGKKTIDIYWLFDDGGLTLLIPYLLGRKRRWSKCKIRVFVGGQINRMDQERKAIISLLSKFRLGFHEVHILPDINQNPRAEHTKRFEDMIAPFRLNDGFKDEATVNEMRRDCPWKISDEEITKNRVKSLRQVRLNEIVLDYSRDAALIVITLPIGRKGKCPSSLYMAWLETLSQDLRPPVILIRGNQENVLTFYCQ

SEQ ID NO: 80399 - protein, 430 aa, Homo sapiens
  Payload ID: 16026
  Gene Symbol: SLC12A1
  Gene Name: solute carrier family 12 (sodium/potassium/chloride transporter), member 1
  ENSP ID: ENSP00000331550
MSLNNSSNVFLDSVPSNTNRFQVSVINENHESSAAADDNTDPPHYEETSFGDEAQKRLRISFRPGNQECYDNFLQSGETAKTDASFHAYDSHTNTYYLQTFGHNTMDAVPKIEYYRNTGSISGPKVNRPSLLEIHEQLAKNVAVTPSSADRVANGDGIPGDEQAENKEDDQAGVVKFGWVKGVLVRCMLNIWGVMLFIRLSWIVGEAGIGLGVLIILLSTMVTSITGLSTSAIATNGFVRGGGAYYLISRSLGPEFGGSIGLIFAFANAVAVAMYVVGFAETVVDLLKESDSMMVDPTNDIRIIGSITVVILLGISVAGMEWEAKAQVILLVILLIAIANFFIGTVIPSNNEKKSRGFFNYQASIFAENFGPRFTKGEGFFSVFAIFFPAATGILAGANISGDLEALRKQGASPLPQGAQSRRRRQTSLI

SEQ ID NO: 80400 - protein, 1099 aa, Homo sapiens
  Payload ID: 16026
  Gene Symbol: SLC12A1
  Gene Name: solute carrier family 12 (sodium/potassium/chloride transporter), member 1
  Uniprot ID: Q13621
  ENSP ID: ENSP00000370381
MSLNNSSNVFLDSVPSNTNRFQVSVINENHESSAAADDNTDPPHYEETSFGDEAQKRLRISFRPGNQECYDNFLQSGETAKTDASFHAYDSHTNTYYLQTFGHNTMDAVPKIEYYRNTGSISGPKVNRPSLLEIHEQLAKNVAVTPSSADRVANGDGIPGDEQAENKEDDQAGVVKFGWVKGVLVRCMLNIWGVMLFIRLSWIVGEAGIGLGVLIILLSTMVTSITGLSTSAIATNGFVRGGGAYYLISRSLGPEFGGSIGLIFAFANAVAVAMYVVGFAETVVDLLKESDSMMVDPTNDIRIIGSITVVILLGISVAGMEWEAKAQVILLVILLIAIANFFIGTVIPSNNEKKSRGFFNYQASIFAENFGPRFTKGEGFFSVFAIFFPAATGILAGANISGDLEDPQDAIPRGTMLAIFITTVAYLGVAICVGACVVRDATGNMNDTIISGMNCNGSAACGLGYDFSRCRHEPCQYGLMNNFQVMSMVSGFGPLITAGIFSATLSSALASLVSAPKVFQALCKDNIYKALQFFAKGYGKNNEPLRGYILTFLIAMAFILIAELNTIAPIISNFFLASYALINFSCFHASYAKSPGWRPAYGIYNMWVSLFGAVLCCAVMFVINWWAAVITYVIEFFLYVYVTCKKPDVNWGSSTQALSYVSALDNALELTTVEDHVKNFRPQCIVLTGGPMTRPALLDITHAFTKNSGLCICCEVFVGPRKLCVKEMNSGMAKKQAWLIKNKIKAFYAAVAADCFRDGVRSLLQASGLGRMKPNTLVIGYKKNWRKAPLTEIENYVGIIHDAFDFEIGVVIVRISQGFDISQVLQVQEELERLEQERLALEATIKDNECEEESGGIRGLFKKAGKLNITKTTPKKDGSINTSQSMHVGEFNQKLVEASTQFKKKQEKGTIDVWWLFDDGGLTLLIPYILTLRKKWKDCKLRIYVGGKINRIEEEKIVMASLLSKFRIKFADIHIIGDINIRPNKESWKVFEEMIEPYRLHESCKDLTTAEKLKRETPWKITDAELEAVKEKSYRQVRLNELLQEHSRAANLIVLSLPVARKGSISDLLYMAWLEILTKNLPPVLLVRGNHKNVLTFYS

SEQ ID NO: 80401 - protein, 1099 aa, Homo sapiens
  Payload ID: 16026
  Gene Symbol: SLC12A1
  Gene Name: solute carrier family 12 (sodium/potassium/chloride transporter), member 1
  Uniprot ID: Q13621
  ENSP ID: ENSP00000379822
MSLNNSSNVFLDSVPSNTNRFQVSVINENHESSAAADDNTDPPHYEETSFGDEAQKRLRISFRPGNQECYDNFLQSGETAKTDASFHAYDSHTNTYYLQTFGHNTMDAVPKIEYYRNTGSISGPKVNRPSLLEIHEQLAKNVAVTPSSADRVANGDGIPGDEQAENKEDDQAGVVKFGWVKGVLVRCMLNIWGVMLFIRLSWIVGEAGIGLGVIIIGLSVVVTTLTGISMSAICTNGVVRGGGAYYLISRSLGPEFGGSIGLIFAFANAVAVAMYVVGFAETVVDLLKESDSMMVDPTNDIRIIGSITVVILLGISVAGMEWEAKAQVILLVILLIAIANFFIGTVIPSNNEKKSRGFFNYQASIFAENFGPRFTKGEGFFSVFAIFFPAATGILAGANISGDLEDPQDAIPRGTMLAIFITTVAYLGVAICVGACVVRDATGNMNDTIISGMNCNGSAACGLGYDFSRCRHEPCQYGLMNNFQVMSMVSGFGPLITAGIFSATLSSALASLVSAPKVFQALCKDNIYKALQFFAKGYGKNNEPLRGYILTFLIAMAFILIAELNTIAPIISNFFLASYALINFSCFHASYAKSPGWRPAYGIYNMWVSLFGAVLCCAVMFVINWWAAVITYVIEFFLYVYVTCKKPDVNWGSSTQALSYVSALDNALELTTVEDHVKNFRPQCIVLTGGPMTRPALLDITHAFTKNSGLCICCEVFVGPRKLCVKEMNSGMAKKQAWLIKNKIKAFYAAVAADCFRDGVRSLLQASGLGRMKPNTLVIGYKKNWRKAPLTEIENYVGIIHDAFDFEIGVVIVRISQGFDISQVLQVQEELERLEQERLALEATIKDNECEEESGGIRGLFKKAGKLNITKTTPKKDGSINTSQSMHVGEFNQKLVEASTQFKKKQEKGTIDVWWLFDDGGLTLLIPYILTLRKKWKDCKLRIYVGGKINRIEEEKIVMASLLSKFRIKFADIHIIGDINIRPNKESWKVFEEMIEPYRLHESCKDLTTAEKLKRETPWKITDAELEAVKEKSYRQVRLNELLQEHSRAANLIVLSLPVARKGSISDLLYMAWLEILTKNLPPVLLVRGNHKNVLTFYS

SEQ ID NO: 80402 - protein, 648 aa, Homo sapiens
  Payload ID: 16026
  Gene Symbol: SLC12A1
  Gene Name: solute carrier family 12 (sodium/potassium/chloride transporter), member 1
  ENSP ID: ENSP00000453230
MLNIWGVMLFIRLSWIVGEAGIGLGVLIILLSTMVTSITGLSTSAIATNGFVRGGGAYYLISRSLGPEFGGSIGLIFAFANAVAVAMYVVGFAETVVDLLKESDSMMVDPTNDIRIIGSITVVILLGISVAGMEWEAKAQVILLVILLIAIANFFIGTVIPSNNEKKSRGFFNYQASIFAENFGPRFTKGEGFFSVFAIFFPAATGILAGANISGDLEDPQDAIPRGTMLAIFITTVAYLGVAICVGACVVRDATGNMNDTIISGMNCNGSAACGLGYDFSRCRHEPCQYGLMNNFQVMSMVSGFGPLITAGIFSATLSSALASLVSAPKVFQALCKDNIYKALQFFAKGYGKNNEPLRGYILTFLIAMAFILIAELNTIAPIISNFFLASYALINFSCFHASYAKSPGWRPAYGIYNMWVSLFGAVLCCAVMFVINWWAAVITYVIEFFLYVYVTCKKPDVNWGSSTQALSYVSALDNALELTTVEDHVKNFRPQCIVLTGGPMTRPALLDITHAFTKNSGLCICCEVFVGPRKLCVKEMNSGMAKKQAWLIKNKIKAFYAAVAADCFRDGVRSLLQASGLGRMKPNTLVIGYKKNWRKAPLTEIENYVGIIHDAFDFEIGVVIVRISQGFDISQVLQVQEELERLE

SEQ ID NO: 80403 - protein, 1099 aa, Homo sapiens; identical to SEQ ID NO: 80400
  Payload ID: 16026
  Gene Symbol: SLC12A1
  Gene Name: solute carrier family 12 (sodium/potassium/chloride transporter), member 1
  Uniprot ID: Q13621
  ENSP ID: ENSP00000453409

SEQ ID NO: 80404 - protein, 113 aa, Homo sapiens
  Payload ID: 16026
  Gene Symbol: SLC12A1
  Gene Name: solute carrier family 12 (sodium/potassium/chloride transporter), member 1
  ENSP ID: ENSP00000453602
MLNIWGVMLFIRLSWIVGEAGIGLGVLIILLSTMVTSITGLSTSAIATNGFVRGGGAYYLISRSLGPEFGGSIGLIFAFANAVAVAMYVVGFAETVVDLLKESDSMMVDPTND

SEQ ID NO: 80405 - protein, 103 aa, Homo sapiens
  Payload ID: 16026
  Gene Symbol: SLC12A1
  Gene Name: solute carrier family 12 (sodium/potassium/chloride transporter), member 1
  ENSP ID: ENSP00000454054
  MOD_RES (1)..(1): Any amino acid
XAQVILLVILLIAIANFFIGTVIPSNNEKKSRGFFNYQASIFAENFGPRFTKGEGFFSVFAIFFPAATGILAGANISGDLEVRCLLCFAVLGVVVHLVGSTRS

SEQ ID NO: 80406 - protein, 217 aa, Homo sapiens
  Payload ID: 16026
  Gene Symbol: SLC12A1
  Gene Name: solute carrier family 12 (sodium/potassium/chloride transporter), member 1
  ENSP ID: ENSP00000454178
MSLNNSSNVFLDSVPSNTNRFQVSVINENHESSAAADDNTDPPHYEETSFGDEAQKRLRISFRPGNQECYDNFLQSGETAKTDASFHAYDSHTNTYYLQTFGHNTMDAVPKIEYYRNTGSISGPKVNRPSLLEIHEQLAKNVAVTPSSADRVANGDGIPGDEQAENKEDDQAGVVKFGWVKGVLVRCMLNIWGVMLFIRLSWIVGEAGIEYPSWHDW

SEQ ID NO: 80407 - protein, 1212 aa, Homo sapiens
  Payload ID: 16027
  Gene Symbol: SLC12A2
  Gene Name: solute carrier family 12 (sodium/potassium/chloride transporter), member 2
  Uniprot ID: P55011
  ENSP ID: ENSP00000262461
MEPRPTAPSSGAPGLAGVGETPSAAALAAARVELPGTAVPSVPEDAAPASRDGGGVRDEGPAAAGDGLGRPLGPTPSQSRFQVDLVSENAGRAAAAAAAAAAAAAAAGAGAGAKQTPADGEASGESEPAKGSEEAKGRFRVNFVDPAASSSAEDSLSDAAGVGVDGPNVSFQNGGDTVLSEGSSLHSGGGGGSGHHQHYYYDTHTNTYYLRTFGHNTMDAVPRIDHYRHTAAQLGEKLLRPSLAELHDELEKEPFEDGFANGEESTPTRDAVVTYTAESKGVVKFGWIKGVLVRCMLNIWGVMLFIRLSWIVGQAGIGLSVLVIMMATVVTTITGLSTSAIATNGFVRGGGAYYLISRSLGPEFGGAIGLIFAFANAVAVAMYVVGFAETVVELLKEHSILMIDEINDIRIIGAITVVILLGISVAGMEWEAKAQIVLLVILLLAIGDFVIGTFIPLESKKPKGFFGYKSEIFNENFGPDFREEETFFSVFAIFFPAATGILAGANISGDLADPQSAIPKGTLLAILITTLVYVGIAVSVGSCVVRDATGNVNDTIVTELTNCTSAACKLNFDFSSCESSPCSYGLMNNFQVMSMVSGFTPLISAGIFSATLSSALASLVSAPKIFQALCKDNIYPAFQMFAKGYGKNNEPLRGYILTFLIALGFILIAELNVIAPIISNFFLASYALINFSVFHASLAKSPGWRPAFKYYNMWISLLGAILCCIVMFVINWWAALLTYVIVLGLYIYVTYKKPDVNWGSSTQALTYLNALQHSIRLSGVEDHVKNFRPQCLVMTGAPNSRPALLHLVHDFTKNVGLMICGHVHMGPRRQAMKEMSIDQAKYQRWLIKNKMKAFYAPVHADDLREGAQYLMQAAGLGRMKPNTLVLGFKKDWLQADMRDVDMYINLFHDAFDIQYGVVVIRLKEGLDISHLQGQEELLSSQEKSPGTKDVVVSVEYSKKSDLDTSKPLSEKPITHKVEEEDGKTATQPLLKKESKGPIVPLNVADQKLLEASTQFQKKQGKNTIDVWWLFDDGGLTLLIPYLLTTKKKWKDCKIRVFIGGKINRIDHDRRAMATLLSKFRIDFSDIMVLGDINTKPKKENIIAFEEIIEPYRLHEDDKEQDIADKMKEDEPWRITDNELELYKTKTYRQIRLNELLKEHSSTANIIVMSLPVARKGAVSSALYMAWLEALSKDLPPILLVRGNHQSVLTFYS

SEQ ID NO: 80408 - protein, 1196 aa, Homo sapiens
  Payload ID: 16027
  Gene Symbol: SLC12A2
  Gene Name: solute carrier family 12 (sodium/potassium/chloride transporter), member 2
  Uniprot ID: P55011
  ENSP ID: ENSP00000340878
MEPRPTAPSSGAPGLAGVGETPSAAALAAARVELPGTAVPSVPEDAAPASRDGGGVRDEGPAAAGDGLGRPLGPTPSQSRFQVDLVSENAGRAAAAAAAAAAAAAAAGAGAGAKQTPADGEASGESEPAKGSEEAKGRFRVNFVDPAASSSAEDSLSDAAGVGVDGPNVSFQNGGDTVLSEGSSLHSGGGGGSGHHQHYYYDTHTNTYYLRTFGHNTMDAVPRIDHYRHTAAQLGEKLLRPSLAELHDELEKEPFEDGFANGEESTPTRDAVVTYTAESKGVVKFGWIKGVLVRCMLNIWGVMLFIRLSWIVGQAGIGLSVLVIMMATVVTTITGLSTSAIATNGFVRGGGAYYLISRSLGPEFGGAIGLIFAFANAVAVAMYVVGFAETVVELLKEHSILMIDEINDIRIIGAITVVILLGISVAGMEWEAKAQIVLLVILLLAIGDFVIGTFIPLESKKPKGFFGYKSEIFNENFGPDFREEETFFSVFAIFFPAATGILAGANISGDLADPQSAIPKGTLLAILITTLVYVGIAVSVGSCVVRDATGNVNDTIVTELTNCTSAACKLNFDFSSCESSPCSYGLMNNFQVMSMVSGFTPLISAGIFSATLSSALASLVSAPKIFQALCKDNIYPAFQMFAKGYGKNNEPLRGYILTFLIALGFILIAELNVIAPIISNFFLASYALINFSVFHASLAKSPGWRPAFKYYNMWISLLGAILCCIVMFVINWWAALLTYVIVLGLYIYVTYKKPDVNWGSSTQALTYLNALQHSIRLSGVEDHVKNFRPQCLVMTGAPNSRPALLHLVHDFTKNVGLMICGHVHMGPRRQAMKEMSIDQAKYQRWLIKNKMKAFYAPVHADDLREGAQYLMQAAGLGRMKPNTLVLGFKKDWLQADMRDVDMYINLFHDAFDIQYGVVVIRLKEGLDISHLQGQEELLSSQEKSPGTKDVVVSVEYSKKSDLDTSKPLSEKPITHKESKGPIVPLNVADQKLLEASTQFQKKQGKNTIDVWWLFDDGGLTLLIPYLLTTKKKWKDCKIRVFIGGKINRIDHDRRAMATLLSKFRIDFSDIMVLGDINTKPKKENIIAFEEIIEPYRLHEDDKEQDIADKMKEDEPWRITDNELELYKTKTYRQIRLNELLKEHSSTANIIVMSLPVARKGAVSSALYMAWLEALSKDLPPILLVRGNHQSVLTFYS

SEQ ID NO: 80409 - protein, 1150 aa, Homo sapiens
  Payload ID: 16027
  Gene Symbol: SLC12A2
  Gene Name: solute carrier family 12 (sodium/potassium/chloride transporter), member 2
  ENSP ID: ENSP00000427109
MEPRPTAPSSGAPGLAGVGETPSAAALAAARVELPGTAVPSVPEDAAPASRDGGGVRDEGPAAAGDGLGRPLGPTPSQSRFQVDLVSENAGRAAAAAAAAAAAAAAAGAGAGAKQTPADGEASGESEPAKGSEEAKGRFRVNFVDPAASSSAEDSLSDAAGVGVDGPNVSFQNGGDTVLSEGSSLHSGGGGGSGHHQHYYYDTHTNTYYLRTFGHNTMDAVPRIDHYRHTAAQLGEKLLRPSLAELHDELEKEPFEDGFANGEESTPTRDAVVTYTAESKGVVKFGWIKGVLVRCMLNIWGVMLFIRLSWIVGQAGIGLSVLVIMMATVVTTITGLSTSAIATNGFVRGGGAYYLISRSLGPEFGGAIGLIFAFANAVAVAMYVVGFAETVVELLKEHSILMIDEINDIRIIGAITVVILLGISVAGMEWEAKAQIVLLVILLLAIGDFVIGTFIPLESKKPKGFFGYKSEIFNENFGPDFREEETFFSVFAIFFPAATGILAGANISGDLADPQSAIPKGTLLAILITTLVYVGIAVSVGSCVVRDATGNVNDTIVTELTNCTSAACKLNFDFSSCESSPCSYGLMNNFQVMSMVSGFTPLISAGIFSATLSSALASLVSAPKIFQALCKDNIYPAFQMFAKGYGKNNEPLRGYILTFLIALGFILIAELNVIAPIISNFFLASYALINFSVFHASLAKSPGWRPAFKYYNMWISLLGAILCCIVMFVINWWAALLTYVIVLGLYIYVTYKKPDVNWGSSTQALTYLNALQHSIRLSGVEDHVKNFRPQCLVMTGAPNSRPALLHLVHDFTKNVGLMICGHVHMGPRRQAMKEMSIDQAKYQRWLIKNKMKAFYAPVHADDLREGAQYLMQAAGLGRMKPNTLVLGFKKDWLQADMRDVDMYINLFHDAFDIQYGVVVIRLKEGLDISHLQGQEELLSSQEKSPGTKDVVVSVEYSKKSDLDTSKPLSEKPITHKVEEEDGKTATQPLLKKESKGPIVPLNVADQKLLEASTQFQKKQGKNTIDVWWLFDDGGLTLLIPYLLTTKKKWKDCKIRVFIGGKINRIDHDRRAMATLLSKFRIDFSDIMVLGDINTKPKKENIIAFEEIIEPYRLHEDDKEQDIADKMKEDEPWRITDNELELYKTKFYEPC

SEQ ID NO: 80410 - protein, 1150 aa, Homo sapiens; identical to SEQ ID NO: 80409
  Payload ID: 16027
  Gene Symbol: SLC12A2
  Gene Name: solute carrier family 12 (sodium/potassium/chloride transporter), member 2
  ENSP ID: ENSP00000486323

SEQ ID NO: 80411 - protein, 714 aa, Homo sapiens
  Payload ID: 16028
  Gene Symbol: SLC12A8
  Gene Name: solute carrier family 12, member 8
  Uniprot ID: A0AV02
  ENSP ID: ENSP00000377112
MTQMSQVQELFHEAAQQDALAQPQPWWKTQLFMWEPVLFGTWDGVFTSCMINIFGVVLFLRTGWLVGNTGVLLGMFLVSFVILVALVTVLSGIGVGERSSIGSGGVYSMISSVLGGQTGGTIGLLYVFGQCVAGAMYITGFAESISDLLGLGNIWAVRGISVAVLLALLGINLAGVKWIIRLQLLLLFLLAVSTLDFVVGSFTHLDPEHGFIGYSPELLQNNTLPDYSPGESFFTVFGVFFPAATGVMAGFNMGGDLREPAASIPLGSLAAVGISWFLYIIFVFLLGAICTREALRYDFLIAEKVSLMGFLFLLGLYISSLASCMGGLYGAPRILQCIAQEKVIPALACLGQGKGPNKTPVAAICLTSLVTMAFVFVGQVNVLAPIVTINFMLTYVAVDYSYFSLSMCSCSLTPVPEPVLREGAEGLHCSEHLLLEKAPSYGSEGPAQRVLEGTLLEFTKDMDQLLQLTRKLESSQPRQGEGNRTPESQKRKSKKATKQTLQDSFLLDLKSPPSFPVEISDRLPAASWEGQESCWNKQTSKSEGTQPEGTYGEQLVPELCNQSESSGEDFFLKSRLQEQDVWRRSTSFYTHMCNPWVSLLGAVGSLLIMFVIQWVYTLVNMGVAAIVYFYIGRASPGLHLGSASNFSFFRWMRSLLLPSCRSLRSPQEQIILAPSLAKVDMEMTQLTQENADFATRDRYHHSSLVNREQLMPHY

SEQ ID NO: 80412 - protein, 515 aa, Homo sapiens
  Payload ID: 16028
  Gene Symbol: SLC12A8
  Gene Name: solute carrier family 12, member 8
  Uniprot ID: A0AV02
  ENSP ID: ENSP00000415713
MRRAAAGGLAVGQLPGEGPAGEEGAALGKAMRGGGCSPHSPSGCLSGVMAGFNMGGDLREPAASIPLGSLAAVGISWFLYIIFVFLLGAICTREALRYDFLIAEKVSLMGFLFLLGLYISSLASCMGGLYGAPRILQCIAQEKVIPALACLGQGKGPNKTPVAAICLTSLVTMAFVFVGQVNVLAPIVTINFMLTYVAVDYSYFSLSMCSCSLTPVPEPVLREGAEGLHCSEHLLLEKAPSYGSEGPAQRVLEGTLLEFTKDMDQLLQLTRKLESSQPRQGEGNRTPESQKRKSKKATKQTLQDSFLLDLKSPPSFPVEISDRLPAASWEGQESCWNKQTSKSEGTQPEGTYGEQLVPELCNQSESSGEDFFLKSRLQEQDVWRRSTSFYTHMCNPWVSLLGAVGSLLIMFVIQWVYTLVNMGVAAIVYFYIGRASPGLHLGSASNFSFFRWMRSLLLPSCRSLRSPQEQIILAPSLAKVDMEMTQLTQENADFATRDRYHHSSLVNREQLMPHY

SEQ ID NO: 80413 - protein, 112 aa, Homo sapiens
  Payload ID: 16028
  Gene Symbol: SLC12A8
  Gene Name: solute carrier family 12, member 8
  ENSP ID: ENSP00000418636
MWEPVLFGTWDGVFTSCMINIFGVVLFLRTGWLVGNTGVLLGMFLVSFVILVALVTVLSGIGVGERSSIGSGGVYSMISSVLGGQTGGTIGLLYVFGQCVAGAMYITGFAES

SEQ ID NO: 80414 - protein, 714 aa, Homo sapiens; identical to SEQ ID NO: 80411
  Payload ID: 16028
  Gene Symbol: SLC12A8
  Gene Name: solute carrier family 12, member 8
  Uniprot ID: A0AV02
  ENSP ID: ENSP00000418783

SEQ ID NO: 80415 - protein, 160 aa, Homo sapiens
  Payload ID: 16028
  Gene Symbol: SLC12A8
  Gene Name: solute carrier family 12, member 8
  ENSP ID: ENSP00000419424
  MOD_RES (1)..(1): Any amino acid
XQDALAQPQPWWKTQLFMWEPVLFGTWDGVFTSCMINIFGVVLFLRTGWLVGNTGVLLGMFLVSFVILVALVTVLSGIGVGERSSIGSGGVYSMISSVLGGQTGGTIGLLYVFGQVPCISPALLNPSRICWASGISGLCEEFQLRCFWPCWALTSQVSNG

SEQ ID NO: 80416 - protein, 207 aa, Homo sapiens
  Payload ID: 16028
  Gene Symbol: SLC12A8
  Gene Name: solute carrier family 12, member 8
  ENSP ID: ENSP00000420197
LGWCVHILHDQHLWGCALPEDWLAGGKHRSAPGHVPGVLRHPGGPRHGAVWHWRRGAQQHRQRWRLLHDLLGPGWADGRHHRAALCVWTEHGFIGYSPELLQNNTLPDYSPGESFFTVFGVFFPAATGVMAGFNMGGDLREPAASIPLGSLAAVGISWFLYIIFVFLLGAICTREALRYDFLIAEKVSLMGFLFLLGLYISSLASCM

SEQ ID NO: 80417 - protein, 914 aa, Homo sapiens
  Payload ID: 16029
  Gene Symbol: SLC12A9
  Gene Name: solute carrier family 12, member 9
  Uniprot ID: Q9BXP2
  ENSP ID: ENSP00000275730
MASESSPLLAYRLLGEEGVALPANGAGGPGGASARKLSTFLGVVVPTVLSMFSIVVFLRIGFVVGHAGLLQALAMLLVAYFILALTVLSVCAIATNGAVQGGGAYFMISRTLGPEVGGSIGLMFYLANVCGCAVSLLGLVESVLDVFGADATGPSGLRVLPQGYGWNLLYGSLLLGLVGGVCTLGAGLYARASFLTFLLVSGSLASVLISFVAVGPRDIRLTPRPGPNGSSLPPRFGHFTGFNSSTLKDNLGAGYAEDYTTGAVMNFASVFAVLFNGCTGIMAGANMSGELKDPSRAIPLGTIVAVAYTFFVYVLLFFLSSFTCDRTLLQEDYGFFRAISLWPPLVLIGIYATALSASMSSLIGASRILHALARDDLFGVILAPAKVVSRGGNPWAAVLYSWGLVQLVLLAGKLNTLAAVVTVFYLVAYAAVDLSCLSLEWASAPNFRPTFSLFSWHTCLLGVASCLLMMFLISPGAAGGSLLLMGLLAALLTARGGPSSWGYVSQALLFHQVRKYLLRLDVRKDHVKFWRPQLLLLVGNPRGALPLLRLANQLKKGGLYVLGHVTLGDLDSLPSDPVQPQYGAWLSLVDRAQVKAFVDLTLSPSVRQGAQHLLRISGLGGMKPNTLVLGFYDDAPPQDHFLTDPAFSEPADSTREGSSPALSTLFPPPRAPGSPRALNPQDYVATVADALKMNKNVVLARASGALPPERLSRGSGGTSQLHHVDVWPLNLLRPRGGPGYVDVCGLFLLQMATILGMVPAWHSARLRIFLCLGPREAPGAAEGRLRALLSQLRIRAEVQEVVWGEGAGAGEPEAEEEGDFVNSGRGDAEAEALARSANALVRAQQGRGTGGGPGGPEGGDAEGPITALTFLYLPRPPADPARYPRYLALLETLTRDLGPTLLVHGVTPVTCTDL

SEQ ID NO: 80418 - protein, 45 aa, Homo sapiens
  Payload ID: 16029
  Gene Symbol: SLC12A9
  Gene Name: solute carrier family 12, member 9
  ENSP ID: ENSP00000401583
MNFASVFAVLFNGCTGIMAGANMSGPCCRKTMGSSAPSACGPHWC

SEQ ID NO: 80419 - protein, 156 aa, Homo sapiens
  Payload ID: 16029
  Gene Symbol: SLC12A9
  Gene Name: solute carrier family 12, member 9
  ENSP ID: ENSP00000406560
MNFASVFAVLFNGCTGIMAGANMSGELKDPSRAIPLGTIVAVAYTFFVYVLLFFLSSFTCDRTLLQEDYGFFRAISLWPPLVLIGIYATALSASMSSLIGASRILHALARDDLFGVILAPAKVVSRGGNPWAAVLYSWGLVQLVLLAGKLNTLAAV

SEQ ID NO: 80420 - protein, 128 aa, Homo sapiens
  Payload ID: 16029
  Gene Symbol: SLC12A9
  Gene Name: solute carrier family 12, member 9
  ENSP ID: ENSP00000408571
MASESSPLLAYRLLGEEGVALPANGAGGPGGASARKLSTFLGVVVPTVLSMFSIVVFLRIGFVVGHAGLLQALAMLLVAYFILALTVLSVCAIATNGAVQGGGAYFMISRTLGPEVGGSIGLMFYLAN

SEQ ID NO: 80421 - protein, 245 aa, Homo sapiens
  Payload ID: 16029
  Gene Symbol: SLC12A9
  Gene Name: solute carrier family 12, member 9
  ENSP ID: ENSP00000410692
MASESSPLLAYRLLGEEGVALPANGAGGPGGASARKLSTFLGVVVPTVLSMFSIVVFLRIAGYAEDYTTGAVMNFASVFAVLFNGCTGIMAGANMSGELKDPSRAIPLGTIVAVAYTFFVYVLLFFLSSFTCDRTLLQEDYGFFRAISLWPPLVLIGIYATALSASMSSLIGASRILHALARDDLFGVILAPAKVVSRGGNPWAAVLYSWGLVQLVLLAGKLNTLAAVVTVFYLVAYAAVDLSCL

SEQ ID NO: 80422 - protein, 538 aa, Homo sapiens
  Payload ID: 16029
  Gene Symbol: SLC12A9
  Gene Name: solute carrier family 12, member 9
  Uniprot ID: Q9BXP2
  ENSP ID: ENSP00000413796
MASESSPLLAYRLLGEEGVALPANGAGGPGGASARKLSTFLGVVVPTVLSMFSIVVFLRIDATGPSGLRVLPQGYGWNLLYGSLLLGLVGGVCTLGAGLYARASFLTFLLVSGSLASVLISFVAVGPRDIRLTPRPGPNGSSLPPRFGHFTGFNSSTLKDNLGAGYAEDYTTGAVMNFASVFAVLFNGCTGIMAGANMSGELKDPSRAIPLGTIVAVAYTFFVYVLLFFLSSFTCDRTLLQEDYGFFRAISLWPPLVLIGIYATALSASMSSLIGASRILHALARDDLFGVILAPAKVVSRGGNPWAAVLYSWGLVQLVLLAGKLNTLAAVVTVFYLVAYAAVDLSCLSLEWASAPNFRPTFSLFSWHTCLLGVASCLLMMFLISPGAAGGSLLLMGLLAALLTARGGPSSWGYVSQALLFHQVRKYLLRLDVRKDHVKFWRPQLLLLVGNPRGALPLLRLANQLKKGGLYVLGHVTLGDLDSLPSDPVQPQYGAWLSLVDRAQVKAFVDLTLSPSVRQGAQHLLRISGLESNSHPLP

SEQ ID NO: 80423 - protein, 631 aa, Homo sapiens
  Payload ID: 16029
  Gene Symbol: SLC12A9
  Gene Name: solute carrier family 12, member 9
  Uniprot ID: Q9BXP2
  ENSP ID: ENSP00000443702
MASESSPLLAYRLLGEEGVALPANGAGGPGGASARKLSTFLGVVVPTVLSMFSIVVFLRIGFVVGHAGLLQALAMLLVAYFILALTVLSVCAIATNGAVQGGGAYFMISRTLGPEVGGSIGLMFYLANVCGCAVSLLGLVESVLDVFGADATGPSGLRVLPQGYGWNLLYGSLLLGLVGGVCTLGAGLYARASFLTFLLVSGSLASVLISFVAVGPRDIRLTPRPGPNGSSLPPRFGHFTGFNSSTLKDNLGAGYAEDYTTGAVMNFASVFAVLFNGCTGIMAGANMSGELKDPSRAIPLGTIVAVAYTFFVYVLLFFLSSFTCDRTLLQEDYGFFRAISLWPPLVLIGIYATALSASMSSLIGASRILHALARDDLFGVILAPAKVVSRGGNPWAAVLYSWGLVQLVLLAGKLNTLAAVVTVFYLVAYAAVDLSCLSLEWASAPNFRPTFSLFSWHTCLLGVASCLLMMFLISPGAAGGSLLLMGLLAALLTARGGPSSWGYVSQALLFHQVRKYLLRLDVRKDHVKFWRPQLLLLVGNPRGALPLLRLANQLKKGGLYVLGHVTLGDLDSLPSDPVQPQYGAWLSLVDRAQVKAFVDLTLSPSVRQGAQHLLRISGLESGTLLPWGFRS

SEQ ID NO: 80424 - protein, 595 aa, Homo sapiens
  Payload ID: 16030
  Gene Symbol: SLC13A1
  Gene Name: solute carrier family 13 (sodium/sulfate symporter), member 1
  Uniprot ID: Q9BZW2
  ENSP ID: ENSP00000194130
MKFFSYILVYRRFLFVVFTVLVLLPLPIVLHTKEAECAYTLFVVATFWLTEALPLSVTALLPSLMLPMFGIMPSKKVASAYFKDFHLLLIGVICLATSIEKWNLHKRIALKMVMMVGVNPAWLTLGFMSSTAFLSMWLSNTSTAAMVMPIAEAVVQQIINAEAEVEATQMTYFNGSTNHGLEIDESVNGHEINERKEKTKPVPGYNNDTGKISSKVELEKNSGMRTKYRTKKGHVTRKLTCLCIAYSSTIGGLTTITGTSTNLIFAEYFNTRYPDCRCLNFGSWFTFSFPAALIILLLSWIWLQWLFLGFNFKEMFKCGKTKTVQQKACAEVIKQEYQKLGPIRYQEIVTLVLFIIMALLWFSRDPGFVPGWSALFSEYPGFATDSTVALLIGLLFFLIPAKTLTKTTPTGEIVAFDYSPLITWKEFQSFMPWDIAILVGGGFALADGCEESGLSKWIGNKLSPLGSLPAWLIILISSLMVTSLTEVASNPATITLFLPILSPLAEAIHVNPLYILIPSTLCTSFAFLLPVANPPNAIVFSYGHLKVIDMVKAGLGVNIVGVAVVMLGICTWIVPMFDLYTYPSWAPAMSNETMP

SEQ ID NO: 80425 - protein, 36 aa, Homo sapiens
  Payload ID: 16030
  Gene Symbol: SLC13A1
  Gene Name: solute carrier family 13 (sodium/sulfate symporter), member 1
  ENSP ID: ENSP00000388403
MKFFSYILVYRRFLFVVFTVLVLLPLPIVLHTKSKL

SEQ ID NO: 80426 - protein, 40 aa, Homo sapiens
  Payload ID: 16030
  Gene Symbol: SLC13A1
  Gene Name: solute carrier family 13 (sodium/sulfate symporter), member 1
  ENSP ID: ENSP00000401417
MKFFSYILVYRRFLFVVFTVLVLLPLPIVLHTKLILTFPR

SEQ ID NO: 80427 - protein, 161 aa, Homo sapiens
  Payload ID: 16030
  Gene Symbol: SLC13A1
  Gene Name: solute carrier family 13 (sodium/sulfate symporter), member 1
  ENSP ID: ENSP00000441309
MLPMFGIMPSKKVASAYFKDFHLLLIGVICLATSIEKWNLHKRIALKMVMMVGVNPAWLTLGFMSSTAFLSMWLSNTSTAAMVMPIAEAVVQQIINAEAEVEATQMTYFNGSTNHGLEIDESVNGHEINERKEKTKPVPGYNNDTGKISSKVELEKYLQVR

SEQ ID NO: 80428 - protein, 626 aa, Homo sapiens
  Payload ID: 16031
  Gene Symbol: SLC13A4
  Gene Name: solute carrier family 13 (sodium/sulfate symporter), member 4
  Uniprot ID: Q9UKG4
  ENSP ID: ENSP00000297282
MGLLQGLLRVRKLLLVVCVPLLLLPLPVLHPSSEASCAYVLIVTAVYWVSEAVPLGAAALVPAFLYPFFGVLRSNEVAAEYFKNTTLLLVGVICVAAAVEKWNLHKRIALRMVLMAGAKPGMLLLCFMCCTTLLSMWLSNTSTTAMVMPIVEAVLQELVSAEDEQLVAGNSNTEEAEPISLDVKNSQPSLELIFVNEESNADLTTLMHNENLNGVPSITNPIKTANQHQGKKQHPSQEKPQVLTPSPRKQKLNRKYRSHHDQMICKCLSLSISYSATIGGLTTIIGTSTSLIFLEHFNNQYPAAEVVNFGTWFLFSFPISLIMLVVSWFWMHWLFLGCNFKETCSLSKKKKTKREQLSEKRIQEEYEKLGDISYPEMVTGFFFILMTVLWFTREPGFVPGWDSFFEKKGYRTDATVSVFLGFLLFLIPAKKPCFGKKNDGENQEHSLGTEPIITWKDFQKTMPWEIVILVGGGYALASGSKSSGLSTWIGNQMLSLSSLPPWAVTLLACILVSIVTEFVSNPATITIFLPILCSLSETLHINPLYTLIPVTMCISFAVMLPVGNPPNAIVFSYGHCQIKDMVKAGLGVNVIGLVIVMVAINTWGVSLFHLDTYPAWARVSNITDQA

SEQ ID NO: 80429 - protein, 112 aa, Homo sapiens
  Payload ID: 16031
  Gene Symbol: SLC13A4
  Gene Name: solute carrier family 13 (sodium/sulfate symporter), member 4
  ENSP ID: ENSP00000476620
MGLLQGLLRVRKLLLVVCVPLLLLPLPVLHPSSEASCAYVLIVTAVYWVSEAVPLGAAALVPAFLYPFFGVLRSNEVAAEYFKNTTLLLVGVICVAAAVEKWNLHKRIALRM

SEQ ID NO: 80430 - protein, 76 aa, Homo sapiens
  Payload ID: 16031
  Gene Symbol: SLC13A4
  Gene Name: solute carrier family 13 (sodium/sulfate symporter), member 4
  ENSP ID: ENSP00000477467
MGLLQGLLRVRKLLLVVCVPLLLLPLPVLHPSSEASCAYVLIVTAVYWVSEAVPLGAAALVPAFLYPFFGVLRSNE

SEQ ID NO: 80431 - protein, 551 aa, Homo sapiens
  Payload ID: 16032
  Gene Symbol: SLC13A5
  Gene Name: solute carrier family 13 (sodium-dependent citrate transporter), member 5
  Uniprot ID: Q86YT5
  ENSP ID: ENSP00000293800
MASALSYVSKFKSFVILFVTPLLLLPLVILMPAKFVRCAYVIILMAIYWCTEVIPLAVTSLMPVLLFPLFQILDSRQVCVQYMKDTNMLFLGGLIVAVAVERWNLHKRIALRTLLWVGAKPARNTATTAMMVPIVEAILQQMEATSAATEAGLELVDKGKAKELPGSQVIFEGPTLGQQEDQERKRLCKAMTLCICYAASIGGTATLTGTGPNVVLLGQMNELFPDSKDLVNFASWFAFAFPNMLVMLLFAWLWLQFVYMRFNFKKSWGCGLESKKNEKAALKVLQEEYRKLGPLSFAEINVLICFFLLVILWFSRDPGFMPGWLTVAWVEGETKYVSDATVAIFVATLLFIVPSQKPKFNFRSQTEEERKTPFYPPPLLDWKVTQEKVPWGIVLLLGGGFALAKGSEASGLSVWMGKQMEPLHAVPPAAITLILSLLVAVFTECTSNVATTTLFLPIFASMSRSIGLNPLYIMLPCTLSASFAFMLPVATPPNAIVFTYGHLKVADMVKTGVIMNIIGVFCVFLAVNTWGRAIFDLDHFPDWANVTHIET

SEQ ID NO: 80432 - protein, 525 aa, Homo sapiens
  Payload ID: 16032
  Gene Symbol: SLC13A5
  Gene Name: solute carrier family 13 (sodium-dependent citrate transporter), member 5
  Uniprot ID: Q86YT5
  ENSP ID: ENSP00000370464
MASALSYVSKFKSFVILFVTPLLLLPLVILMPAKVCVQYMKDTNMLFLGGLIVAVAVERWNLHKRIALRTLLWVGAKPARLMLGFMGVTALLSMWISNTATTAMMVPIVEAILQQMEATSAATEAGLELVDKGKAKELPGSQVIFEGPTLGQQEDQERKRLCKAMTLCICYAASIGGTATLTGTGPNVVLLGQMNELFPDSKDLVNFASWFAFAFPNMLVMLLFAWLWLQFVYMRFNFKKSWGCGLESKKNEKAALKVLQEEYRKLGPLSFAEINVLICFFLLVILWFSRDPGFMPGWLTVAWVEGETKYVSDATVAIFVATLLFIVPSQKPKFNFRSQTEEERKTPFYPPPLLDWKVTQEKVPWGIVLLLGGGFALAKGSEASGLSVWMGKQMEPLHAVPPAAITLILSLLVAVFTECTSNVATTTLFLPIFASMSRSIGLNPLYIMLPCTLSASFAFMLPVATPPNAIVFTYGHLKVADMVKTGVIMNIIGVFCVFLAVNTWGRAIFDLDHFPDWANVTHIET

SEQ ID NO: 80433 - protein, 568 aa, Homo sapiens [sequence omitted]

SEQ ID NO: 80434 - protein, 522 aa, Homo sapiens
  Payload ID: 16032
  Gene Symbol: SLC13A5
  Gene Name: solute carrier family 13 (sodium-dependent citrate transporter), member 5
  Uniprot ID: Q86YT5
  ENSP ID: ENSP00000459372
MASALSYVSKFKSFVILFVTPLLLLPLVILMPAKFVRCAYVIILMAIYWCTEVIPLAVTSLMPVLLFPLFQILDSRQVCVQYMKDTNMLFLGGLIVAVAVERWNLHKRIALRTLLWVGAKPARLMLGFMGVTALLSMWISNTATTAMMVPIVEAILQQMEATSAATEAGLELVDKGKAKELPGSQVIFEGPTLGQQEDQERKRLCKAMTLCICYAASIGGTATLTGTGPNVVLLGQMNELFPDSKDLVNFASWFAFAFPNMLVMLLFAWLWLQFVYMRFNFKKSWGCGLESKKNEKAALKVLQEEYRKLGPLSFAEINVLICFFLLVILWFSRDPGFMPGWLTVAWVEGETKYVSDATVAIFVATLLFIVPSQKPKFNFRSQTEEERKTPFYPPPLLDWKVTQEKVPWGIVLLLGGGFALAKGSEASGLSVWMGKQMEPLHAVPPAAITLILSLLVAVFTECTSNVATTTLFLPIFASMVKTGVIMNIIGVFCVFLAVNTWGRAIFDLDHFPDWANVTHIET

SEQ ID NO: 80435 - protein, 94 aa, Homo sapiens
  Payload ID: 16032
  Gene Symbol: SLC13A5
  Gene Name: solute carrier family 13 (sodium-dependent citrate transporter), member 5
  ENSP ID: ENSP00000460037
  MOD_RES (1)..(1): Any amino acid
XPAAITLILSLLVAVFTECTSNVATTTLFLPIFASMSRSIGLNPLYIMLPCTLSASFAFMLPVATPPNAIVFTYGHLKVADMVTQLFLFTPVGL

SEQ ID NO: 80436 - protein, 91 aa, Homo sapiens
  Payload ID: 16032
  Gene Symbol: SLC13A5
  Gene Name: solute carrier family 13 (sodium-dependent citrate transporter), member 5
  ENSP ID: ENSP00000460903
MASALSYVSKFKSFVILFVTPLLLLPLVILMPAKFVRCAYVIILMAIYWCTEVIPLAVTSLMPVLLFPLFQILDSRQGDTTRACIPTPSCP

SEQ ID NO: 80437 - protein, 81 aa, Homo sapiens
  Payload ID: 16032
  Gene Symbol: SLC13A5
  Gene Name: solute carrier family 13 (sodium-dependent citrate transporter), member 5
  ENSP ID: ENSP00000461495
MASALSYVSKFKSFVILFVTPLLLLPLVILMPAKFVRCAYVIILMAIYWCTEVIPLAVTSLMPVLLFPLFQILDSRCVSST

SEQ ID NO: 80438 - protein, 167 aa, Homo sapiens
  Payload ID: 16032
  Gene Symbol: SLC13A5
  Gene Name: solute carrier family 13 (sodium-dependent citrate transporter), member 5
  ENSP ID: ENSP00000461622
MASALSYVSKFKSFVILFVTPLLLLPLVILMPAKILDSRQVCVQYMKDTNMLFLGGLIVAVAVERWNLHKRIALRTLLWVGAKPARLMLGFMGVTALLSMWISNTATTAMMVPIVEAILQQMEATSAATEAGLELVDKGKAKELPGSQVIFEGPTLGQQEDQERKRL

SEQ ID NO: 80439 - protein, 592 aa, Homo sapiens
  Payload ID: 16033
  Gene Symbol: SLC13A2
  Gene Name: solute carrier family 13 (sodium-dependent dicarboxylate transporter), member 2
  Uniprot ID: Q13183
  ENSP ID: ENSP00000316202
MATCWQALWAYRSYLIVFFVPILLLPLPILVPSKEAYCAYAIILMALFWCTEALPLAVTALFPLILFPMMGIVDASEVAVEYLKDSNLLFFGGLLVAIAVEHWNLHKRIALRVLLIVGVRPAPLILGFMLVTAFLSMWISNTATSAMMVPIAHAVLDQLHSSQASSNVEEGSNNPTFELQEPSPQKEVTKLDNGQALPVTSASSEGRAHLSQKHLHLTQCMSLCVCYSASIGGIATLTGTAPNLVLQGQINSLFPQNGNVVNFASWFSFAFPTMVILLLLAWLWLQILFLGFNFRKNFGIGEKMQEQQQAAYCVIQTEHRLLGPMTFAEKAISILFVILVLLWFTREPGFFLGWGNLAFPNAKGESMVSDGTVAIFIGIIMFIIPSKFPGLTQDPENPGKLKAPLGLLDWKTVNQKMPWNIVLLLGGGYALAKGSERSGLSEWLGNKLTPLQSVPAPAIAIILSLLVATFTECTSNVATTTIFLPILASMAQAICLHPLYVMLPCTLATSLAFMLPVATPPNAIVFSFGDLKVLDMARAGFLLNIIGVLIIALAINSWGIPLFSLHSFPSWAQSNTTAQCLPSLANTTTPSP

SEQ ID NO: 80440 - protein, 641 aa, Homo sapiens
  Payload ID: 16033
  Gene Symbol: SLC13A2
  Gene Name: solute carrier family 13 (sodium-dependent dicarboxylate transporter), member 2
  Uniprot ID: Q13183
  ENSP ID: ENSP00000392411
MATCWQALWAYRSYLIVFFVPILLLPLPILVPSKEAYCAYAIILMALFWCTEALPLAVTALFPLILFPMMGIVDASEIIQRPFPSSFESPGECQSVGMSVTASHNLGGTVGDSRVFPPLSHVSTCQVAVEYLKDSNLLFFGGLLVAIAVEHWNLHKRIALRVLLIVGVRPAPLILGFMLVTAFLSMWISNTATSAMMVPIAHAVLDQLHSSQASSNVEEGSNNPTFELQEPSPQKEVTKLDNGQALPVTSASSEGRAHLSQKHLHLTQCMSLCVCYSASIGGIATLTGTAPNLVLQGQINSLFPQNGNVVNFASWFSFAFPTMVILLLLAWLWLQILFLGFNFRKNFGIGEKMQEQQQAAYCVIQTEHRLLGPMTFAEKAISILFVILVLLWFTREPGFFLGWGNLAFPNAKGESMVSDGTVAIFIGIIMFIIPSKFPGLTQDPENPGKLKAPLGLLDWKTVNQKMPWNIVLLLGGGYALAKGSERSGLSEWLGNKLTPLQSVPAPAIAIILSLLVATFTECTSNVATTTIFLPILASMAQAICLHPLYVMLPCTLATSLAFMLPVATPPNAIVFSFGDLKVLDMARAGFLLNIIGVLIIALAINSWGIPLFSLHSFPSWAQSNTTAQCLPSLANTTTPSP

SEQ ID NO: 80441 - protein, 358 aa, Homo sapiens
  Payload ID: 16033
  Gene Symbol: SLC13A2
  Gene Name: solute carrier family 13 (sodium-dependent dicarboxylate transporter), member 2
  ENSP ID: ENSP00000441935
MALFWCTEALPLAVTALFPLILFPMMGIVDASEVAVEYLKDSNLLFFGGLLVAIAVEHWNLHKRIALRVLLIVGVRPAPLILGFMLVTAFLSMWISNTATSAMMVPIAHAVLDQLHSSQASSNVEEGSNNPTFELQEPSPQKEVTKLDNGQALPVTSASSEGRAHLSQKHLHLTQCMSLCVCYSASIGGIATLTGTAPNLVLQGQINSLFPQNGNVVNFASWFSFAFPTMVILLLLAWLWLQILFLGFNFRKNFGIGEKMQEQQQAAYCVIQTEHRLLGPMTFAEKAISILFVILVLLWFTREPGFFWLGQFGFSQCQGGEVRVAGVGRRTHLGLTCSGRREGYRAPIAEQEVTLGGG

SEQ ID NO: 80442 - protein, 27 aa, Homo sapiens
  Payload ID: 16033
  Gene Symbol: SLC13A2
  Gene Name: solute carrier family 13 (sodium-dependent dicarboxylate transporter), member 2
  ENSP ID: ENSP00000463421
  MOD_RES (1)..(1): Any amino acid
XAYRSYLIVFFVPILLLPLPILVPSKL

SEQ ID NO: 80443 - protein, 35 aa, Homo sapiens
  Payload ID: 16033
  Gene Symbol: SLC13A2
  Gene Name: solute carrier family 13 (sodium-dependent dicarboxylate transporter), member 2
  ENSP ID: ENSP00000463457
MATCWQALWAYRSYLIVFFVPILLLPLPILVPSKL

SEQ ID NO: 80444 - protein, 27 aa, Homo sapiens
  Payload ID: 16033
  Gene Symbol: SLC13A2
  Gene Name: solute carrier family 13 (sodium-dependent dicarboxylate transporter), member 2
  ENSP ID: ENSP00000464074
  MOD_RES (1)..(1): Any amino acid
XAYRSYLIVFFVPILLLPLPILVPSKL

SEQ ID NO: 80445 - protein, 602 aa, Homo sapiens
  Payload ID: 16034
  Gene Symbol: SLC13A3
  Gene Name: solute carrier family 13 (sodium-dependent dicarboxylate transporter), member 3
  Uniprot ID: Q8WWT9
  ENSP ID: ENSP00000279027
MAALAAAAKKVWSARRLLVLLFTPLALLPVVFALPPKEGRCLFVILLMAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTAAVRRNGLHTVPTEMQFLASTEAKDHPGETEVPLDLPADSRKEDEYRRNIWKGFLISIPYSASIGGTATLTGTAPNLILLGQLKSFFPQCDVVNFGSWFIFAFPLMLLFLLAGWLWISFLYGGLSFRGWRKNKSEIRTNAEDRARAVIREEYQNLGPIKFAEQAVFILFCMFAILLFTRDPKFIPGWASLFNPGFLSDAVTGVAIVTILFFFPSQRPSLKWWFDFKAPNTETEPLLTWKKAQETVPWNIILLLGGGFAMAKGCEESGLSVWIGGQLHPLENVPPALAVLLITVVIAFFTEFASNTATIIIFLPVLAELAIRLRVHPLYLMIPGTVGCSFAFMLPVSTPPNSIAFASGHLLVKDMVRTGLLMNLMGVLLLSLAMNTWAQTIFQLGTFPDWADMYSVNVTALPPTLANDTFRTL

SEQ ID NO: 80446 - protein, 555 aa, Homo sapiens
  Payload ID: 16034
  Gene Symbol: SLC13A3
  Gene Name: solute carrier family 13 (sodium-dependent dicarboxylate transporter), member 3
  Uniprot ID: Q8WWT9
  ENSP ID: ENSP00000290317
MAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTAAVRRNGLHTVPTEMQFLASTEAKDHPGETEVPLDLPADSRKEDEYRRNIWKGFLISIPYSASIGGTATLTGTAPNLILLGQLKSFFPQCDVVNFGSWFIFAFPLMLLFLLAGWLWISFLYGGLSFRGWRKNKSEIRTNAEDRARAVIREEYQNLGPIKFAEQAVFILFCMFAILLFTRDPKFIPGWASLFNPGFLSDAVTGVAIVTILFFFPSQRPSLKWWFDFKAPNTETEPLLTWKKAQETVPWNIILLLGGGFAMAKGCEESGLSVWIGGQLHPLENVPPALAVLLITVVIAFFTEFASNTATIIIFLPVLAELAIRLRVHPLYLMIPGTVGCSFAFMLPVSTPPNSIAFASGHLLVKDMVRTGLLMNLMGVLLLSLAMNTWAQTIFQLGTFPDWADMYSVNVTALPPTLANDTFRTL

SEQ ID NO: 80447 - protein, 248 aa, Homo sapiens
  Payload ID: 16034
  Gene Symbol: SLC13A3
  Gene Name: solute carrier family 13 (sodium-dependent dicarboxylate transporter), member 3
  ENSP ID: ENSP00000361193
MAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTAKTTLGRQRFHWICRLTPGRRMNIVGTSGRASSSPSPTQPVLGAQPHSRAQPLTSSCLASSRGWLWISFLYGGLSFRGWRKNKSEIRTNAEDRARAVIREEYQNLGPIKFAEQAV

SEQ ID NO: 80448 - protein, 236 aa, Homo sapiens
  Payload ID: 16034
  Gene Symbol: SLC13A3
  Gene Name: solute carrier family 13 (sodium-dependent dicarboxylate transporter), member 3
  ENSP ID: ENSP00000394217
  MOD_RES (1)..(1): Any amino acid
XFHNFGNGCSAAVRRNGLHTVPTEMQFLASTEAKDHPGETEVPLDLPADSRKEDEYRRNIWKGFLISIPYSASIGGTATLTGTAPNLILLGQLKSFFPQCDVVNFGSWFIFAFPLMLLFLLAGWLWISFLYGGLSFRGWRKNKSEIRTNAEDRARAVIREEYQNLGPIKFAEQAVFILFCMFAILLFTRDPKFIPGWASLFNPGFLSDAVTGVAIVTILFFFPSQRPSLKWWFDFK

SEQ ID NO: 80449 - protein, 301 aa, Homo sapiens
  Payload ID: 16034
  Gene Symbol: SLC13A3
  Gene Name: solute carrier family 13 (sodium-dependent dicarboxylate transporter), member 3
  ENSP ID: ENSP00000395095
EGRCLFVILLMAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTAKTTLGRQRFHWICRLTPGRRMNIVGTSGRASSSPSPTQPVLGAQPHSRAQPLTSSCLASSRGWLWISFLYGGLSFRGWRKNKSEIRTNAEDRARAVIREEYQNLGPIKFAEQAVFILFCMFAILLFTRDPKFIPGWASLFNPGCKMGIISISTIQKM

SEQ ID NO: 80450 - protein, 185 aa, Homo sapiens
  Payload ID: 16034
  Gene Symbol: SLC13A3
  Gene Name: solute carrier family 13 (sodium-dependent dicarboxylate transporter), member 3
  ENSP ID: ENSP00000397955
MAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTGIEPNTFLSEERLKLQAPLVIRLGQITESGQWNMSGNDVCNFRVLSFLPGGM

SEQ ID NO: 80451 - protein, 552 aa, Homo sapiens
  Payload ID: 16034
  Gene Symbol: SLC13A3
  Gene Name: solute carrier family 13 (sodium-dependent dicarboxylate transporter), member 3
  Uniprot ID: Q8WWT9
  ENSP ID: ENSP00000415852
MAALAAAAKKVWSARRLLVLLFTPLALLPVVFALPPKEGRCLFVILLMAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTAKTTLGRQRFHWICRLTPGRRMNIVGTSGRASSSPSPTQPVLGAQPHSRAQPLTSSCLASSRGWLWISFLYGGLSFRGWRKNKSEIRTNAEDRARAVIREEYQNLGPIKFAEQAVFILFCMFAILLFTRDPKFIPGWASLFNPGFLSDAVTGVAIVTILFFFPSQRPSLKWWFDFKAPNTETEPLLTWKKAQETVPWNIILLLGGGFAMAKGCEESGLSVWIGGQLHPLENVPPALAVLLITVVIAFFTEFASNTATIIIFLPVLAELAIRLRVHPLYLMIPGTVGCSFAFMLPVSTPPNSIAFASGHLLVKDMVRTGLLMNLMGVLLLSLAMNTWAQTIFQLGTFPDWADMYSVNVTALPPTLANDTFRTL

SEQ ID NO: 80452 - protein, 408 aa, Homo sapiens
  Payload ID: 16034
  Gene Symbol: SLC13A3
  Gene Name: solute carrier family 13 (sodium-dependent dicarboxylate transporter), member 3
  ENSP ID: ENSP00000417784
MAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTAAVRRNGLHTVPTEMQFLASTEAKDHPGETEVPLDLPADSRKEDEYRRNIWKGFLISIPYSASIGGTATLTGTAPNLILLGQLKSFFPQCDVVNFGSWFIFAFPLMLLFLLAGWLWISFLYGGLSFRGWRKNKSEIRTNAEDRARAVIREEYQNLGPIKFAEQAVFILFCMFAILLFTRDPKFIPGWASLFNPGFLSDAVTGVAIVTILFFFPSQRPSLKWWFDFKAPNTETEPLLTWKKAQETVPWNIILLLGGGFAMAKGCEESGLSVWIGGQ

SEQ ID NO: 80453 - protein, 555 aa, Homo sapiens; identical to SEQ ID NO: 80446
  Payload ID: 16034
  Gene Symbol: SLC13A3
  Gene Name: solute carrier family 13 (sodium-dependent dicarboxylate transporter), member 3
  Uniprot ID: Q8WWT9
  ENSP ID: ENSP00000419621

SEQ ID NO: 80454 - protein, 520 aa, Homo sapiens
  Payload ID: 16034
  Gene Symbol: SLC13A3
  Gene Name: solute carrier family 13 (sodium-dependent dicarboxylate transporter), member 3
  Uniprot ID: Q8WWT9
  ENSP ID: ENSP00000420177
MAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTAAVRRNGLHTVPTEMQFLASTEAKDHPGETEVPLDLPADSRKEDEYRRNIWKGFLISIPYSASIGGTATLTGTAPNLILLGQLKSFFPQCDVVNFGSWFIFAFPLMLLFLLAGWLWISFLYGGLSFRGWRKNKSEIRTNAEDRARAVIREEYQNLGPIKFLSDAVTGVAIVTILFFFPSQRPSLKWWFDFKAPNTETEPLLTWKKAQETVPWNIILLLGGGFAMAKGCEESGLSVWIGGQLHPLENVPPALAVLLITVVIAFFTEFASNTATIIIFLPVLAELAIRLRVHPLYLMIPGTVGCSFAFMLPVSTPPNSIAFASGHLLVKDMVRTGLLMNLMGVLLLSLAMNTWAQTIFQLGTFPDWADMYSVNVTALPPTLANDTFRTL

SEQ ID NO: 80455 - protein, 389 aa, Homo sapiens
  Payload ID: 16035
  Gene Symbol: SLC14A1
  Gene Name: solute carrier family 14 (urea transporter), member 1 (Kidd blood group)
  Uniprot ID: Q13336
  ENSP ID: ENSP00000318546
MEDSPTMVRVDSPTMVRGENQVSPCQGRRCFPKALGYVTGDMKELANQLKDKPVVLQFIDWILRGISQVVFVNNPVSGILILVGLLVQNPWWALTGWLGTVVSTLMALLLSQDRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMFMALTWQTHLLALGCALFTAYLGVGMANFMAEVGLPACTWPFCLATLLFLIMTTKNSNIYKMPLSKVTYPEENRIFYLQAKKRMVESPL

SEQ ID NO: 80456 - protein, 284 aa, Homo sapiens
  Payload ID: 16035
  Gene Symbol: SLC14A1
  Gene Name: solute carrier family 14 (urea transporter), member 1 (Kidd blood group)
  ENSP ID: ENSP00000385320
MALLLSQDRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMFMALTWQTHLLALGCALFTAYLGVGMANFMAEVGLPACTWPFCLATLLFLIMTTKNSNIYKMPLSKVTYPEENRIFYLQAKKRMVESPL

SEQ ID NO: 80457 - protein, 445 aa, Homo sapiens
  Payload ID: 16035
  Gene Symbol: SLC14A1
  Gene Name: solute carrier family 14 (urea transporter), member 1 (Kidd blood group)
  Uniprot ID: Q13336
  ENSP ID: ENSP00000390637
MNGRSLIGGAGDARHGPVWKDPFGTKAGDAARRGIARLSLALADGSQEQEPEEEIAMEDSPTMVRVDSPTMVRGENQVSPCQGRRCFPKALGYVTGDMKELANQLKDKPVVLQFIDWILRGISQVVFVNNPVSGILILVGLLVQNPWWALTGWLGTVVSTLMALLLSQDRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMFMALTWQTHLLALGCALFTAYLGVGMANFMAEVGLPACTWPFCLATLLFLIMTTKNSNIYKMPLSKVTYPEENRIFYLQAKKRMVESPL

SEQ ID NO: 80458 - protein, 445 aa, Homo sapiens; identical to SEQ ID NO: 80457
  Payload ID: 16035
  Gene Symbol: SLC14A1
  Gene Name: solute carrier family 14 (urea transporter), member 1 (Kidd blood group)
  Uniprot ID: Q13336
  ENSP ID: ENSP00000412309

SEQ ID NO: 80459 - protein, 257 aa, Homo sapiens
  Payload ID: 16035
  Gene Symbol: SLC14A1
  Gene Name: solute carrier family 14 (urea transporter), member 1 (Kidd blood group)
  ENSP ID: ENSP00000441998
MAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMFMALTWQTHLLALGCALFTAYLGVGMANFMAEVGLPACTWPFCLATLLFLIMTTKNSNIYKMPLSKVTYPEENRIFYLQAKKRMVESPL

SEQ ID NO: 80460 - protein, 281 aa, Homo sapiens
  Payload ID: 16035
  Gene Symbol: SLC14A1
  Gene Name: solute carrier family 14 (urea transporter), member 1 (Kidd blood group)
  ENSP ID: ENSP00000442180
MGRRNRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMFMALTWQTHLLALGCALFTAYLGVGMANFMAEVGLPACTWPFCLATLLFLIMTTKNSNIYKMPLSKVTYPEENRIFYLQAKKRMVESPL

SEQ ID NO: 80461 - protein, 28 aa, Homo sapiens
  Payload ID: 16035
  Gene Symbol: SLC14A1
  Gene Name: solute carrier family 14 (urea transporter), member 1 (Kidd blood group)
  ENSP ID: ENSP00000465029
MALLLSQDRSLIASGLYGYNATLVGVLM

SEQ ID NO: 80462 - protein, 302 aa, Homo sapiens
  Payload ID: 16035
  Gene Symbol: SLC14A1
  Gene Name: solute carrier family 14 (urea transporter), member 1 (Kidd blood group)
  ENSP ID: ENSP00000465044
MEDSPTMVRVDSPTMVRGENQVSPCQGRRCFPKALGYVTGDMKELANQLKDKPVVLQFIDWILRGISQVVFVNNPVSGILILVGLLVQNPWWALTGWLGTVVSTLMALLLSQDRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALEDSVFQPHLRTSTLDSGVSTALWPALQWEECSWRSPGKPTSWLLAVPCSRPILESAWQTLWLRLDCQLVPGPSVWPRYCSSS

SEQ ID NO: 80463 - protein, 173 aa, Homo sapiens
  Payload ID: 16035
  Gene Symbol: SLC14A1
  Gene Name: solute carrier family 14 (urea transporter), member 1 (Kidd blood group)
  ENSP ID: ENSP00000465150
  MOD_RES (1)..(1): Any amino acid
XLTGWLGTVVSTLMALLLSQDRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALEPCSRPILESAWQTLWLRERVKEELWGKKSKHNQRSSAVKNLGCG

SEQ ID NO: 80464 - protein, 102 aa, Homo sapiens
  Payload ID: 16035
  Gene Symbol: SLC14A1
  Gene Name: solute carrier family 14 (urea transporter), member 1 (Kidd blood group)
  ENSP ID: ENSP00000465702
MEDSPTMVRVDSPTMVRGENQVSPCQGRRCFPKALGYVTGDMKELANQLKDKPVVLQFIDWILRGISQVVFVNNPVSGILILVGLLVQNPWWALTGWLGTVV

SEQ ID NO: 80465 - protein, 129 aa, Homo sapiens
  Payload ID: 16035
  Gene Symbol: SLC14A1
  Gene Name: solute carrier family 14 (urea transporter), member 1 (Kidd blood group)
  ENSP ID: ENSP00000466093
MNGRSLIGGAGDARHGPVWKDPFGTKAGDAARRGIARLSLALADGSQEQEPEEEIAMEDSPTMVRVDSPTMVRGENQVSPCQGRRCFPKALGYVTGDMKELANQLKDKPVVLQFIDWILRGISQVVFVN

SEQ ID NO: 80466 - protein, 169 aa, Homo sapiens
  Payload ID: 16035
  Gene Symbol: SLC14A1
  Gene Name: solute carrier family 14 (urea transporter), member 1 (Kidd blood group)
  ENSP ID: ENSP00000466273
MAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMF

SEQ ID NO: 80467 - protein, 214 aa, Homo sapiens
  Payload ID: 16035
  Gene Symbol: SLC14A1
  Gene Name: solute carrier family 14 (urea transporter), member 1 (Kidd blood group)
  ENSP ID: ENSP00000467898
MNGRSLIGGAGDARHGPVWKDPFGTKAGDAARRGIARLSLALADGSQEQEPEEEIAMEDSPTMVRVDSPTMVRGENQVSPCQGRRCFPKALGYVTGDMKELANQLKDKPVVLQFIDWILRGISQVVFVNNPVSGILILVGLLVQNPWWALTGWLGTVVSTLMALLLSQDRSLIASGLYGYNATLVGVLMAVFSDKGDYFWWLLLPVCAMSMTCC

SEQ ID NO: 80468 - protein, 116 aa, Homo sapiens
  Payload ID: 16035
  Gene Symbol: SLC14A1
  Gene Name: solute carrier family 14 (urea transporter), member 1 (Kidd blood group)
  ENSP ID: ENSP00000468763
MALLLSQDRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALE

SEQ ID NO: 80469 - protein, 136 aa, Homo sapiens
  Payload ID: 16035
  Gene Symbol: SLC14A1
  Gene Name: solute carrier family 14 (urea transporter), member 1 (Kidd blood group)
  ENSP ID: ENSP00000470055
MEDSPTMVRVDSPTMVRGENQVSPCQGRRCFPKALGYVTGDMKELANQLKDKPVVLQFIDWILRGISQVVFVNNPVSGILILVGLLVQNPWWALTGWLGTVVSTLMALLLSQDRSLIASGLYGYNATLVGVLMAVF

SEQ ID NO: 80470 - protein, 389 aa, Homo sapiens; identical to SEQ ID NO: 80455
  Payload ID: 16035
  Gene Symbol: SLC14A1
  Gene Name: solute carrier family 14 (urea transporter), member 1 (Kidd blood group)
  Uniprot ID: Q13336
  ENSP ID: ENSP00000470476

SEQ ID NO: 80471 - protein, 302 aa, Homo sapiens; identical to SEQ ID NO: 80462
  Payload ID: 16035
  Gene Symbol: SLC14A1
  Gene Name: solute carrier family 14 (urea transporter), member 1 (Kidd blood group)
  ENSP ID: ENSP00000479595

SEQ ID NO: 80472 - protein, 920 aa, Homo sapiens
  Payload ID: 16036
  Gene Symbol: SLC14A2
  Gene Name: solute carrier family 14 (urea transporter), member 2
  Uniprot ID: Q15849
  ENSP ID: ENSP00000255226
MSDPHSSPLLPEPLSSRYKLYEAEFTSPSWPSTSPDTHPALPLLEMPEEKDLRSSNEDSHIVKIEKLNERSKRKDDGVAHRDSAGQRCICLSKAVGYLTGDMKEYRIWLKDKHLALQFIDWVLRGTAQVMFINNPLSGLIIFIGLLIQNPWWTITGGLGTVVSTLTALALGQDRSAIASGLHGYNGMLVGLLMAVFSEKLDYYWWLLFPVTFTAMSCPVLSSALNSIFSKWDLPVFTLPFNIAVTLYLAATGHYNLFFPTTLVEPVSSVPNITWTEMEMPLLLQAIPVGVGQVYGCDNPWTGGVFLVALFISSPLICLHAAIGSIVGLLAALSVATPFETIYTGLWSYNCVLSCIAIGGMFYALTWQTHLLALICALFCAYMEAAISNIMSVVGVPPGTWAFCLATIIFLLLTTNNPAIFRLPLSKVTYPEANRIYYLTVKSGEEEKAPSGGGGEHPPTAGPKVEEGSEAVLSKHRSVFHIEWSSIRRRSKVFGKGEHQERQNKDPFPYRYRKPTVELLDLDTMEESSEIKVETNISKTSWIRSSMAASGKRVSKALSYITGEMKECGEGLKDKSPVFQFFDWVLRGTSQVMFVNNPLSGILIILGLFIQNPWWAISGCLGTIMSTLTALILSQDKSAIAAGFHGYNGVLVGLLMAVFSDKGDYYWWLLLPVIIMSMSCPILSSALGTIFSKWDLPVFTLPFNITVTLYLAATGHYNLFFPTTLLQPASAMPNITWSEVQVPLLLRAIPVGIGQVYGCDNPWTGGIFLIALFISSPLICLHAAIGSTMGMLAALTIATPFDSIYFGLCGFNSTLACIAIGGMFYVITWQTHLLAIACALFAAYLGAALANMLSVFGLPPCTWPFCLSALTFLLLTTNNPAIYKLPLSKVTYPEANRIYYLSQERNRRASIITKYQAYDVS

SEQ ID NO: 80473 - protein, 235 aa, Homo sapiens
  Payload ID: 16036
  Gene Symbol: SLC14A2
  Gene Name: solute carrier family 14 (urea transporter), member 2
  ENSP ID: ENSP00000320689
MSDPHSSPLLPEPLSSRYKLYEAEFTSPSWPSTSPDTHPALPLLEMPEEKDLRSSNEDSHIVKIEKLNERSKRKDDGVAHRDSAGQRCICLSKAVGYLTGDMKEYRIWLKDKHLALQFIDWVLRGTAQVMFINNPLSGLIIFIGLLIQNPWWTITGGLGTVVSTLTALALGQDRSAIASGLHGYNGMLVGLLMAVFSEKLDYYWWLLFPVTFTAMSWMETDFNWSKSGCWKHLLQ

SEQ ID NO: 80474 - protein, 920 aa, Homo sapiens; identical to SEQ ID NO: 80472
  Payload ID: 16036
  Gene Symbol: SLC14A2
  Gene Name: solute carrier family 14 (urea transporter), member 2
  Uniprot ID: Q15849
  ENSP ID: ENSP00000465349

SEQ ID NO: 80475 - protein, 920 aa, Homo sapiens; identical to SEQ ID NO: 80472
  Payload ID: 16036
  Gene Symbol: SLC14A2
  Gene Name: solute carrier family 14 (urea transporter), member 2
  Uniprot ID: Q15849
  ENSP ID: ENSP00000465953

SEQ ID NO: 80476 - protein, 708 aa, Homo sapiens
  Payload ID: 16037
  Gene Symbol: SLC15A1
  Gene Name: solute carrier family 15 (oligopeptide transporter), member 1
  Uniprot ID: P46059
  ENSP ID: ENSP00000365686
MGMSKSHSFFGYPLSIFFIVVNEFCERFSYYGMRAILILYFTNFISWDDNLSTAIYHTFVALCYLTPILGALIADSWLGKFKTIVSLSIVYTIGQAVTSVSSINDLTDHNHDGTPDSLPVHVVLSLIGLALIALGTGGIKPCVSAFGGDQFEEGQEKQRNRFFSIFYLAINAGSLLSTIITPMLRVQQCGIHSKQACYPLAFGVPAALMAVALIVFVLGSGMYKKFKPQGNIMGKVAKCIGFAIKNRFRHRSKAFPKREHWLDWAKEKYDERLISQIKMVTRVMFLYIPLPMFWALFDQQGSRWTLQATTMSGKIGALEIQPDQMQTVNAILIVIMVPIFDAVLYPLIAKCGFNFTSLKKMAVGMVLASMAFVVAAIVQVEIDKTLPVFPKGNEVQIKVLNIGNNTMNISLPGEMVTLGPMSQTNAFMTFDVNKLTRINISSPGSPVTAVTDDFKQGQRHTLLVWAPNHYQVVKDGLNQKPEKGENGIRFVNTFNELITITMSGKVYANISSYNASTYQFFPSGIKGFTISSTEIPPQCQPNFNTFYLEFGSAYTYIVQRKNDSCPEVKVFEDISANTVNMALQIPQYFLLTCGEVVFSVTGLEFSYSQAPSNMKSVLQAGWLLTVAVGNIIVLIVAGAGQFSKQWAEYILFAALLLVVCVIFAIMARFYTYINPAEIEAQFDEDEKKNRLEKSNPYFMSGANSQKQM

SEQ ID NO: 80477 - protein, 706 aa, Homo sapiens
  Payload ID: 16037
  Gene Symbol: SLC15A1
  Gene Name: solute carrier family 15 (oligopeptide transporter), member 1
  ENSP ID: ENSP00000478051
MGMSKSHSFFGYPLSIFFIVVNEFCERFSYYGMRAILILYFTNFISWDDNLSTAIYHTFVALCYLTPILGALIADSWLGKFKTIVSLSIVYTIGQAVTSVSSINDLTDHNHDGTPDSLPVHVVLSLIGLALIALGTGGIKPCVSAFGGDQFEEGQEKQRNRFFSIFYLAINAGSLLSTIITPMLRVQQCGIHSKQACYPLAFGVPAALMAVALIVFVLGSGMYKKFKPQGNIMGKVAKCIGFAIKNRFRHRSKAFPKREHWLDWAKEKYDERLISQIKMVTRVMFLYIPLPMFWALFDQQGSRWTLQATTMSGKIGALEIQPDQMQTVNAILIVIMVPIFDAVLYPLIAKCGFNFTSLKKMAVGMVLASMAFVVAAIVQVEIDKTLPVFPKGNEVQIKVLNIGNNTMNISLPGEMVTLGPMSQTNAFMTFDVNKLTRINISSPGSPVTAVTDDFKQGQRHTLLVWAPNHYQVVKDGLNQKPEKGENGIRFVNTFNELITITMSGKVYANISSYQHIPVFPSGIKGFTISSTEIPPQCQPNFNTFYLEFGSAYTYIVQRKNDSCPEVKVFEDISANTVNMALQIPQYFLLTCGEVVFSVTGLEFSYSQAPSNMKSVLQAGWLLTVAVGNIIVLIVAGAGQFSKQWAEYILFAALLLVVCVIFAIMARFYTYINPAEIEAQFDEDEKKNRLEKSNPYFMSGANSQKQM

SEQ ID NO: 80478 - protein, 208 aa, Homo sapiens
  Payload ID: 16037
  Gene Symbol: SLC15A1
  Gene Name: solute carrier family 15 (oligopeptide transporter), member 1
  ENSP ID: ENSP00000482440
MDQWGVYFNPVLVSFCQSFFGYPLSIFFIVVNEFCERFSYYGMRAILILYFTNFISWDDNLSTAIYHTFVALCYLTPILGALIADSWLGKFKTIVSLSIVYTIGQAVTSVSSINDLTDHNHDGTPDSLPVHVVLSLIGLALIALGTGGIKPCVSAFGGDQFEEGQEKQRNRFFSIFYLAINAGSLLSTIITPMLRGKRYLKGTSVGLF

SEQ ID NO: 80479 - protein, 698 aa, Homo sapiens
  Payload ID: 16038
  Gene Symbol: SLC15A2
  Gene Name: solute carrier family 15 (oligopeptide transporter), member 2
  Uniprot ID: Q16348
  ENSP ID: ENSP00000295605
MNPFQKNESKETLFSPVSIEEVPPRPPSPPKKPSPTICGSNYPLSIAFIVVNEFCERFSYYGMKAVLILYFLYFLHWNEDTSTSIYHAFSSLCYFTPILGAAIADSWLGKFKVLSLIGLSLIALGTGGIKPCVAAFGGDQFEEKHAEERTRYFSVFYLSINAGSLISTFITPMLRGDVQCFGEDCYALAFGVPGLLMVIALVVFAMGSKIYNKPPPEGNIVAQVFKCIWFAISNRFKNRSGDIPKRQHWLDWAAEKYPKQLIMDVKALTRVLFLYIPLPMFWALLDQQGSRWTLQAIRMNRNLGFFVLQPDQMQVLNPLLVLIFIPLFDFVIYRLVSKCGINFSSLRKMAVGMILACLAFAVAAAVEIKINEMAPAQPGPQEVFLQVLNLADDEVKVTVVGNENNSLLIESIKSFQKTPHYSKLHLKTKSQDFHFHLKYHNLSLYTEHSVQEKNWYSLVIREDGNSISSMMVKDTESRTTNGMTTVRFVNTLHKDVNISLSTDTSLNVGEDYGVSAYRTVQRGEYPAVHCRTEDKNFSLNLGLLDFGAAYLFVITNNTNQGLQAWKIEDIPANKMSIAWQLPQYALVTAGEVMFSVTGLEFSYSQAPSSMKSVLQAAWLLTIAVGNIIVLVVAQFSGLVQWAEFILFSCLLLVICLIFSIMGYYYVPVKTEDMRGPADKHIPHIQGNMIKLETKKTKL

SEQ ID NO: 80480 - protein, 729 aa, Homo sapiens
  Payload ID: 16038
  Gene Symbol: SLC15A2
  Gene Name: solute carrier family 15 (oligopeptide transporter), member 2
  Uniprot ID: Q16348
  ENSP ID: ENSP00000417085
MNPFQKNESKETLFSPVSIEEVPPRPPSPPKKPSPTICGSNYPLSIAFIVVNEFCERFSYYGMKAVLILYFLYFLHWNEDTSTSIYHAFSSLCYFTPILGAAIADSWLGKFKTIIYLSLVYVLGHVIKSLGALPILGGQVVHTVLSLIGLSLIALGTGGIKPCVAAFGGDQFEEKHAEERTRYFSVFYLSINAGSLISTFITPMLRGDVQCFGEDCYALAFGVPGLLMVIALVVFAMGSKIYNKPPPEGNIVAQVFKCIWFAISNRFKNRSGDIPKRQHWLDWAAEKYPKQLIMDVKALTRVLFLYIPLPMFWALLDQQGSRWTLQAIRMNRNLGFFVLQPDQMQVLNPLLVLIFIPLFDFVIYRLVSKCGINFSSLRKMAVGMILACLAFAVAAAVEIKINEMAPAQPGPQEVFLQVLNLADDEVKVTVVGNENNSLLIESIKSFQKTPHYSKLHLKTKSQDFHFHLKYHNLSLYTEHSVQEKNWYSLVIREDGNSISSMMVKDTESRTTNGMTTVRFVNTLHKDVNISLSTDTSLNVGEDYGVSAYRTVQRGEYPAVHCRTEDKNFSLNLGLLDFGAAYLFVITNNTNQGLQAWKIEDIPANKMSIAWQLPQYALVTAGEVMFSVTGLEFSYSQAPSSMKSVLQAAWLLTIAVGNIIVLVVAQFSGLVQWAEFILFSCLLLVICLIFSIMGYYYVPVKTEDMRGPADKHIPHIQGNMIKLETKKTKL

SEQ ID NO: 80481 - protein, 152 aa, Homo sapiens
  Payload ID: 16038
  Gene Symbol: SLC15A2
  Gene Name: solute carrier family 15 (oligopeptide transporter), member 2
  ENSP ID: ENSP00000418704
MKAVLILYFLYFLHWNEDTSTSIYHAFSSLCYFTPILGAAIADSWLGKFKTIIYLSLVYVLGHVIKSLGALPILGGQVVHTVLSLIGLSLIALGTGGIKPCVAAFGGDQFEEKHAEERTRYFSVFYLSINAGSLISTFITPMLRGDVQCFGE

SEQ ID NO: 80482 - protein, 581 aa, Homo sapiens
  Payload ID: 16039
  Gene Symbol: SLC15A3
  Gene Name: solute carrier family 15 (oligopeptide transporter), member 3
  Uniprot ID: Q8IY34
  ENSP ID: ENSP00000227880
MPAPRAREQPRVPGERQPLLPRGARGPRRWRRAAGAAVLLVEMLERAAFFGVTANLVLYLNSTNFNWTGEQATRAALVFLGASYLLAPVGGWLADVYLGRYRAVALSLLLYLAASGLLPATAFPDGRSSFCGEMPASPLGPACPSAGCPRSSPSPYCAPVLYAGLLLLGLAASSVRSNLTSFGADQVMDLGRDATRRFFNWFYWSINLGAVLSLLVVAFIQQNISFLLGYSIPVGCVGLAFFIFLFATPVFITKPPMGSQVSSMLKLALQNCCPQLWQRHSARDRQCARVLADERSPQPGASPQEDIANFQVLVKILPVMVTLVPYWMVYFQMQSTYVLQGLHLHIPNIFPANPANISVALRAQGSSYTIPEAWLLLANVVVVLILVPLKDRLIDPLLLRCKLLPSALQKMALGMFFGFTSVIVAGVLEMERLHYIHHNETVSQQIGEVLYNAAPLSIWWQIPQYLLIGISEIFASIPGLEFAYSEAPRSMQGAIMGIFFCLSGVGSLLGSSLVALLSLPGGWLHCPKDFGNINNCRMDLYFFLLAGIQAVTALLFVWIAGRYERASQGPASHSRFSRDRG

SEQ ID NO: 80483 - protein, 247 aa, Homo sapiens
  Payload ID: 16039
  Gene Symbol: SLC15A3
  Gene Name: solute carrier family 15 (oligopeptide transporter), member 3
  ENSP ID: ENSP00000437908
  MOD_RES (1)..(1): Any amino acid
XPGASPQEDIANFQVLVKILPVMVTLVPYWMVYFQIPEAWLLLANVVVVLILVPLKDRLIDPLLLRCKLLPSALQKMALGMFFGFTSVIVAGVLEMERLHYIHHNETVSQQIGEVLYNAAPLSIWWQIPQYLLIGISEIFASIPGLEFAYSEAPRSMQGAIMGIFFCLSGVGSLLGSSLVALLSLPGGWLHCPKDFGNINNCRMDLYFFLLAGIQAVTALLFVWIAGRYERASQGPASHSRFSRDRG

SEQ ID NO: 80484 - protein, 209 aa, Homo sapiens
  Payload ID: 16039
  Gene Symbol: SLC15A3
  Gene Name: solute carrier family 15 (oligopeptide transporter), member 3
  ENSP ID: ENSP00000439535
MDLGRDATRRFFNWFYWSINLGAVLSLLVVAFIQQNISFLLGYSIPVGCVGLAFFIFLFATPVFITKPPMGSQVSSMLKLALQNCCPQLWQRHSARDRQCARVLADERSPQPGASPQEDIANFQVLVKILPVMVTLVPYWMVYFQMQSTYVLQGLHLHIPNIFPANPANISVALRAQGSSYTIPEAWLLLANVVVVLILVPLKDRLIDP

SEQ ID NO: 80485 - protein, 149 aa, Homo sapiens
  Payload ID: 16039
  Gene Symbol: SLC15A3
  Gene Name: solute carrier family 15 (oligopeptide transporter), member 3
  ENSP ID: ENSP00000441559
MPASPLGPACPSAGCPRSSPSPYCAPVLYAGLLLLGLAASSVRSNLTSFGADQVMDLGRDATRRFFNWFYWSINLGAVLSLLVVAFIQQNISFLLGYSIPVGCVGLAFFIFLFATPVFITKPPMGSQVSSMLKLALQNCCPQLWQRHSA

SEQ ID NO: 80486 - protein, 43 aa, Homo sapiens
  Payload ID: 16039
  Gene Symbol: SLC15A3
  Gene Name: solute carrier family 15 (oligopeptide transporter), member 3
  ENSP ID: ENSP00000441694
GAIMGIFFCLSGVGSLLGSSLVALLSLPGGWLHCPKDFAEEEL

SEQ ID NO: 80487 - protein, 456 aa, Homo sapiens
  Payload ID: 16039
  Gene Symbol: SLC15A3
  Gene Name: solute carrier family 15 (oligopeptide transporter), member 3
  ENSP ID: ENSP00000445773
MPAPRAREQPRVPGERQPLLPRGARGPRRWRRAAGAAVLLVEMLERAAFFGVTANLVLYLNSTNFNWTGEQATRAALVFLGASYLLAPVGGWLADVYLGRYRAVALSLLLYLAASGLLPATAFPDGRSSFCGEMPASPLGPACPSAGCPRSSPSPYCAPVLYAGLLLLGLAASSVRSNLTSFGADQVMDLGRDATRRFFNWFYWSINLGAVLSLLVVAFIQQNISFLLGYSIPVGCVGLAFFIFLFATPVFITKPPMGSQVSSMLKLALQNCCPQLWQRHSARDRQCARVLADERSPQPGASPQEDIANFQVLVKILPVMVTLVPYWMVYFQMQSTYVLQGLHLHIPNIFPANPANISVALRAQGSSYTESWRWSAYTTSTTTRPCPSRLGRSCTTRHHCPSGGRSLSTCSLGSVRSLPASQAWSLPTQRPRAPCRAPSWASSSACRGWAHCWAPA

SEQ ID NO: 80488 - protein, 313 aa, Homo sapiens
  Payload ID: 16039
  Gene Symbol: SLC15A3
  Gene Name: solute carrier family 15 (oligopeptide transporter), member 3
  ENSP ID: ENSP00000479400
MPAPRAREQPRVPGERQPLLPRGARGPRRWRRAAGAAVLLVEMLERAAFFGVTANLVLYLNSTNFNWTGEQATRAALVFLGASYLLAPVGGWLADVYLGRYRAVALSLLLYLAASGLLPATAFPDGRSSFCGEMPASPLGPACPSAGCPRSSPSPYCAPVLYAGLLLLGLAASSVRSNLTSFGADQVMDLGRDATRRFFNWFTGASTWVLCCRCWWWRLFSRTSASCWATASLWAVWAWHFSSSSLPPPSSSPSPRWAAKCPLCLSSLSKTAAPSCGNDTRPETVNVPACWPTRGLPSQGLPRKRTSPTSRCW

SEQ ID NO: 80489 - protein, 313 aa, Homo sapiens; identical to SEQ ID NO: 80488
  Payload ID: 16039
  Gene Symbol: SLC15A3
  Gene Name: solute carrier family 15 (oligopeptide transporter), member 3
  ENSP ID: ENSP00000484264

SEQ ID NO: 80490 - protein, 577 aa, Homo sapiens
  Payload ID: 16040
  Gene Symbol: SLC15A4
  Gene Name: solute carrier family 15 (oligopeptide transporter), member 4
  Uniprot ID: Q8N697
  ENSP ID: ENSP00000266771
MEGSGGGAGERAPLLGARRAAAAAAAAGAFAGRRAACGAVLLTELLERAAFYGITSNLVLFLNGAPFCWEGAQASEALLLFMGLTYLGSPFGGWLADARLGRARAILLSLALYLLGMLAFPLLAAPATRAALCGSARLLNCTAPGPDAAARCCSPATFAGLVLVGLGVATVKANITPFGADQVKDRGPEATRRFFNWFYWSINLGAILSLGGIAYIQQNVSFVTGYAIPTVCVGLAFVVFLCGQSVFITKPPDGSAFTDMFKILTYSCCSQKRSGERQSNGEGIGVFQQSSKQSLFDSCKMSHGGPFTEEKVEDVKALVKIVPVFLALIPYWTVYFQMQTTYVLQSLHLRIPEISNITTTPHTLPAAWLTMFDAVLILLLIPLKDKLVDPILRRHGLLPSSLKRIAVGMFFVMCSAFAAGILESKRLNLVKEKTINQTIGNVVYHAADLSLWWQVPQYLLIGISEIFASIAGLEFAYSAAPKSMQSAIMGLFFFFSGVGSFVGSGLLALVSIKAIGWMSSHTDFGNINGCYLNYYFFLLAAIQGATLLLFLIISVKYDHHRDHQRSRANGVPTSRRA

SEQ ID NO: 80491 - protein, 155 aa, Homo sapiens
  Payload ID: 16040
  Gene Symbol: SLC15A4
  Gene Name: solute carrier family 15 (oligopeptide transporter), member 4
  ENSP ID: ENSP00000365930
  MOD_RES (1)..(1): Any amino acid
XTAPGPDAAARCCSPATFAGLVLVGLGVATVKANITPFGADQVKDRGPEATRRFFNWFYWSINLGAILSLGGIAYIQQNVSFVTGYAIPTVCVGLAFVVFLCGQSVFITKPPDGSAFTDMFKILTYSCCSQKRSGERQSNGCLMVGHLQKRKWKM

SEQ ID NO: 80492 - protein, 238 aa, Homo sapiens
  Payload ID: 16040
  Gene Symbol: SLC15A4
  Gene Name: solute carrier family 15 (oligopeptide transporter), member 4
  ENSP ID: ENSP00000365935
  MOD_RES (1)..(1): Any amino acid
XSNLVLFLNGAPFCWEGAQASEALLLFMGLTYLGSPFGGWLADARLGRARAILLSLALYLLGMLAFPLLAAPATRAALCGSARLLNCTAPGPDAAARCCSPATFAGLVLVGLGVATVKANITPFGADQVKDRGPEATRRFFNWFYWSINLGAILSLGGIAYIQQNVSFVTGYAIPTVCVGLAFVVFLCGQSVFITKPPDGSAFTDMFKILTYSCCSQKRSGERQSNGCRQHMFYRVFI

SEQ ID NO: 80493 - protein, 187 aa, Homo sapiens
  Payload ID: 16040
  Gene Symbol: SLC15A4
  Gene Name: solute carrier family 15 (oligopeptide transporter), member 4
  ENSP ID: ENSP00000483143
MQTTYVLQSLHLRIPEISNITTTPHTLPAAWLTMFDAVLILLLIPLKDKLVDPILRRHGLLPSSLKRIAVGMFFVMCSAFAAGILESKRLNLVKEKTINQTIGNVVYHAADLSLWWQVPQYLLIGISEIFASIAGLEFAYSAAPKSMQSAIMGLFFFFSGRVVRGFWTAGTGVYQSHRMDEQSHRLW

SEQ ID NO: 80494 - protein, 579 aa, Homo sapiens
  Payload ID: 16041
  Gene Symbol: SLC15A5
  Gene Name: solute carrier family 15, member 5
  Uniprot ID: A6NIM6
  ENSP ID: ENSP00000340402
MSVTGFTITDEKVHLYHSIEKEKTVRHIGDLCSSHSVKKIQVGICLLLVELCERFTFFEVVCNMIPFCTIKLGYHNCQAAILNLCFIGTSILTPVFVRWLTDVYLGRNKLVYICLFLHFLGTALLSVVAFPLEDFYLGTYHAVNNIPKTEQHRLFYVALLTICLGIGGVRAIVCPLGAFGLQEYGSQKTMSFFNWFYWLMNLNATIVFLGISYIQHSQAWALVLLIPFMSMLMAVITLHMIYYNLIYQSEKRCSLLTGVGVLVSALKTCHPQYCHLGRDVTSQLDHAKEKNGGCYSELHVEDTTFFLTLLPLFIFQLLYRMCIMQIPSGYYLQTMNSNLNLDGFLLPIAVMNAISSLPLLILAPFLEYFSTCLFPSKRVGSFLSTCIIAGNLFAALSVMIAGFFEIHRKHFPAVEQPLSGKVLTVSSMPCFYLILQYVLLGVAETLVNPALSVISYRFVPSNVRGTSMNFLTLFNGFGCFTGALLVKLVYLISDGNWFPNTLNKGNLESFFFFLASLTLLNVLGFCSVSQRYCNLNHFNAQNIRGSNLEETLLLHEKSLKFYGSIQEFSSSIDLWETAL

SEQ ID NO: 80495 - protein, 201 aa, Homo sapiens
  Payload ID: 16042
  Gene Symbol: SLC16A10
  Gene Name: solute carrier family 16 (aromatic amino acid transporter), member 10
  ENSP ID: ENSP00000357843
MKHVNERFQDEKNKEVVLMCIGVTSGVGRLLFGRIADYVPGVKKVYLQVLSFFFIGLMSMMIPLCSIFGALIAVCLIMGLFDGCFISIMAPIAFELVGAQDVSQAIGFLLGFMSIPMTVGPPIAGLLRDKLGSYDVAFYLAGVPPLIGGAVLCFIPWIHSKKQREISKTTGKEKMEKMLENQNSLLSSSSGMFKKESDSII

SEQ ID NO: 80496 - protein, 515 aa, Homo sapiens
  Payload ID: 16042
  Gene Symbol: SLC16A10
  Gene Name: solute carrier family 16 (aromatic amino acid transporter), member 10
  Uniprot ID: Q8TF71
  ENSP ID: ENSP00000357844
MVLSQEEPDSARGTSEAQPLGPAPTGAAPPPGPGPSDSPEAAVEKVEVELAGPATAEPHEPPEPPEGGWGWLVMLAAMWCNGSVFGIQNACGVLFVSMLETFGSKDDDKMVFKTAWVGSLSMGMIFFCCPIVSVFTDLFGCRKTAVVGAAVGFVGLMSSSFVSSIEPLYLTYGIIFACGCSFAYQPSLVILGHYFKKRLGLVNGIVTAGSSVFTILLPLLLRVLIDSVGLFYTLRVLCIFMFVLFLAGFTYRPLATSTKDKESGGSGSSLFSRKKFSPPKKIFNFAIFKVTAYAVWAVGIPLALFGYFVPYVHLMKHVNERFQDEKNKEVVLMCIGVTSGVGRLLFGRIADYVPGVKKVYLQVLSFFFIGLMSMMIPLCSIFGALIAVCLIMGLFDGCFISIMAPIAFELVGAQDVSQAIGFLLGFMSIPMTVGPPIAGLLRDKLGSYDVAFYLAGVPPLIGGAVLCFIPWIHSKKQREISKTTGKEKMEKMLENQNSLLSSSSGMFKKESDSII

SEQ ID NO: 80497 - protein, 206 aa, Homo sapiens
  Payload ID: 16042
  Gene Symbol: SLC16A10
  Gene Name: solute carrier family 16 (aromatic amino acid transporter), member 10
  ENSP ID: ENSP00000387501
  MOD_RES (1)..(1): Any amino acid
XWVGSLSMGMIFFCCPIVSVFTDLFGCRKTAVVGAAVGFVGLMSSSFVSSIEPLYLTYGIIFACGCSFAYQPSLVILGHYFKKRLGLVNGIVTAGSSVFTILLPLLLRVLIDSVGLFYTLRVLCIFMFVLFLAGFTYRPLATSTKDKESGGSGSSLFSRKKFSPPKKIFNFAIFKVTAYAVWAVGIPLALFGYFVPYVHLVSMLLH

SEQ ID NO: 80498 - protein, 211 aa, Homo sapiens
  Payload ID: 16042
  Gene Symbol: SLC16A10
  Gene Name: solute carrier family 16 (aromatic amino acid transporter), member 10
  ENSP ID: ENSP00000399601
  MOD_RES (1)..(1): Any amino acid
XWVGSLSMGMIFFCCPIVSVFTDLFGCRKTAVVGAAVGFVGLMSSSFVSSIEPLYLTYGIIFACGCSFAYQPSLVILGHYFKKRLGLVNGIVTAGSSVFTILLPLLLRVLIDSVGLFYTLRVLCIFMFVLFLAGFTYRPLATSTKDKESGGSGSSLFSRKKFSPPKKIFNFAIFKVTAYAVWAVGIPLALFGYFVPYVHLAKFSFVILKYE

SEQ ID NO: 80499 - protein, 326 aa, Homo sapiens
  Payload ID: 16042
  Gene Symbol: SLC16A10
  Gene Name: solute carrier family 16 (aromatic amino acid transporter), member 10
  ENSP ID: ENSP00000483868
MVLSQEEPDSARGTSEAQPLGPAPTGAAPPPGPGPSDSPEAAVEKVEVELAGPATAEPHEPPEPPEGGWGWLVMLAAMWCNGSVFGIQNACGVLFVSMLETFGSKDDDKMVFKTAWVGSLSMGMIFFCCPIVSVFTDLFGCRKTAVVGAAVGFVGLMSSSFVSSIEPLYLTYGIIFACGCSFAYQPSLVILGHYFKKRLGLVNGIVTAGSSVFTILLPLLLRVLIDSVGLFYTLRVLCIFMFVLFLAGFTYRPLATSTKDKESGGSGSSLFSRKKFSPPKNFQFCHLQGDSLCSVGSWNTTCTFWILCALCSLGEYAPSLIMNITI

SEQ ID NO: 80500 - protein, 500 aa, Homo sapiens
  Payload ID: 16043
  Gene Symbol: SLC16A1
  Gene Name: solute carrier family 16 (monocarboxylate transporter), member 1
  Uniprot ID: P53985
  ENSP ID: ENSP00000358640
MPPAVGGPVGYTPPDGGWGWAVVIGAFISIGFSYAFPKSITVFFKEIEGIFHATTSEVSWISSIMLAVMYGGGPISSILVNKYGSRIVMIVGGCLSGCGLIAASFCNTVQQLYVCIGVIGGLGLAFNLNPALTMIGKYFYKRRPLANGLAMAGSPVFLCTLAPLNQVFFGIFGWRGSFLILGGLLLNCCVAGALMRPIGPKPTKAGKDKSKASLEKAGKSGVKKDLHDANTDLIGRHPKQEKRSVFQTINQFLDLTLFTHRGFLLYLSGNVIMFFGLFAPLVFLSSYGKSQHYSSEKSAFLLSILAFVDMVARPSMGLVANTKPIRPRIQYFFAASVVANGVCHMLAPLSTTYVGFCVYAGFFGFAFGWLSSVLFETLMDLVGPQRFSSAVGLVTIVECCPVLLGPPLLGRLNDMYGDYKYTYWACGVVLIISGIYLFIGMGINYRLLAKEQKANEQKKESKEEETSIDVAGKPNEVTKAAESPDQKDTDGGPKEEESPV

SEQ ID NO: 80501 - protein, 215 aa, Homo sapiens
  Payload ID: 16043
  Gene Symbol: SLC16A1
  Gene Name: solute carrier family 16 (monocarboxylate transporter), member 1
  ENSP ID: ENSP00000397106
MPPAVGGPVGYTPPDGGWGWAVVIGAFISIGFSYAFPKSITVFFKEIEGIFHATTSEVSWISSIMLAVMYGGGPISSILVNKYGSRIVMIVGGCLSGCGLIAASFCNTVQQLYVCIGVIGGLGLAFNLNPALTMIGKYFYKRRPLANGLAMAGSPVFLCTLAPLNQVFFGIFGWRGSFLILGGLLLNCCVAGALMRPIGPKPTKAGKDKSKASLE

SEQ ID NO: 80502 - protein, 296 aa, Homo sapiens
  Payload ID: 16043
  Gene Symbol: SLC16A1
  Gene Name: solute carrier family 16 (monocarboxylate transporter), member 1
  ENSP ID: ENSP00000399104
MPPAVGGPVGYTPPDGGWGWAVVIGAFISIGFSYAFPKSITVFFKEIEGIFHATTSEVSWISSIMLAVMYGGGPISSILVNKYGSRIVMIVGGCLSGCGLIAASFCNTVQQLYVCIGVIGGLGLAFNLNPALTMIGKYFYKRRPLANGLAMAGSPVFLCTLAPLNQVFFGIFGWRGSFLILGGLLLNCCVAGALMRPIGPKPTKAGKDKSKASLEKAGKSGVKKDLHDANTDLIGRHPKQEKRSVFQTINQFLDLTLFTHRGFLLYLSGNVIMFFGLFAPLVFLSSYGKSQHYSSE

SEQ ID NO: 80503 - protein, 456 aa, Homo sapiens
  Payload ID: 16043
  Gene Symbol: SLC16A1
  Gene Name: solute carrier family 16 (monocarboxylate transporter), member 1
  ENSP ID: ENSP00000416167
MPPAVGGPVGYTPPDGGWGWAVVIGAFISIGFSYAFPKSITVFFKEIEGIFHATTSEVSWISSIMLAVMYGGGPISSILVNKYGSRIVMIVGGCLSGCGLIAASFCNTVQQLYVCIGVIGGLGLAFNLNPALTMIGKYFYKRRPLANGLAMAGSPVFLCTLAPLNQVFFGIFGWRGSFLILGGLLLNCCVAGALMRPIGPKPTKAGKDKSKASLEKAGKSGVKKDLHDANTDLIGRHPKQEKRSVFQTINQFLDLTLFTHRGFLLYLSGNVIMFFGLFAPLVFLSSYGKSQHYSSEKSAFLLSILAFVDMVARPSMGLVANTKPIRPRIQYFFAASVVANGVCHMLAPLSTTYVGFCVYAGFFGFAFGWLSSVLFETLMDLVGPQRFSSAVGLVTIVECCPVLLGPPLLGRLNDMYGDYKYTYWACGVVLIISGIYLFIGMGINYRLLAKEQKANE

SEQ ID NO: 80504 - protein, 500 aa, Homo sapiens; identical to SEQ ID NO: 80500
  Payload ID: 16043
  Gene Symbol: SLC16A1
  Gene Name: solute carrier family 16 (monocarboxylate transporter), member 1
  Uniprot ID: P53985
  ENSP ID: ENSP00000441065

SEQ ID NO: 80505 - protein, 500 aa, Homo sapiens; identical to SEQ ID NO: 80500
  Payload ID: 16043
  Gene Symbol: SLC16A1
  Gene Name: solute carrier family 16 (monocarboxylate transporter), member 1
  Uniprot ID: P53985
  ENSP ID: ENSP00000485688

SEQ ID NO: 80506 - protein, 215 aa, Homo sapiens; identical to SEQ ID NO: 80501
  Payload ID: 16043
  Gene Symbol: SLC16A1
  Gene Name: solute carrier family 16 (monocarboxylate transporter), member 1
  ENSP ID: ENSP00000485854

SEQ ID NO: 80507 - protein, 500 aa, Homo sapiens; identical to SEQ ID NO: 80500
  Payload ID: 16043
  Gene Symbol: SLC16A1
  Gene Name: solute carrier family 16 (monocarboxylate transporter), member 1
  Uniprot ID: P53985
  ENSP ID: ENSP00000486000

SEQ ID NO: 80508 - protein, 296 aa, Homo sapiens; identical to SEQ ID NO: 80502
  Payload ID: 16043
  Gene Symbol: SLC16A1
  Gene Name: solute carrier family 16 (monocarboxylate transporter), member 1
  ENSP ID: ENSP00000486404

SEQ ID NO: 80509 - protein, 456 aa, Homo sapiens; identical to SEQ ID NO: 80503
  Payload ID: 16043
  Gene Symbol: SLC16A1
  Gene Name: solute carrier family 16 (monocarboxylate transporter), member 1
  ENSP ID: ENSP00000486874

SEQ ID NO: 80510 - protein, 465 aa, Homo sapiens
  Payload ID: 16044
  Gene Symbol: SLC16A3
  Gene Name: solute carrier family 16 (monocarboxylate transporter), member 3
  Uniprot ID: O15427
  ENSP ID: ENSP00000376150
MGGAVVDEGPTGVKAPDGGWGWAVLFGCFVITGFSYAFPKAVSVFFKELIQEFGIGYSDTAWISSILLAMLYGTGPLCSVCVNRFGCRPVMLVGGLFASLGMVAASFCRSIIQVYLTTGVITGLGLALNFQPSLIMLNRYFSKRRPMANGLAAAGSPVFLCALSPLGQLLQDRYGWRGGFLILGGLLLNCCVCAALMRPLVVTAQPGSGPPRPSRRLLDLSVFRDRGFVLYAVAASVMVLGLFVPPVFVVSYAKDLGVPDTKAAFLLTILGFIDIFARPAAGFVAGLGKVRPYSVYLFSFSMFFNGLADLAGSTAGDYGGLVVFCIFFGISYGMVGALQFEVLMAIVGTHKFSSAIGLVLLMEAVAVLVGPPSGGKLLDATHVYMYVFILAGAEVLTSSLILLLGNFFCIRKKPKEPQPEVAAAEEEKLHKPPADSGVDLREVEHFLKAEPEKNGEVVHTPETSV

SEQ ID NO: 80511 - protein, 465 aa, Homo sapiens; identical to SEQ ID NO: 80510
  Payload ID: 16044
  Gene Symbol: SLC16A3
  Gene Name: solute carrier family 16 (monocarboxylate transporter), member 3
  Uniprot ID: O15427
  ENSP ID: ENSP00000376152

SEQ ID NO: 80512 - protein, 465 aa, Homo sapiens; identical to SEQ ID NO: 80510
  Payload ID: 16044
  Gene Symbol: SLC16A3
  Gene Name: solute carrier family 16 (monocarboxylate transporter), member 3
  Uniprot ID: O15427
  ENSP ID: ENSP00000462405

SEQ ID NO: 80513 - protein, 219 aa, Homo sapiens
  Payload ID: 16044
  Gene Symbol: SLC16A3
  Gene Name: solute carrier family 16 (monocarboxylate transporter), member 3
  ENSP ID: ENSP00000462854
MGGAVVDEGPTGVKAPDGGWGWAVLFGCFVITGFSYAFPKAVSVFFKELIQEFGIGYSDTAWISSILLAMLYGTGPLCSVCVNRFGCRPVMLVGGLFASLGMVAASFCRSIIQVYLTTGVITGLGLALNFQPSLIMLNRYFSKRRPMANGLAAAGSPVFLCALSPLGQLLQDRYGWRGGFLILGGLLLNCCVCAALMRPLVVTAQPGSGPPRPSRRLLD

SEQ ID NO: 80514 - protein, 306 aa, Homo sapiens
  Payload ID: 16044
  Gene Symbol: SLC16A3
  Gene Name: solute carrier family 16 (monocarboxylate transporter), member 3
  ENSP ID: ENSP00000463005
LIMLNRYFSKRRPMANGLAAAGSPVFLCALSPLGQLLQDRYGWRGGFLILGGLLLNCCVCAALMRPLVVTAQPGSGPPRPSRRLLDLSVFRDRGFVLYAVAASVMVLGLFVPPVFVVSYAKDLGVPDTKAAFLLTILGFIDIFARPAAGFVAGLGKVRPYSVYLFSFSMFFNGLADLAGSTAGDYGGLVVFCIFFGISYGMVGALQFEVLMAIVGTHKFSSAIGLVLLMEAVAVLVGPPSGGVLLSPRLEGSGTITAPCSLNLPNSSHPPASASRVAETTDVSHCTWPVSFSSLPPKCLSRNHPFC

SEQ ID NO: 80515 - protein, 157 aa, Homo sapiens
  Payload ID: 16044
  Gene Symbol: SLC16A3
  Gene Name: solute carrier family 16 (monocarboxylate transporter), member 3
  ENSP ID: ENSP00000463063
MGGAVVDEGPTGVKAVSVFFKELIQEFGIGYSDTAWISSILLAMLYGTGPLCSVCVNRFGCRPVMLVGGLFASLGMVAASFCRSIIQVYLTTGVITGLGLALNFQPSLIMLNRYFSKRRPMANGLAAAGSPVFLCALSPLGQLLQDRYGWRGGFLIL

SEQ ID NO: 80516 - protein, 135 aa, Homo sapiens
  Payload ID: 16044
  Gene Symbol: SLC16A3
  Gene Name: solute carrier family 16 (monocarboxylate transporter), member 3
  ENSP ID: ENSP00000463508
MGGAVVDEGPTGVKAPDGGWGWAVLFGCFVITGFSYAFPKAVSVFFKELIQEFGIGYSDTAWISSILLAMLYGTGPLCSVCVNRFGCRPVMLVGGLFASLGMVAASFCRSIIQVYLTTGVITGLGLALNFQPSLI

SEQ ID NO: 80517 - protein, 235 aa, Homo sapiens
  Payload ID: 16044
  Gene Symbol: SLC16A3
  Gene Name: solute carrier family 16 (monocarboxylate transporter), member 3
  ENSP ID: ENSP00000463880
MGGAVVDEGPTGVKAPDGGWGWAVLFGCFVITGFSYAFPKAVSVFFKELIQEFGIGYSDTAWISSILLAMLYGTGPLCSVCVNRFGCRPVMLVGGLFASLGMVAASFCRSIIQVYLTTGVITGLGLALNFQPSLIMLNRYFSKRRPMANGLAAAGSPVFLCALSPLGQLLQDRYGWRGGFLILGGLLLNCCVCAALMRPLVVTAQPGSGPPRPSRRLLDLSVFRDRGFVLYAVAA

SEQ ID NO: 80518 - protein, 263 aa, Homo sapiens
  Payload ID: 16044
  Gene Symbol: SLC16A3
  Gene Name: solute carrier family 16 (monocarboxylate transporter), member 3
  ENSP ID: ENSP00000463912
MGGAVVDEGPTGVKAPDGGWGWAVLFGCFVITGFSYAFPKAVSVFFKELIQEFGIGYSDTAWISSILLAMLYGTGLGLALNFQPSLIMLNRYFSKRRPMANGLAAAGSPVFLCALSPLGQLLQDRYGWRGGFLILGGLLLNCCVCAALMRPLVVTAQPGSGPPRPSRRLLDLSVFRDRGFVLYAVAASVMVLGLFVPPVFVVSYAKDLGVPDTKAAFLLTILGFIDIFARPAAGFVAGLGKVRPYSVYLFSFSMFFNGLADLA

SEQ ID NO: 80519 - protein, 465 aa, Homo sapiens; identical to SEQ ID NO: 80510
  Payload ID: 16044
  Gene Symbol: SLC16A3
  Gene Name: solute carrier family 16 (monocarboxylate transporter), member 3
  Uniprot ID: O15427
  ENSP ID: ENSP00000463978

SEQ ID NO: 80520 - protein, 223 aa, Homo sapiens
  Payload ID: 16044
  Gene Symbol: SLC16A3
  Gene Name: solute carrier family 16 (monocarboxylate transporter), member 3
  ENSP ID: ENSP00000464112
MGGAVVDEGPTGVKAPDGGWGWAVLFGCFVITGFSYAFPKAVSVFFKELIQEFGIGYSDTAWISSILLAMLYGTGPLCSVCVNRFGCRPVMLVGGLFASLGMVAASFCRSIIQVYLTTGVITGLGLALNFQPSLIMLNRYFSKRRPMANGLAAAGSPVFLCALSPLGQLLQDRYGWRGGFLILGGLLLNCCVCAALMRPLVVTAQPGSGPPRPSRRLLDLSVF

SEQ ID NO: 80521 - protein, 79 aa, Homo sapiens
  Payload ID: 16044
  Gene Symbol: SLC16A3
  Gene Name: solute carrier family 16 (monocarboxylate transporter), member 3
  ENSP ID: ENSP00000464326
MGGAVVDEGPTGVKAPDGGWGWAVLFGCFVITGFSYAFPKPVLPWAHMGPVPTPLECLGDSSFHPWKMEINLRVGGVLG

SEQ ID NO: 80522 - protein, 163 aa, Homo sapiens
  Payload ID: 16044
  Gene Symbol: SLC16A3
  Gene Name: solute carrier family 16 (monocarboxylate transporter), member 3
  ENSP ID: ENSP00000464381
MGGAVVDEGPTGVKAPDGGWGWAVLFGCFVITGFSYAFPKAVSVFFKELIQEFGIGYSDTAWISSILLAMLYGTGPLCSVCVNRFGCRPVMLVGGLFASLGMVAASFCRSIIQVYLTTGVITGLGLALNFQPSLIMLNRYFSKRRPMANGLAAAGSPVFLCAL

SEQ ID NO: 80523 - protein, 291 aa, Homo sapiens
  Payload ID: 16044
  Gene Symbol: SLC16A3
  Gene Name: solute carrier family 16 (monocarboxylate transporter), member 3
  ENSP ID: ENSP00000464625
MGGAVVDEGPTGVKAPDGGWGWAVLFGCFVITGFSYAFPKAVSVFFKELIQEFGIGYSDTAWISSILLAMLYGTGPLCSVCVNRFGCRPVMLVGGLFASLGMVAASFCRSIIQVYLTTGVITGLGLALNFQPSLIMLNRYFSKRRPMANGLAAAGSPVFLCALSPLGQLLQDRYGWRGGFLILGGLLLNCCVCAALMRPLVVTAQPGSGPPRPSRRLLDLSVFRDRGFVLYAVAASVMVLGLFVPPVFVVSYAKDLGVPDTKAAFLLTILGFIDIFARPAAGFVAGLGKVR

SEQ ID NO: 80524 - protein, 465 aa, Homo sapiens; identical to SEQ ID NO: 80510
  Payload ID: 16044
  Gene Symbol: SLC16A3
  Gene Name: solute carrier family 16 (monocarboxylate transporter), member 3
  Uniprot ID: O15427
  ENSP ID: ENSP00000482013

SEQ ID NO: 80525 - protein, 465 aa, Homo sapiens; identical to SEQ ID NO: 80510
  Payload ID: 16044
  Gene Symbol: SLC16A3
  Gene Name: solute carrier family 16 (monocarboxylate transporter), member 3
  Uniprot ID: O15427
  ENSP ID: ENSP00000483212

SEQ ID NO: 80526 - protein, 505 aa, Homo sapiens
  Payload ID: 16045
  Gene Symbol: SLC16A5
  Gene Name: solute carrier family 16 (monocarboxylate transporter), member 5
  Uniprot ID: O15375
  ENSP ID: ENSP00000330141
MPQALERADGSWAWVVLLATMVTQGLTLGFPTCIGIFFTELQWEFQASNSETSWFPSILTAVLHMAGPLCSILVGRFGCRVTVMLGGVLASLGMVASSFSHNLSQLYFTAGFITGLGMCFSFQSSITVLGFYFVRRRVLANALASMGVSLGITLWPLLSRYLLENLGWRGTFLVFGGIFLHCCICGAIIRPVATSVAPETKECPPPPPETPALGCLAACGRTIQRHLAFDILRHNTGYCVYILGVMWSVLGFPLPQVFLVPYAMWHSVDEQQAALLISIIGFSNIFLRPLAGLMAGRPAFASHRKYLFSLALLLNGLTNLVCAASGDFWVLVGYCLAYSVSMSGIGALIFQVLMDIVPMDQFPRALGLFTVLDGLAFLISPPLAGLLLDATNNFSYVFYMSSFFLISAALFMGGSFYALQKKEQGKQAVAADALERDLFLEAKDGPGKQRSPEIMCQSSRQPRPAGVNKHLWGCPASSRTSHEWLLWPKAVLQAKQTALGWNSPT

SEQ ID NO: 80527 - protein, 505 aa, Homo sapiens; identical to SEQ ID NO: 80526
  Payload ID: 16045
  Gene Symbol: SLC16A5
  Gene Name: solute carrier family 16 (monocarboxylate transporter), member 5
  Uniprot ID: O15375
  ENSP ID: ENSP00000390564

SEQ ID NO: 80528 - protein, 500 aa, Homo sapiens
  Payload ID: 16045
  Gene Symbol: SLC16A5
  Gene Name: solute carrier family 16 (monocarboxylate transporter), member 5
  Uniprot ID: O15375
  ENSP ID: ENSP00000440212
MPRPTRGPLATSQGWCPSVTPGTWAAATLAVRPWQRRQQRMPQALERADGSWAWVVLLATMVTQGLTLGFPTCIGIFFTELQWEFQASNSETSWFPSILTAVLHMAGPLCSILVGRFGCRVTVMLGGVLASLGMVASSFSHNLSQLYFTAGFITGLGMCFSFQSSITVLGFYFVRRRVLANALASMGVSLGITLWPLLSRYLLENLGWRGTFLVFGGIFLHCCICGAIIRPVATSVAPETKECPPPPPETPALGCLAACGRTIQRHLAFDILRHNTGYCVYILGVMWSVLGFPLPQVFLVPYAMWHSVDEQQAALLISIIGFSNIFLRPLAGLMAGRPAFASHRKYLFSLALLLNGLTNLVCAASGDFWVLVGYCLAYSVSMSGIGALIFQVLMDIVPMDQFPRALGLFTVLDGLAFLISPPLAGLLLDATNNFSYVFYMSSFFLISAALFMGGSFYALQKKEQGKQAVAADALERDLFLEAKDGPGKQRSPEIMYVTSV

SEQ ID NO: 80529 - protein, 203 aa, Homo sapiens
  Payload ID: 16045
  Gene Symbol: SLC16A5
  Gene Name: solute carrier family 16 (monocarboxylate transporter), member 5
  ENSP ID: ENSP00000462267
MGGEAGEPTGHPYRAAATLAVRPWQRRQQRMPQALERADGSWAWVVLLATMVTQGLTLGFPTCIGIFFTELQWEFQASNSETSWFPSILTAVLHMAGPLCSILVGRFGCRVTVMLGGVLASLGMVASSFSHNLSQLYFTAGFITGLGMCFSFQSSITVLGFYFVRRRVLANALASMGVSLGITLWPLLSRYLLENLGWRGTFL

SEQ ID NO: 80530 - protein, 53 aa, Homo sapiens
  Payload ID: 16045
  Gene Symbol: SLC16A5
  Gene Name: solute carrier family 16 (monocarboxylate transporter), member 5
  ENSP ID: ENSP00000462866
MPQALERADGSWAWVVLLATMVTQGLTLGFPTCIGIFFTELQWEFQASNSETS

SEQ ID NO: 80531 - protein, 454 aa, Homo sapiens
  Payload ID: 16045
  Gene Symbol: SLC16A5
  Gene Name: solute carrier family 16 (monocarboxylate transporter), member 5
  ENSP ID: ENSP00000463363
MPQALERADGSWAWVVLLATMVTQGLTLGFPTCIGIFFTELQWEFQASNSETSWFPSILTAVLHMAGPLCSILVGRFGCRVTVMLGGVLASLGMVASSFSHNLSQLYFTAGFITGLGMCFSFQSSITVLGFYFVRRRVLANALASMGVSLGITLWPLLSRYLLENLGWRGTFLVFGGIFLHCCICGAIIRPVATSVAPETKECPPPPPETPALGCLAACGRTIQRHLAFDILRHNTGYCVYILGVMWSVLGFPLPQVFLVPYAMWHSVDEQQAALLISIIGFSNIFLRPLAGLMAGRPAFASHRKYLFSLALLLNGLTNLVCAASGDFWVLVGYCLAYSVSMSGIGALIFQVLMDIVPMDQFPRALGLFTVLDGLAFLISPPLAGLLLDATNNFSYVFYMSSFFLISAALFMGGSFYALQKKEQGKQAVAADALERDLFLEAKDGPGKQRSPEI

SEQ ID NO: 80532 - protein, 505 aa, Homo sapiens; identical to SEQ ID NO: 80526
  Payload ID: 16045
  Gene Symbol: SLC16A5
  Gene Name: solute carrier family 16 (monocarboxylate transporter), member 5
  Uniprot ID: O15375
  ENSP ID: ENSP00000463434

SEQ ID NO: 80533 - protein, 236 aa, Homo sapiens
  Payload ID: 16045
  Gene Symbol: SLC16A5
  Gene Name: solute carrier family 16 (monocarboxylate transporter), member 5
  ENSP ID: ENSP00000463931
MPQALERADGSWAWVVLLATMVTQGLTLGFPTCIGIFFTELQWEFQASNSETSWFPSILTAVLHMAGPLCSILVGRFGCRVTVMLGGVLASLGMVASSFSHNLSQLYFTAGFITGLGMCFSFQSSITVLGFYFVRRRVLANALASMGVSLGITLWPLLSRYLLENLGWRGTFLVFGGIFLHCCICGAIIRPVATSVAPETKECPPPPPETPALGCLAACGRTIQRHLAFDILRHNT

SEQ ID NO: 80534 - protein, 478 aa, Homo sapiens
  Payload ID: 16046
  Gene Symbol: SLC16A7
  Gene Name: solute carrier family 16 (monocarboxylate transporter), member 7
  Uniprot ID: O60669
  ENSP ID: ENSP00000261187
MPPMPSAPPVHPPPDGGWGWIVVGAAFISIGFSYAFPKAVTVFFKEIQQIFHTTYSEIAWISSIMLAVMYAGGPVSSVLVNKYGSRPVVIAGGLLCCLGMVLASFSSSVVQLYLTMGFITGLGLAFNLQPALTIIGKYFYRKRPMANGLAMAGSPVFLSSLAPFNQYLFNTFGWKGSFLILGSLLLNACVAGSLMRPLGPNQTTSKSKNKTGKTEDDSSPKKIKTKKSTWEKVNKYLDFSLFKHRGFLIYLSGNVIMFLGFFAPIIFLAPYAKDQGIDEYSAAFLLSVMAFVDMFARPSVGLIANSKYIRPRIQYFFSFAIMFNGVCHLLCPLAQDYTSLVLYAVFFGLGFGSVSSVLFETLMDLVGAPRFSSAVGLVTIVECGPVLLGPPLAGKLVDLTGEYKYMYMSCGAIVVAASVWLLIGNAINYRLLAKERKEENARQKTRESEPLSKSKHSEDVNVKVSNAQSVTSERETNI

SEQ ID NO: 80535 - protein, 435 aa, Homo sapiens
  Payload ID: 16046
  Gene Symbol: SLC16A7
  Gene Name: solute carrier family 16 (monocarboxylate transporter), member 7
  ENSP ID: ENSP00000446722
MPPMPSAPPVHPPPDGGWGWIVVGAAFISIGFSYAFPKAVTVFFKEIQQIFHTTYSEIAWISSIMLAVMYAGGPVSSVLVNKYGSRPVVIAGGLLCCLGMVLASFSSSVVQLYLTMGFITGLGLAFNLQPALTIIGKYFYRKRPMANGLAMAGSPVFLSSLAPFNQYLFNTFGWKGSFLILGSLLLNACVAGSLMRPLGPNQTTSKSKNKTGKTEDDSSPKKIKTKKSTWEKVNKYLDFSLFKHRGFLIYLSGNVIMFLGFFAPIIFLAPYAKDQGIDEYSAAFLLSVMAFVDMFARPSVGLIANSKYIRPRIQYFFSFAIMFNGVCHLLCPLAQDYTSLVLYAVFFGLGFGSVSSVLFETLMDLVGAPRFSSAVGLVTIVECGPVLLGPPLAGKLVDLTGEYKYMYMSCGAIVVAASVWLLIGNAINYRLLAKE

SEQ ID NO: 80536 - protein, 141 aa, Homo sapiens
  Payload ID: 16046
  Gene Symbol: SLC16A7
  Gene Name: solute carrier family 16 (monocarboxylate transporter), member 7
  ENSP ID: ENSP00000447459
MPPMPSAPPVHPPPDGGWGWIVVGAAFISIGFSYAFPKAVTVFFKEIQQIFHTTYSEIAWISSIMLAVMYAGGRIFESFLIFTSLRIQCSFTQSGSCLAAVHNDSSDESGKRRWKIFWKGFAILDNITIIHCYGRRSKYQH

SEQ ID NO: 80537 - protein, 78 aa, Homo sapiens
  Payload ID: 16046
  Gene Symbol: SLC16A7
  Gene Name: solute carrier family 16 (monocarboxylate transporter), member 7
  ENSP ID: ENSP00000447555
MPPMPSAPPVHPPPDGGWGWIVVGAAFISIGFSYAFPKAVTVFFKEIQQIFHTTYSEIAWISSIMLAVMYAGGWYHMQ

SEQ ID NO: 80538 - protein, 131 aa, Homo sapiens
  Payload ID: 16046
  Gene Symbol: SLC16A7
  Gene Name: solute carrier family 16 (monocarboxylate transporter), member 7
  ENSP ID: ENSP00000447814
MGFITGLGLAFNLQPALTIIGKYFYRKRPMANGLAMAGSPVFLSSLAPFNQYLFNTFGWKGSFLILGSLLLNACVAGSLMRPLGPNQTTSKSKNKTGKTEDDSSPKKIKTKKSTWEKVNKYLDFSLFKHRG

SEQ ID NO: 80539 - protein, 478 aa, Homo sapiens; identical to SEQ ID NO: 80534
  Payload ID: 16046
  Gene Symbol: SLC16A7
  Gene Name: solute carrier family 16 (monocarboxylate transporter), member 7
  Uniprot ID: O60669
  ENSP ID: ENSP00000448071

SEQ ID NO: 80540 - protein, 478 aa, Homo sapiens; identical to SEQ ID NO: 80534
  Payload ID: 16046
  Gene Symbol: SLC16A7
  Gene Name: solute carrier family 16 (monocarboxylate transporter), member 7
  Uniprot ID: O60669
  ENSP ID: ENSP00000448742

SEQ ID NO: 80541 - protein, 84 aa, Homo sapiens
  Payload ID: 16046
  Gene Symbol: SLC16A7
  Gene Name: solute carrier family 16 (monocarboxylate transporter), member 7
  ENSP ID: ENSP00000448870
MPPMPSAPPVHPPPDGGWGWIVVGAAFISIGFSYAFPKAVTVFFKEIQQIFHTTYSEIAWISSIMLAVMYAGAGPKLPSHLQEE

SEQ ID NO: 80542 - protein, 84 aa, Homo sapiens
  Payload ID: 16046
  Gene Symbol: SLC16A7
  Gene Name: solute carrier family 16 (monocarboxylate transporter), member 7
  ENSP ID: ENSP00000449167
MPPMPSAPPVHPPPDGGWGWIVVGAAFISIGFSYAFPKAVTVFFKEIQQIFHTTYSEIAWISSIMLAVMYAGGKKEKRNASFTL

SEQ ID NO: 80543 - protein, 84 aa, Homo sapiens; identical to SEQ ID NO: 80542
  Payload ID: 16046
  Gene Symbol: SLC16A7
  Gene Name: solute carrier family 16 (monocarboxylate transporter), member 7
  ENSP ID: ENSP00000449229

SEQ ID NO: 80544 - protein, 478 aa, Homo sapiens; identical to SEQ ID NO: 80534
  Payload ID: 16046
  Gene Symbol: SLC16A7
  Gene Name: solute carrier family 16 (monocarboxylate transporter), member 7
  Uniprot ID: O60669
  ENSP ID: ENSP00000449547

SEQ ID NO: 80545 - protein, 83 aa, Homo sapiens
  Payload ID: 16046
  Gene Symbol: SLC16A7
  Gene Name: solute carrier family 16 (monocarboxylate transporter), member 7
  ENSP ID: ENSP00000449972
MPPMPSAPPVHPPPDGGWGWIVVGAAFISIGFSYAFPKAVTVFFKEIQQIFHTTYSEIAWISSIMLAVMYAGGPKLPSHLQEE

SEQ ID NO: 80546 - protein, 97 aa, Homo sapiens
  Payload ID: 16046
  Gene Symbol: SLC16A7
  Gene Name: solute carrier family 16 (monocarboxylate transporter), member 7
  ENSP ID: ENSP00000450133
MPPMPSAPPVHPPPDGGWGWIVVGAAFISIGFSYAFPKAVTVFFKEIQQIFHTTYSEIAWISSIMLAVMYAGGRMKHMDNRRASKAERSFTEQQNNS

SEQ ID NO: 80547 - protein, 504 aa, Homo sapiens
  Payload ID: 16047
  Gene Symbol: SLC16A8
  Gene Name: solute carrier family 16 (monocarboxylate transporter), member 8
  Uniprot ID: O95907
  ENSP ID: ENSP00000321735
MGAGGPRRGEGPPDGGWGWVVLGACFVVTGFAYGFPKAVSVFFRALMRDFDAGYSDTAWVSSIMLAMLYGTGPVSSILVTRFGCRPVMLAGGLLASAGMILASFATRLLELYLTAGVLTGLGLALNFQPSLIMLGLYFERRRPLANGLAAAGSPVFLSALSPLGQQLLERFGWRGGFLLLGGLLLHCCACGAVMRPPPGPGPRPRRDSAGDRAGDAPGEAEADGAGLQLREASPRVRPRRRLLDLAVCTDRAFAVYAVTKFLMALGLFVPAILLVNYAKDAGVPDTDAAFLLSIVGFVDIVARPACGALAGLARLRPHVPYLFSLALLANGLTDLSSARARSYGALVAFCVAFGLSYGMVGALQFEVLMAAVGAPRFPSALGLVLLVEAAAVLIGPPSAGRLVDVLKNYEIIFYLAGSEVALAGVFMAVATNCCLRCAKAAPSGPGTEGGASDTEDAEAEGDSEPLPVVAEEPGNLEALEVLSARGEPTEPEIEARPRLAAESV

SEQ ID NO: 80548 - protein, 97 aa, Homo sapiens
  Payload ID: 16047
  Gene Symbol: SLC16A8
  Gene Name: solute carrier family 16 (monocarboxylate transporter), member 8
  ENSP ID: ENSP00000409547
MGAGGPRRGEGPPDGGWGWVVLGACFVVTGFAYGFPKAVSVFFRALMRDFDAGYSDTAWVSSIMLAMLYGTGPVSSILVTRFGCRPVMLAGGLLASA

SEQ ID NO: 80549 - protein, 471 aa, Homo sapiens
  Payload ID: 16048
  Gene Symbol: SLC16A11
  Gene Name: solute carrier family 16, member 11
  Uniprot ID: Q8NCK7
  ENSP ID: ENSP00000310490
MPAPQRKHRRGGFSHRCFPTPQTAMTPQPAGPPDGGWGWVVAAAAFAINGLSYGLLRSLGLAFPDLAEHFDRSAQDTAWISALALAVQQAASPVGSALSTRWGARPVVMVGGVLASLGFVFSAFASDLLHLYLGLGLLAGFGWALVFAPALGTLSRYFSRRRVLAVGLALTGNGASSLLLAPALQLLLDTFGWRGALLLLGAITLHLTPCGALLLPLVLPGDPPAPPRSPLAALGLSLFTRRAFSIFALGTALVGGGYFVPYVHLAPHALDRGLGGYGAALVVAVAAMGDAGARLVCGWLADQGWVPLPRLLAVFGALTGLGLWVVGLVPVVGGEESWGGPLLAAAVAYGLSAGSYAPLVFGVLPGLVGVGGVVQATGLVMMLMSLGGLLGPPLSGFLRDETGDFTASFLLSGSLILSGSFIYIGLPRALPSCGPASPPATPPPETGELLPAPQAVLLSPGGPGSTLDTTC

SEQ ID NO: 80550 - protein, 439 aa, Homo sapiens
  Payload ID: 16048
  Gene Symbol: SLC16A11
  Gene Name: solute carrier family 16, member 11
  ENSP ID: ENSP00000394449
MTPQPAGPPDGGWGWVVAAAAFAINGLSYGLLRSLGLAFPDLAEHFDRSAQDTAWISALALAVQQAASPVGSALSTRWGARPVVMVGGVLASLGFVFSAFASDLLHLYLGLGLLAGFGWALVFAPALGTLSRYFSRRRVLAVGLALTGNGASSLLLAPALQLLLDTFGWRGALLLLGAITLHLTPCGALLLPLVLPGDPPAPPRSPLAALGLSLFTRRAFSIFALGTALVGGGYFVPYVHLAPHALDRGLGGYGAALVVAVAAMGDAGARLVCGWLADQGWVPLPRLLAVFGALTGLGLWVVGLSWGGPLLAAAVAYGLSAGSYAPLVFGVLPGLVGVGGVVQATGLVMMLMSLGGLLGPPLSGFLRDETGDFTASFLLSGSLILSGSFIYIGLPRALPSCGPASPPATPPPETGELLPAPQAVLLSPGGPGSTLDTTC

SEQ ID NO: 80551 - protein, 93 aa, Homo sapiens
  Payload ID: 16048
  Gene Symbol: SLC16A11
  Gene Name: solute carrier family 16, member 11
  ENSP ID: ENSP00000460927
MTPQPAGPPDGGWGWVVAAAAFAINGLSYGLLRSLGLAFPDLAEHFDRSAQDTAWISALALAVQQAASPVGSALSTRWGARPVVMVGGVLASL

SEQ ID NO: 80552 - protein, 516 aa, Homo sapiens
  Payload ID: 16049
  Gene Symbol: SLC16A12
  Gene Name: solute carrier family 16, member 12
  ENSP ID: ENSP00000360855
MPSGSHWTANSSKIITWLLEQPGKEEKRKTMAKVNRARSTSPPDGGWGWMIVAGCFLVTICTRAVTRCISIFFVEFQTYFTQDYAQTAWIHSIVDCVTMLCAPLGSVVSNHLSCQVGIMLGGLLASTGLILSSFATSLKHLYLTLGVLTGLGFALCYSPAIAMVGKYFSRRKALAYGIAMSGSGIGTFILAPVVQLLIEQFSWRGALLILGGFVLNLCVCGALMRPITLKEDHTTPEQNHVCRTQKEDIKRVSPYSSLTKEWAQTCLCCCLQQEYSFLLMSDFVVLAVSVLFMAYGCSPLFVYLVPYALSVGVSHQQAAFLMSILGVIDIIGNITFGWLTDRRCLKNYQYVCYLFAVGMDGLCYLCLPMLQSLPLLVPFSCTFGYFDGAYVTLIPVVTTEIVGTTSLSSALGVVYFLHAVPYLVSPPIAGRLVDTTGSYTAAFLLCGFSMIFSSVLLGFARLIKRMRKTQLQFIAKESDPKLQLWTNGSVAYSVARELDQKHGEPVATAVPGYSLT

SEQ ID NO: 80553 - protein, 25 aa, Homo sapiens
  Payload ID: 16049
  Gene Symbol: SLC16A12
  Gene Name: solute carrier family 16, member 12
  ENSP ID: ENSP00000436965
MPSGSHWTANSSKIITWLLEQPGKE

SEQ ID NO: 80554 - protein, 426 aa, Homo sapiens
  Payload ID: 16050
  Gene Symbol: SLC16A13
  Gene Name: solute carrier family 16, member 13
  Uniprot ID: Q7RTY0
  ENSP ID: ENSP00000309751
MARRTEPPDGGWGWVVVLSAFFQSALVFGVLRSFGVFFVEFVAAFEEQAARVSWIASIGIAVQQFGSPVGSALSTKFGPRPVVMTGGILAALGMLLASFATSLTHLYLSIGLLSGSGWALTFAPTLACLSCYFSRRRSLATGLALTGVGLSSFTFAPFFQWLLSHYAWRGSLLLVSALSLHLVACGALLRPPSLAEDPAVGGPRAQLTSLLHHGPFLRYTVALTLINTGYFIPYLHLVAHLQDLDWDPLPAAFLLSVVAISDLVGRVVSGWLGDAVPGPVTRLLMLWTTLTGVSLALFPVAQAPTALVALAVAYGFTSGALAPLAFSVLPELIGTRRIYCGLGLLQMIESIGGLLGPPLSGYLRDVTGNYTASFVVAGAFLLSGSGILLTLPHFFCFSTTTSGPQDLVTEALDTKVPLPKEGLEED

SEQ ID NO: 80555 - protein, 510 aa, Homo sapiens
  Payload ID: 16051
  Gene Symbol: SLC16A14
  Gene Name: solute carrier family 16, member 14
  Uniprot ID: Q7RTX9
  ENSP ID: ENSP00000295190
MYTSHEDIGYDFEDGPKDKKTLKPHPNIDGGWAWMMVLSSFFVHILIMGSQMALGVLNVEWLEEFHQSRGLTAWVSSLSMGITLIVGPFIGLFINTCGCRQTAIIGGLVNSLGWVLSAYAANVHYLFITFGVAAGLGSGMAYLPAVVMVGRYFQKRRALAQGLSTTGTGFGTFLMTVLLKYLCAEYGWRNAMLIQGAVSLNLCVCGALMRPLSPGKNPNDPGEKDVRGLPAHSTESVKSTGQQGRTEEKDGGLGNEETLCDLQAQECPDQAGHRKNMCALRILKTVSWLTMRVRKGFEDWYSGYFGTASLFTNRMFVAFIFWALFAYSSFVIPFIHLPEIVNLYNLSEQNDVFPLTSIIAIVHIFGKVILGVIADLPCISVWNVFLLANFTLVLSIFILPLMHTYAGLAVICALIGFSSGYFSLMPVVTEDLVGIEHLANAYGIIICANGISALLGPPFAGWIYDITQKYDFSFYICGLLYMIGILFLLIQPCIRIIEQSRRKYMDGAHV

SEQ ID NO: 80556 - protein, 42 aa, Homo sapiens
  Payload ID: 16051
  Gene Symbol: SLC16A14
  Gene Name: solute carrier family 16, member 14
  ENSP ID: ENSP00000389726
MYTSHEDIGYDFEDGPKDKKTLKPHPNIDGGWAWMMVLSSFF

SEQ ID NO: 80557 - protein, 485 aa, Homo sapiens
  Payload ID: 16051
  Gene Symbol: SLC16A14
  Gene Name: solute carrier family 16, member 14
  ENSP ID: ENSP00000395775
MYTSHEDIGYDFEDGPKDKKTLKPHPNIDGGWAWMMVLSSFFVHILIMGSQMALGVLNVEWLEEFHQSRGLTAWVSSLSMGITLIVGPFIGLFINTCGCRQTAIIGGLVNSLGWVLSAYAANVHYLFITFGVAAGLGSGMAYLPAVVMVGRYFQKRRALAQGLSTTGTGFGTFLMTVLLKYLCAEYGWRNAMLIQGAVSLNLCVCGALMRPLSPGKNPNDPGEKDVRGLPAHSTESVKSTGQQGRTEEKDGGLGNEETLCDLQAQECPDQAGHRKNMCALRILKTVSWLTMRVRKGFEDWYSGYFGTASLFTNRMFVAFIFWALFAYSSFVIPFIHLPEIVNLYNLSEQNDVFPLTSIIAIVHIFGKVILGVIADLPCISVWNVFLLANFTLVLSIFILPLMHTYAGLAVICALIGFSSGYFSLMPVVTEDLVGIEHLANAYGIIICANGISALLGPPFAGKLSEVLRAQSACTYGALCYKVPDK

SEQ ID NO: 80558 - protein, 18 aa, Homo sapiens
  Payload ID: 16051
  Gene Symbol: SLC16A14
  Gene Name: solute carrier family 16, member 14
  ENSP ID: ENSP00000396834
MYTSHEDIGYDFEDGPKD

SEQ ID NO: 80559 - protein, 489 aa, Homo sapiens
  Payload ID: 16051
  Gene Symbol: SLC16A14
  Gene Name: solute carrier family 16, member 14
  ENSP ID: ENSP00000400352
MYTSHEDIGYDFEDGPKDKKTLKPHPNIDGGWAWMMVLSSFFVHILIMGSQMALGVLNVEWLEEFHQSRGLTAWVSSLSMGITLIVGPFIGLFINTCGCRQTAIIGGLVNSLGWVLSAYAANVHYLFITFGVAAGLGSGMAYLPAVVMVGRYFQKRRALAQGLSTTGTGFGTFLMTVLLKYLCAEYGWRNAMLIQGAVSLNLCVCGALMRPLSPGKNPNDPGEKDVRGLPAHSTESVKSTGQQGRTEEKDGGLGNEETLCDLQAQECPDQAGHRKNMCALRILKTVSWLTMRVRKGFEDWYSGYFGTASLFTNRMFVAFIFWALFAYSSFVIPFIHLPEIVNLYNLSEQNDVFPLTSIIAIVHIFGKVILGVIADLPCISVWNVFLLANFTLVLSIFILPLMHTYAGLAVICALIGFSSGYFSLMPVVTEDLVGIEHLANAYGIIICANGISALLGPPFAGKLSEVLRAQSACTYGALCYKVPDKEEGF

SEQ ID NO: 80560 - protein, 539 aa, Homo sapiens
  Payload ID: 16052
  Gene Symbol: SLC16A2
  Gene Name: solute carrier family 16, member 2 (thyroid hormone transporter)
  Uniprot ID: P36021
  ENSP ID: ENSP00000465734
MALQSQASEEAKGPWQEADQEQQEPVGSPEPESEPEPEPEPEPVPVPPPEPQPEPQPLPDPAPLPELEFESERVHEPEPTPTVETRGTARGFQPPEGGFGWVVVFAATWCNGSIFGIHNSVGILYSMLLEEEKEKNRQVEFQAAWVGALAMGMIFFCSPIVSIFTDRLGCRITATAGAAVAFIGLHTSSFTSSLSLRYFTYGILFGCGCSFAFQPSLVILGHYFQRRLGLANGVVSAGSSIFSMSFPFLIRMLGDKIKLAQTFQVLSTFMFVLMLLSLTYRPLLPSSQDTPSKRGVRTLHQRFLAQLRKYFNMRVFRQRTYRIWAFGIAAAALGYFVPYVHLMKYVEEEFSEIKETWVLLVCIGATSGLGRLVSGHISDSIPGLKKIYLQVLSFLLLGLMSMMIPLCRDFGGLIVVCLFLGLCDGFFITIMAPIAFELVGPMQASQAIGYLLGMMALPMIAGPPIAGLLRNCFGDYHVAFYFAGVPPIIGAVILFFVPLMHQRMFKKEQRDSSKDKMLAPDPDPNGELLPGSPNPEEPI

SEQ ID NO: 80561 - protein, 229 aa, Homo sapiens
  Payload ID: 16052
  Gene Symbol: SLC16A2
  Gene Name: solute carrier family 16, member 2 (thyroid hormone transporter)
  ENSP ID: ENSP00000466213
  MOD_RES (1)..(1): Any amino acid
XSSFTSSLSLRYFTYGILFGCGCSFAFQPSLVILGHYFQRRLGLANGVVSAGSSIFSMSFPFLIRMLGDKIKLAQTFQVLSTFMFVLMLLSLTYRPLLPSSQDTPSKRGVRTLHQRFLAQLRKYFNMRVFRQRTYRIWAFGIAAAALGYFVPYVHLMKYVEEEFSEIKETWVLLVCIGATSGLGRLVSGHISDSIPGLKKIYLQAYSATVLGTTMWPSTLPVCPPSSGL

SEQ ID NO: 80562 - protein, 487 aa, Homo sapiens
  Payload ID: 16053
  Gene Symbol: SLC16A4
  Gene Name: solute carrier family 16, member 4
  Uniprot ID: O15374
  ENSP ID: ENSP00000358794
MLKREGKVQPYTKTLDGGWGWMIVIHFFLVNVFVMGMTKTFAIFFVVFQEEFEGTSEQIGWIGSIMSSLRFCAGPLVAIICDILGEKTTSILGAFVVTGGYLISSWATSIPFLCVTMGLLPGLGSAFLYQVAAVVTTKYFKKRLALSTAIARSGMGLTFLLAPFTKFLIDLYDWTGALILFGAIALNLVPSSMLLRPIHIKSENNSGIKDKGSSLSAHGPEAHATETHCHETEESTIKDSTTQKAGLPSKNLTVSQNQSEEFYNGPNRNRLLLKSDEESDKVISWSCKQLFDISLFRNPFFYIFTWSFLLSQLAYFIPTFHLVARAKTLGIDIMDASYLVSVAGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAGWLYDYTQTYNGSFYFSGICYLLSSVSFFFVPLAERWKNSLT

SEQ ID NO: 80563 - protein, 319 aa, Homo sapiens
  Payload ID: 16053
  Gene Symbol: SLC16A4
  Gene Name: solute carrier family 16, member 4
  Uniprot ID: O15374
  ENSP ID: ENSP00000358796
MLKREGKVQPYTKTLDGGWGWMIVIHFFLVNVFVMGMTKTFAIFFVVFQEEFEGTSEQIGWIGSIMSSLRFCAGPLVAIICDILGEKTTSILGAFVVTGGYLISSWATSIPFLCVTMGLLPGLGSAFLYQVAAVVTTKYFKKRLALSTAIARSGMGLTFLLAPFTKFLIDLYDWTGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAGWLYDYTQTYNGSFYFSGICYLLSSVSFFFVPLAERWKNSLT

SEQ ID NO: 80564 - protein, 382 aa, Homo sapiens
  Payload ID: 16053
  Gene Symbol: SLC16A4
  Gene Name: solute carrier family 16, member 4
  Uniprot ID: O15374
  ENSP ID: ENSP00000394790
MGMDDCDSFFPGLGSAFLYQVAAVVTTKYFKKRLALSTAIARSGMGLTFLLAPFTKFLIDLYDWTGALILFGAIALNLVPSSMLLRPIHIKSENNSGIKDKGSSLSAHGPEAHATETHCHETEESTIKDSTTQKAGLPSKNLTVSQNQSEEFYNGPNRNRLLLKSDEESDKVISWSCKQLFDISLFRNPFFYIFTWSFLLSQLAYFIPTFHLVARAKTLGIDIMDASYLVSVAGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAEIIPSFQAGYMIIPRHTMALSTSLAYAISSLQFPFFLYHWPKDGKTV

SEQ ID NO: 80565 - protein, 57 aa, Homo sapiens
  Payload ID: 16053
  Gene Symbol: SLC16A4
  Gene Name: solute carrier family 16, member 4
  ENSP ID: ENSP00000432190
MLKREGKVQPYTKTLDGGWGWMIVIHFFLVPWLLLFVTYLERKLPPFLGLSLLLVDI

SEQ ID NO: 80566 - protein, 439 aa, Homo sapiens
  Payload ID: 16053
  Gene Symbol: SLC16A4
  Gene Name: solute carrier family 16, member 4
  Uniprot ID: O15374
  ENSP ID: ENSP00000432495
MLKREGKVQPYTKTLDGGWGWMIVIHFFLVNVFVMGMTKTFAIFFVVFQEEFEGTSEQIGWIGSIMSSLRFCAGLGSAFLYQVAAVVTTKYFKKRLALSTAIARSGMGLTFLLAPFTKFLIDLYDWTGALILFGAIALNLVPSSMLLRPIHIKSENNSGIKDKGSSLSAHGPEAHATETHCHETEESTIKDSTTQKAGLPSKNLTVSQNQSEEFYNGPNRNRLLLKSDEESDKVISWSCKQLFDISLFRNPFFYIFTWSFLLSQLAYFIPTFHLVARAKTLGIDIMDASYLVSVAGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAGWLYDYTQTYNGSFYFSGICYLLSSVSFFFVPLAERWKNSLT

SEQ ID NO: 80567 - protein, 57 aa, Homo sapiens; identical to SEQ ID NO: 80565
  Payload ID: 16053
  Gene Symbol: SLC16A4
  Gene Name: solute carrier family 16, member 4
  ENSP ID: ENSP00000433463

SEQ ID NO: 80568 - protein, 42 aa, Homo sapiens
  Payload ID: 16053
  Gene Symbol: SLC16A4
  Gene Name: solute carrier family 16, member 4
  ENSP ID: ENSP00000434136
MLKREGKVQPYTKTLDGGWGWMIVIHFFLVWVLLSYTKWLLW

SEQ ID NO: 80569 - protein, 219 aa, Homo sapiens
  Payload ID: 16053
  Gene Symbol: SLC16A4
  Gene Name: solute carrier family 16, member 4
  ENSP ID: ENSP00000435768
ESTIKDSTTQKAGLPSKNLTVSQNQSEEFYNGPNRNRLLLKSDEESDKVISWSCKQLFDISLFRNPFFYIFTWSFLLSQLAYFIPTFHLVARAKTLGIDIMDASYLVSVAGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAGNTFTTF

SEQ ID NO: 80570 - protein, 425 aa, Homo sapiens
  Payload ID: 16053
  Gene Symbol: SLC16A4
  Gene Name: solute carrier family 16, member 4
  Uniprot ID: O15374
  ENSP ID: ENSP00000446087
MGMDDCDSFFPGPLVAIICDILGEKTTSILGAFVVTGGYLISSWATSIPFLCVTMGLLPGLGSAFLYQVAAVVTTKYFKKRLALSTAIARSGMGLTFLLAPFTKFLIDLYDWTGALILFGAIALNLVPSSMLLRPIHIKSENNSGIKDKGSSLSAHGPEAHATETHCHETEESTIKDSTTQKAGLPSKNLTVSQNQSEEFYNGPNRNRLLLKSDEESDKVISWSCKQLFDISLFRNPFFYIFTWSFLLSQLAYFIPTFHLVARAKTLGIDIMDASYLVSVAGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAGWLYDYTQTYNGSFYFSGICYLLSSVSFFFVPLAERWKNSLT

SEQ ID NO: 80571 - protein, 523 aa, Homo sapiens
  Payload ID: 16054
  Gene Symbol: SLC16A6
  Gene Name: solute carrier family 16, member 6
  Uniprot ID: O15403
  ENSP ID: ENSP00000319991
MTQNKLKLCSKANVYTEVPDGGWGWAVAVSFFFVEVFTYGIIKTFGVFFNDLMDSFNESNSRISWIISICVFVLTFSAPLATVLSNRFGHRLVVMLGGLLVSTGMVAASFSQEVSHMYVAIGIISGLGYCFSFLPTVTILSQYFGKRRSIVTAVASTGECFAVFAFAPAIMALKERIGWRYSLLFVGLLQLNIVIFGALLRPIFIRGPASPKIVIQENRKEAQYMLENEKTRTSIDSIDSGVELTTSPKNVPTHTNLELEPKADMQQVLVKTSPRPSEKKAPLLDFSILKEKSFICYALFGLFATLGFFAPSLYIIPLGISLGIDQDRAAFLLSTMAIAEVFGRIGAGFVLNREPIRKIYIELICVILLTVSLFAFTFATEFWGLMSCSIFFGFMVGTIGGTHIPLLAEDDVVGIEKMSSAAGVYIFIQSIAGLAGPPLAGLLVDQSKIYSRAFYSCAAGMALAAVCLALVRPCKMGLCQHHHSGETKVVSHRGKTLQDIPEDFLEMDLAKNEHRVHVQMEPV

SEQ ID NO: 80572 - protein, 85 aa, Homo sapiens
  Payload ID: 16054
  Gene Symbol: SLC16A6
  Gene Name: solute carrier family 16, member 6
  ENSP ID: ENSP00000462239
MTQNKLKLCSKANVYTEVPDGGWGWAVAVSFFFVEVFTYGIIKTFGVFFNDLMDSFNESNSRISWIISICVFVLTFSAPLATVLS

SEQ ID NO: 80573 - protein, 523 aa, Homo sapiens; identical to SEQ ID NO: 80571
  Payload ID: 16054
  Gene Symbol: SLC16A6
  Gene Name: solute carrier family 16, member 6
  Uniprot ID: O15403
  ENSP ID: ENSP00000462985

SEQ ID NO: 80574 - protein, 129 aa, Homo sapiens
  Payload ID: 16054
  Gene Symbol: SLC16A6
  Gene Name: solute carrier family 16, member 6
  ENSP ID: ENSP00000463070
MTQNKLKLCSKANVYTEVPDGGWGWAVAVSFFFVEVFTYGIIKTFGVFFNDLMDSFNESNSRISWIISICVFVLTFSGLGYCFSFLPTVTILSQYFGKRRSIVTAVASTGECFAVFAFAPAIMALKERI

SEQ ID NO: 80575 - protein, 522 aa, Homo sapiens [sequence omitted]

SEQ ID NO: 80576 - protein, 509 aa, Homo sapiens
  Payload ID: 16055
  Gene Symbol: SLC16A9
  Gene Name: solute carrier family 16, member 9
  Uniprot ID: Q7RTY1
  ENSP ID: ENSP00000378756
MELKKSPDGGWGWVIVFVSFLTQFLCYGSPLAVGVLYIEWLDAFGEGKGKTAWVGSLASGVGLLASPVCSLCVSSFGARPVTIFSGFMVAGGLMLSSFAPNIYFLFFSYGIVVGLGCGLLYTATVTITCQYFDDRRGLALGLISTGSSVGLFIYAALQRMLVEFYGLDGCLLIVGALALNILACGSLMRPLQSSDCPLPKKIAPEDLPDKYSIYNEKGKNLEENINILDKSYSSEEKCRITLANGDWKQDSLLHKNPTVTHTKEPETYKKKVAEQTYFCKQLAKRKWQLYKNYCGETVALFKNKVFSALFIAILLFDIGGFPPSLLMEDVARSSNVKEEEFIMPLISIIGIMTAVGKLLLGILADFKWINTLYLYVATLIIMGLALCAIPFAKSYVTLALLSGILGFLTGNWSIFPYVTTKTVGIEKLAHAYGILMFFAGLGNSLGPPIVGWFYDWTQTYDIAFYFSGFCVLLGGFILLLAALPSWDTCNKQLPKPAPTTFLYKVASNV

SEQ ID NO: 80577 - protein, 509 aa, Homo sapiens; identical to SEQ ID NO: 80576
  Payload ID: 16055
  Gene Symbol: SLC16A9
  Gene Name: solute carrier family 16, member 9
  Uniprot ID: Q7RTY1
  ENSP ID: ENSP00000378757

SEQ ID NO: 80578 - protein, 495 aa, Homo sapiens
  Payload ID: 16056
  Gene Symbol: SLC17A5
  Gene Name: solute carrier family 17 (acidic sugar transporter), member 5
  Uniprot ID: Q9NRA2
  ENSP ID: ENSP00000348019
MRSPVRDLARNDGEESTDRTPLLPGAPRAEAAPVCCSARYNLAILAFFGFFIVYALRVNLSVALVDMVDSNTTLEDNRTSKACPEHSAPIKVHHNQTGKKYQWDAETQGWILGSFFYGYIITQIPGGYVASKIGGKMLLGFGILGTAVLTLFTPIAADLGVGPLIVLRALEGLGEGVTFPAMHAMWSSWAPPLERSKLLSISYAGAQLGTVISLPLSGIICYYMNWTYVFYFFGTIGIFWFLLWIWLVSDTPQKHKRISHYEKEYILSSLRNQLSSQKSVPWVPILKSLPLWAIVVAHFSYNWTFYTLLTLLPTYMKEILRFNVQENGFLSSLPYLGSWLCMILSGQAADNLRAKWNFSTLCVRRIFSLIGMIGPAVFLVAAGFIGCDYSLAVAFLTISTTLGGFCSSGFSINHLDIAPSYAGILLGITNTFATIPGMVGPVIAKSLTPDNTVGEWQTVFYIAAAINVFGAIFFTLFAKGEVQNWALNDHHGHRH

SEQ ID NO: 80579 - protein, 467 aa, Homo sapiens
  Payload ID: 16057
  Gene Symbol: SLC17A1
  Gene Name: solute carrier family 17 (organic anion transporter), member 1
  Uniprot ID: Q14916
  ENSP ID: ENSP00000244527
MQMDNRLPPKKVPGFCSFRYGLSFLVHCCNVIITAQRACLNLTMVVMVNSTDPHGLPNTSTKKLLDNIKNPMYNWSPDIQGIILSSTSYGVIIIQVPVGYFSGIYSTKKMIGFALCLSSVLSLLIPPAAGIGVAWVVVCRAVQGAAQGIVATAQFEIYVKWAPPLERGRLTSMSTSGFLLGPFIVLLVTGVICESLGWPMVFYIFGACGCAVCLLWFVLFYDDPKDHPCISISEKEYITSSLVQQVSSSRQSLPIKAILKSLPVWAISTGSFTFFWSHNIMTLYTPMFINSMLHVNIKENGFLSSLPYLFAWICGNLAGQLSDFFLTRNILSVIAVRKLFTAAGFLLPAIFGVCLPYLSSTFYSIVIFLILAGATGSFCLGGVFINGLDIAPRYFGFIKACSTLTGMIGGLIASTLTGLILKQDPESAWFKTFILMAAINVTGLIFYLIVATAEIQDWAKEKQHTRL

SEQ ID NO: 80580 - protein, 209 aa, Homo sapiens
  Payload ID: 16057
  Gene Symbol: SLC17A1
  Gene Name: solute carrier family 17 (organic anion transporter), member 1
  ENSP ID: ENSP00000367118
MQMDNRLPPKKVPGFCSFRYGLSFLVHCCNVIITAQRACLNLTMVVMVNSTDPHGLPNTSTKKLLDNIKNPMYNWSPDIQGIILSSTSYGVIIIQVPVGYFSGIYSTKKMIGFALCLSSVLSLLIPPAAGIGVAWVVVCRAVQGAAQGIVATAQFEIYVKWAPPLERGRLTSMSTSGFLLGPFIVLLVTGVICESLGWPMVFYIFGQFK

SEQ ID NO: 80581 - protein, 413 aa, Homo sapiens
  Payload ID: 16057
  Gene Symbol: SLC17A1
  Gene Name: solute carrier family 17 (organic anion transporter), member 1
  Uniprot ID: Q14916
  ENSP ID: ENSP00000420546
MQMDNRLPPKKVPGFCSFRYGLSFLVHCCNVIITAQRACLNLTMVVMVNSTDPHGLPNTSTKKLLDNIKNPMYNWSPDIQGIILSSTSYGVIIIQVPVGYFSGIYSTKKMIGFALCLSSVLSLLIPPAAGIGVAWVVVCRAVQGAAQGIVATAQFEIYVKWAPPLERGRLTSMSTSGFLLGPFIVLLVTGVICESLGWPMVFYIFGACGCAVCLLWFVLFYDDPKDHPCISISEKEYITSSLVQQNGFLSSLPYLFAWICGNLAGQLSDFFLTRNILSVIAVRKLFTAAGFLLPAIFGVCLPYLSSTFYSIVIFLILAGATGSFCLGGVFINGLDIAPRYFGFIKACSTLTGMIGGLIASTLTGLILKQDPESAWFKTFILMAAINVTGLIFYLIVATAEIQDWAKEKQHTRL

SEQ ID NO: 80582 - protein, 467 aa, Homo sapiens; identical to SEQ ID NO: 80579
  Payload ID: 16057
  Gene Symbol: SLC17A1
  Gene Name: solute carrier family 17 (organic anion transporter), member 1
  Uniprot ID: Q14916
  ENSP ID: ENSP00000420614

SEQ ID NO: 80583 - protein, 420 aa, Homo sapiens
  Payload ID: 16058
  Gene Symbol: SLC17A3
  Gene Name: solute carrier family 17 (organic anion transporter), member 3
  Uniprot ID: O00476
  ENSP ID: ENSP00000353873
MATKTELSPTARESKNAQDMQVDETLIPRKVPSLCSARYGIALVLHFCNFTTIAQNVIMNITMVAMVNSTSPQSQLNDSSEVLPVDSFGGLSKAPKSLPAKSSILGGQFAIWEKWGPPQERSRLCSIALSGMLLGCFTAILIGGFISETLGWPFVFYIFGGVGCVCCLLWFVVIYDDPVSYPWISTSEKEYIISSLKQQVGSSKQPLPIKAMLRSLPIWSICLGCFSHQWLVSTMVVYIPTYISSVYHVNIRDNGLLSALPFIVAWVIGMVGGYLADFLLTKKFRLITVRKIATILGSLPSSALIVSLPYLNSGYITATALLTLSCGLSTLCQSGIYINVLDIAPRYSSFLMGASRGFSSIAPVIVPTVSGFLLSQDPEFGWRNVFFLLFAVNLLGLLFYLIFGEADVQEWAKERKLTRL

SEQ ID NO: 80584 - protein, 420 aa, Homo sapiens; identical to SEQ ID NO: 80583
  Payload ID: 16058
  Gene Symbol: SLC17A3
  Gene Name: solute carrier family 17 (organic anion transporter), member 3
  Uniprot ID: O00476
  ENSP ID: ENSP00000355307

SEQ ID NO: 80585 - protein, 498 aa, Homo sapiens
  Payload ID: 16058
  Gene Symbol: SLC17A3
  Gene Name: solute carrier family 17 (organic anion transporter), member 3
  Uniprot ID: O00476
  ENSP ID: ENSP00000380250
MATKTELSPTARESKNAQDMQVDETLIPRKVPSLCSARYGIALVLHFCNFTTIAQNVIMNITMVAMVNSTSPQSQLNDSSEVLPVDSFGGLSKAPKSLPAKAPVYDWSPQIQGIIFGAVGYGGILTMAPSGYLAGRVGTKRVVGISLFATSFLTLCIPLATDFGIVLLIVTRIVQGLSQSSILGGQFAIWEKWGPPQERSRLCSIALSGMLLGCFTAILIGGFISETLGWPFVFYIFGGVGCVCCLLWFVVIYDDPVSYPWISTSEKEYIISSLKQQVGSSKQPLPIKAMLRSLPIWSICLGCFSHQWLVSTMVVYIPTYISSVYHVNIRDNGLLSALPFIVAWVIGMVGGYLADFLLTKKFRLITVRKIATILGSLPSSALIVSLPYLNSGYITATALLTLSCGLSTLCQSGIYINVLDIAPRYSSFLMGASRGFSSIAPVIVPTVSGFLLSQDPEFGWRNVFFLLFAVNLLGLLFYLIFGEADVQEWAKERKLTRL

SEQ ID NO: 80586 - protein, 112 aa, Homo sapiens
  Payload ID: 16058
  Gene Symbol: SLC17A3
  Gene Name: solute carrier family 17 (organic anion transporter), member 3
  ENSP ID: ENSP00000415622
MATKTELSPTARESKNAQDMQVDETLIPRKVPSLCSARYGIALVLHFCNFTTIAQNVIMNITMVAMVNSTSPQSQLNDSSEVLPVDSFGGLSKAPKSLPAKECYWDALLPSS

SEQ ID NO: 80587 - protein, 99 aa, Homo sapiens
  Payload ID: 16058
  Gene Symbol: SLC17A3
  Gene Name: solute carrier family 17 (organic anion transporter), member 3
  ENSP ID: ENSP00000421855
  MOD_RES (1)..(1): Any amino acid
XTLSCGLSTLCQSGIYINVLDIAPRYSSFLMGASRGFSSIAPVIVPTVSGFLLSQDPEFGWRNVFFLLFAVNLLGLLFYLIFGEADVQEWAKERKLTRL

SEQ ID NO: 80588 - protein, 51 aa, Homo sapiens
  Payload ID: 16058
  Gene Symbol: SLC17A3
  Gene Name: solute carrier family 17 (organic anion transporter), member 3
  ENSP ID: ENSP00000424027
SGFLLSQDPEFGWRNVFFLLFAVNLLGLLFYLIFGEADVQEWAKERKLTRL

SEQ ID NO: 80589 - protein, 112 aa, Homo sapiens; identical to SEQ ID NO: 80586
  Payload ID: 16058
  Gene Symbol: SLC17A3
  Gene Name: solute carrier family 17 (organic anion transporter), member 3
  ENSP ID: ENSP00000424729

SEQ ID NO: 80590 - protein, 582 aa, Homo sapiens
  Payload ID: 16059
  Gene Symbol: SLC17A6
  Gene Name: solute carrier family 17 (vesicular glutamate transporter), member 6
  Uniprot ID: Q9P2U8
  ENSP ID: ENSP00000263160
MESVKQRILAPGKEGLKNFAGKSLGQIYRVLEKKQDTGETIELTEDGKPLEVPERKAPLCDCTCFGLPRRYIIAIMSGLGFCISFGIRCNLGVAIVDMVNNSTIHRGGKVIKEKAKFNWDPETVGMIHGSFFWGYIITQIPGGYIASRLAANRVFGAAILLTSTLNMLIPSAARVHYGCVIFVRILQGLVEGVTYPACHGIWSKWAPPLERSRLATTSFCGSYAGAVIAMPLAGILVQYTGWSSVFYVYGSFGMVWYMFWLLVSYESPAKHPTITDEERRYIEESIGESANLLGAMEKFKTPWRKFFTSMPVYAIIVANFCRSWTFYLLLISQPAYFEEVFGFEISKVGMLSAVPHLVMTIIVPIGGQIADFLRSKQILSTTTVRKIMNCGGFGMEATLLLVVGYSHTRGVAISFLVLAVGFSGFAISGFNVNHLDIAPRYASILMGISNGVGTLSGMVCPIIVGAMTKNKSREEWQYVFLIAALVHYGGVIFYAIFASGEKQPWADPEETSEEKCGFIHEDELDEETGDITQNYINYGTTKSYGATTQANGGWPSGWEKKEEFVQGEVQDSHSYKDRVDYS

SEQ ID NO: 80591 - protein, 560 aa, Homo sapiens
  Payload ID: 16060
  Gene Symbol: SLC17A7
  Gene Name: solute carrier family 17 (vesicular glutamate transporter), member 7
  Uniprot ID: Q9P2U7
  ENSP ID: ENSP00000221485
MEFRQEEFRKLAGRALGKLHRLLEKRQEGAETLELSADGRPVTTQTRDPPVVDCTCFGLPRRYIIAIMSGLGFCISFGIRCNLGVAIVSMVNNSTTHRGGHVVVQKAQFSWDPETVGLIHGSFFWGYIVTQIPGGFICQKFAANRVFGFAIVATSTLNMLIPSAARVHYGCVIFVRILQGLVEGVTYPACHGIWSKWAPPLERSRLATTAFCGSYAGAVVAMPLAGVLVQYSGWSSVFYVYGSFGIFWYLFWLLVSYESPALHPSISEEERKYIEDAIGESAKLMNPLTKFSTPWRRFFTSMPVYAIIVANFCRSWTFYLLLISQPAYFEEVFGFEISKVGLVSALPHLVMTIIVPIGGQIADFLRSRRIMSTTNVRKLMNCGGFGMEATLLLVVGYSHSKGVAISFLVLAVGFSGFAISGFNVNHLDIAPRYASILMGISNGVGTLSGMVCPIIVGAMTKHKTREEWQYVFLIASLVHYGGVIFYGVFASGEKQPWAEPEEMSEEKCGFVGHDQLAGSDDSEMEDEAEPPGAPPAPPPSYGATHSTFQPPRPPPPVRDY

SEQ ID NO: 80592 - protein, 493 aa, Homo sapiens
  Payload ID: 16060
  Gene Symbol: SLC17A7
  Gene Name: solute carrier family 17 (vesicular glutamate transporter), member 7
  Uniprot ID: Q9P2U7
  ENSP ID: ENSP00000470338
MSGLGFCISFGIRCNLGVAIVSMVNNSTTHRGGHVVVQKAQFSWDPETVGLIHGSFFWGYIVTQIPGGFICQKFAANRVFGFAIVATSTLNMLIPSAARVHYGCVIFVRILQGLVEGVTYPACHGIWSKWAPPLERSRLATTAFCGSYAGAVVAMPLAGVLVQYSGWSSVFYVYGSFGIFWYLFWLLVSYESPALHPSISEEERKYIEDAIGESAKLMNPLTKFSTPWRRFFTSMPVYAIIVANFCRSWTFYLLLISQPAYFEEVFGFEISKVGLVSALPHLVMTIIVPIGGQIADFLRSRRIMSTTNVRKLMNCGGFGMEATLLLVVGYSHSKGVAISFLVLAVGFSGFAISGFNVNHLDIAPRYASILMGISNGVGTLSGMVCPIIVGAMTKHKTREEWQYVFLIASLVHYGGVIFYGVFASGEKQPWAEPEEMSEEKCGFVGHDQLAGSDDSEMEDEAEPPGAPPAPPPSYGATHSTFQPPRPPPPVRDY

SEQ ID NO: 80593 - protein, 116 aa, Homo sapiens
  Payload ID: 16060
  Gene Symbol: SLC17A7
  Gene Name: solute carrier family 17 (vesicular glutamate transporter), member 7
  ENSP ID: ENSP00000472086
  MOD_RES (1)..(1): Any amino acid
XWSKWAPPLERSRLATTAFCGSYAGAVVAMPLAGVLVQYSGWSSVFYVYGSFGIFWYLFWLLVSYESPALHPSISEEERKYIEDAIGESAKLMNPLTNYTVVPEGTRRSPQPRSPS

SEQ ID NO: 80594 - protein, 589 aa, Homo sapiens
  Payload ID: 16061
  Gene Symbol: SLC17A8
  Gene Name: solute carrier family 17 (vesicular glutamate transporter), member 8
  Uniprot ID: Q8NDX2
  ENSP ID: ENSP00000316909
MPFKAFDTFKEKILKPGKEGVKNAVGDSLGILQRKIDGTTEEEDNIELNEEGRPVQTSRPSPPLCDCHCCGLPKRYIIAIMSGLGFCISFGIRCNLGVAIVEMVNNSTVYVDGKPEIQTAQFNWDPETVGLIHGSFFWGYIMTQIPGGFISNKFAANRVFGAAIFLTSTLNMFIPSAARVHYGCVMCVRILQGLVEGVTYPACHGMWSKWAPPLERSRLATTSFCGSYAGAVVAMPLAGVLVQYIGWSSVFYIYGMFGIIWYMFWLLQAYECPAAHPTISNEEKTYIETSIGEGANVVSLSKFSTPWKRFFTSLPVYAIIVANFCRSWTFYLLLISQPAYFEEVFGFAISKVGLLSAVPHMVMTIVVPIGGQLADYLRSRQILTTTAVRKIMNCGGFGMEATLLLVVGFSHTKGVAISFLVLAVGFSGFAISGFNVNHLDIAPRYASILMGISNGVGTLSGMVCPLIVGAMTRHKTREEWQNVFLIAALVHYSGVIFYGVFASGEKQEWADPENLSEEKCGIIDQDELAEEIELNHESFASPKKKMSYGATSQNCEVQKKEWKGQRGATLDEEELTSYQNEERNFSTIS

SEQ ID NO: 80595 - protein, 539 aa, Homo sapiens
  Payload ID: 16061
  Gene Symbol: SLC17A8
  Gene Name: solute carrier family 17 (vesicular glutamate transporter), member 8
  Uniprot ID: Q8NDX2
  ENSP ID: ENSP00000376715
MPFKAFDTFKEKILKPGKEGVKNAVGDSLGILQRKIDGTTEEEDNIELNEEGRPVQTSRPSPPLCDCHCCGLPKRYIIAIMSGLGFCISFGIRCNLGVAIVEMVNNSTVYVDGKPEIQTAQFNWDPETVGLIHGSFFWGYIMTQIPGGFISNKFAANRVFGAAIFLTSTLNMFIPSAARVHYGCVMCVRILQGLVEGVTYPACHGMWSKWAPPLERSRLATTSFCGSYAGAVVAMPLAGVLVQYIGWSSVFYIYGMFGIIWYMFWLLQAYECPAAHPTISNEEKTYIETSIGEGANVVSLSVGLLSAVPHMVMTIVVPIGGQLADYLRSRQILTTTAVRKIMNCGGFGMEATLLLVVGFSHTKGVAISFLVLAVGFSGFAISGFNVNHLDIAPRYASILMGISNGVGTLSGMVCPLIVGAMTRHKTREEWQNVFLIAALVHYSGVIFYGVFASGEKQEWADPENLSEEKCGIIDQDELAEEIELNHESFASPKKKMSYGATSQNCEVQKKEWKGQRGATLDEEELTSYQNEERNFSTIS

SEQ ID NO: 80596 - protein, 430 aa, Homo sapiens
  Payload ID: 16062
  Gene Symbol: SLC17A9
  Gene Name: solute carrier family 17 (vesicular nucleotide transporter), member 9
  Uniprot ID: Q9BYT1
  ENSP ID: ENSP00000359374
MTLTSRRQDSQEARPECQAWTGTLLLGTCLLYCARSSMPICTVSMSQDFGWNKKEAGIVLSSFFWGYCLTQVVGGHLGDRIGGEKVILLSASAWGSITAVTPLLAHLSSAHLAFMTFSRILMGLLQGVYFPALTSLLSQKVRESERAFTYSIVGAGSQFGTLLTGAVGSLLLEWYGWQSIFYFSGGLTLLWVWYVYRYLLSEKDLILALGVLAQSRPVSRHNRVPWRRLFRKPAVWAAVVSQLSAACSFFILLSWLPTFFEETFPDAKGWIFNVVPWLVAIPASLFSGFLSDHLINQGYRAITVRKLMQGMGLGLSSVFALCLGHTSSFCESVVFASASIGLQTFNHSGISVNIQDLAPSCAGFLFGVANTAGALAGVVGVCLGGYLMETTGSWTCLFNLVAIISNLGLCTFLVFGQAQRVDLSSTHEDL

SEQ ID NO: 80597 - protein, 436 aa, Homo sapiens
  Payload ID: 16062
  Gene Symbol: SLC17A9
  Gene Name: solute carrier family 17 (vesicular nucleotide transporter), member 9
  Uniprot ID: Q9BYT1
  ENSP ID: ENSP00000359376
MQPPPDEARRDMAGDTQWSRPECQAWTGTLLLGTCLLYCARSSMPICTVSMSQDFGWNKKEAGIVLSSFFWGYCLTQVVGGHLGDRIGGEKVILLSASAWGSITAVTPLLAHLSSAHLAFMTFSRILMGLLQGVYFPALTSLLSQKVRESERAFTYSIVGAGSQFGTLLTGAVGSLLLEWYGWQSIFYFSGGLTLLWVWYVYRYLLSEKDLILALGVLAQSRPVSRHNRVPWRRLFRKPAVWAAVVSQLSAACSFFILLSWLPTFFEETFPDAKGWIFNVVPWLVAIPASLFSGFLSDHLINQGYRAITVRKLMQGMGLGLSSVFALCLGHTSSFCESVVFASASIGLQTFNHSGISVNIQDLAPSCAGFLFGVANTAGALAGVVGVCLGGYLMETTGSWTCLFNLVAIISNLGLCTFLVFGQAQRVDLSSTHEDL

SEQ ID NO: 80598 - protein, 152 aa, Homo sapiens
  Payload ID: 16062
  Gene Symbol: SLC17A9
  Gene Name: solute carrier family 17 (vesicular nucleotide transporter), member 9
  ENSP ID: ENSP00000388215
MFPRPGALSWTVRRHTPRQVEPPCVCMTLTSRRQDSQEARPECQAWTGTLLLGTCLLYCARSSMPICTVSMSQDFGWNKKEAGIVLSSFFWGYCLTQVVGGHLGDRIGGEKVILLSASAWGSITAVTPLLAHLSSAHLAFMTFSRILMGLLQ

SEQ ID NO: 80599 - protein, 439 aa, Homo sapiens
  Payload ID: 16063
  Gene Symbol: SLC17A2
  Gene Name: solute carrier family 17, member 2
  Uniprot ID: O00624
  ENSP ID: ENSP00000265425
MDGKPATRKGPDFCSLRYGLALIMHFSNFTMITQRVSLSIAIIAMVNTTQQQGLSNASTEGPVADAFNNSSISIKEFDTKASVYQWSPETQGIIFSSINYGIILTLIPSGYLAGIFGAKKMLGAGLLISSLLTLFTPLAADFGVILVIMVRTVQGMAQGMAWTGQFTIWAKWAPPLERSKLTTIAGSGSAFGSFIILCVGGLISQALSWPFIFYIFGSTGCVCCLLWFTVIYDDPMHHPCISVREKEHILSSLAQQPSSPGRAVPIKAMVTCLPLWAIFLGFFSHFWLCTIILTYLPTYISTLLHVNIRDSGVLSSLPFIAAASCTILGGQLADFLLSRNLLRLITVRKLFSSLGLLLPSICAVALPFVASSYVITIILLILIPGTSNLCDSGFIINTLDIAPRYASFLMGISRGFGLIAGIISSTATGFLISQVGPVY

SEQ ID NO: 80600 - protein, 436 aa, Homo sapiens
  Payload ID: 16063
  Gene Symbol: SLC17A2
  Gene Name: solute carrier family 17, member 2
  Uniprot ID: O00624
  ENSP ID: ENSP00000353677
MDGKPATRKGPDFCSLRYGLALIMHFSNFTMITQRVSLSIAIIAMVNTTQQQGLSNASTEGPVADAFNNSSISIKEFDTKASVYQWSPETQGIIFSSINYGIILTLIPSGYLAGIFGAKKMLGAGLLISSLLTLFTPLAADFGVILVIMVRTVQGMAQGMAWTGQFTIWAKWAPPLERSKLTTIAGSGSAFGSFIILCVGGLISQALSWPFIFYIFGSTGCVCCLLWFTVIYDDPMHHPCISVREKEHILSSLAQQPSSPGRAVPIKAMVTCLPLWAIFLGFFSHFWLCTIILTYLPTYISTLLHVNIRDSGVLSSLPFIAAASCTILGGQLADFLLSRNLLRLITVRKLFSSLDMQVSSWESQGDLGSSQESSLPLPLDSSSVRILSLVGGMSFSCLLQSTCLAWSFTSRLDKQNFKTGPKRGPLPASEDIKLQT

SEQ ID NO: 80601 - protein, 478 aa, Homo sapiens
  Payload ID: 16063
  Gene Symbol: SLC17A2
  Gene Name: solute carrier family 17, member 2
  Uniprot ID: O00624
  ENSP ID: ENSP00000367081
MDGKPATRKGPDFCSLRYGLALIMHFSNFTMITQRVSLSIAIIAMVNTTQQQGLSNASTEGPVADAFNNSSISIKEFDTKASVYQWSPETQGIIFSSINYGIILTLIPSGYLAGIFGAKKMLGAGLLISSLLTLFTPLAADFGVILVIMVRTVQGMAQGMAWTGQFTIWAKWAPPLERSKLTTIAGSGSAFGSFIILCVGGLISQALSWPFIFYIFGSTGCVCCLLWFTVIYDDPMHHPCISVREKEHILSSLAQQPSSPGRAVPIKAMVTCLPLWAIFLGFFSHFWLCTIILTYLPTYISTLLHVNIRDSGVLSSLPFIAAASCTILGGQLADFLLSRNLLRLITVRKLFSSLGLLLPSICAVALPFVASSYVITIILLILIPGTSNLCDSGFIINTLDIAPRYASFLMGISRGFGLIAGIISSTATGFLISQDFESGWRNVFFLSAAVNMFGLVFYLTFGQAELQDWAKERTLTRL

SEQ ID NO: 80602 - protein, 497 aa, Homo sapiens
  Payload ID: 16064
  Gene Symbol: SLC17A4
  Gene Name: solute carrier family 17, member 4
  Uniprot ID: Q9Y2C5
  ENSP ID: ENSP00000367137
MSTGPDVKATVGDISSDGNLNVAQEECSRKGFCSVRHGLALILQLCNFSIYTQQMNLSIAIPAMVNNTAPPSQPNASTERPSTDSQGYWNETLKEFKAMAPAYDWSPEIQGIILSSLNYGSFLAPIPSGYVAGIFGAKYVVGAGLFISSFLTLFIPLAANAGVALLIVLRIVQGIAQVMVLTGQYSIWVKWAPPLERSQLTTIAGSGSMLGSFIVLLAGGLLCQTIGWPYVFYIFGGIGCACCPLWFPLIYDDPVNHPFISAGEKRYIVCSLAQQDCSPGWSLPIRAMIKSLPLWAILVSYFCEYWLFYTIMAYTPTYISSVLQANLRDSGILSALPFVVGCICIILGGLLADFLLSRKILRLITIRKLFTAIGVLFPSVILVSLPWVRSSHSMTMTFLVLSSAISSFCESGALVNFLDIAPRYTGFLKGLLQVFAHIAGAISPTAAGFFISQDSEFGWRNVFLLSAAVNISGLVFYLIFGRADVQDWAKEQTFTHL

SEQ ID NO: 80603 - protein, 221 aa, Homo sapiens
  Payload ID: 16064
  Gene Symbol: SLC17A4
  Gene Name: solute carrier family 17, member 4
  Uniprot ID: Q9Y2C5
  ENSP ID: ENSP00000380266
MNLSIAIPAMVNNTAPPSQPNASTERPSTDSQGYWNETLKEFKAMDCSPGWSLPIRAMIKSLPLWAILVSYFCEYWLFYTIMAYTPTYISSVLQANLRDSGILSALPFVVGCICIILGGLLADFLLSRKILRLITIRKLFTAIGKGETGHRGERGKLRAAFSLLCVCPPTPGVLFPSVILVSLPWVRSSHSMTMTFLVLSSAISSFCESGALVNFLDIAPR

SEQ ID NO: 80604 - protein, 443 aa, Homo sapiens
  Payload ID: 16064
  Gene Symbol: SLC17A4
  Gene Name: solute carrier family 17, member 4
  Uniprot ID: Q9Y2C5
  ENSP ID: ENSP00000391345
MNLSIAIPAMVNNTAPPSQPNASTERPSTDSQGYWNETLKEFKAMAPAYDWSPEIQGIILSSLNYGSFLAPIPSGYVAGIFGAKYVVGAGLFISSFLTLFIPLAANAGVALLIVLRIVQGIAQVMVLTGQYSIWVKWAPPLERSQLTTIAGSGSMLGSFIVLLAGGLLCQTIGWPYVFYIFGGIGCACCPLWFPLIYDDPVNHPFISAGEKRYIVCSLAQQDCSPGWSLPIRAMIKSLPLWAILVSYFCEYWLFYTIMAYTPTYISSVLQANLRDSGILSALPFVVGCICIILGGLLADFLLSRKILRLITIRKLFTAIGVLFPSVILVSLPWVRSSHSMTMTFLVLSSAISSFCESGALVNFLDIAPRYTGFLKGLLQVFAHIAGAISPTAAGFFISQDSEFGWRNVFLLSAAVNISGLVFYLIFGRADVQDWAKEQTFTHL

SEQ ID NO: 80605 - protein, 532 aa, Homo sapiens
  Payload ID: 16065
  Gene Symbol: SLC18A3
  Gene Name: solute carrier family 18 (vesicular acetylcholine transporter), member 3
  Uniprot ID: Q16572
  ENSP ID: ENSP00000363229
MESAEPAGQARAAATKLSEAVGAALQEPRRQRRLVLVIVCVALLLDNMLYMVIVPIVPDYIAHMRGGGEGPTRTPEVWEPTLPLPTPANASAYTANTSASPTAAWPAGSALRPRYPTESEDVKIGVLFASKAILQLLVNPLSGPFIDRMSYDVPLLIGLGVMFASTVLFAFAEDYATLFAARSLQGLGSAFADTSGIAMIADKYPEEPERSRALGVALAFISFGSLVAPPFGGILYEFAGKRVPFLVLAAVSLFDALLLLAVAKPFSAAARARANLPVGTPIHRLMLDPYIAVVAGALTTCNIPLAFLEPTIATWMKHTMAASEWEMGMAWLPAFVPHVLGVYLTVRLAARYPHLQWLYGALGLAVIGASSCIVPACRSFAPLVVSLCGLCFGIALVDTALLPTLAFLVDVRHVSVYGSVYAIADISYSVAYALGPIVAGHIVHSLGFEQLSLGMGLANLLYAPVLLLLRNVGLLTRSRSERDVLLDEPPQGLYDAVRLRERPVSGQDGEPRSPPGPFDACEDDYNYYYTRS

SEQ ID NO: 80606 - protein, 493 aa, Homo sapiens
  Payload ID: 16066
  Gene Symbol: SLC18A1
  Gene Name: solute carrier family 18 (vesicular monoamine transporter), member 1
  Uniprot ID: P54219
  ENSP ID: ENSP00000265808
MLRTILDAPQRLLKEGRASRQLVLVVVFVALLLDNMLFTVVVPIVPTFLYDMEFKEVNSSLHLGHAGSSPHALASPAFSTIFSFFNNNTVAVEESVPSGIAWMNDTASTIPPPATEAISAHKNNCLQGTGFLEEEITRVGVLFASKAVMQLLVNPFVGPLTNRIGYHIPMFAGFVIMFLSTVMFAFSGTYTLLFVARTLQGIGSSFSSVAGLGMLASVYTDDHERGRAMGTALGGLALGLLVGAPFGSVMYEFVGKSAPFLILAFLALLDGALQLCILQPSKVSPESAKGTPLFMLLKDPYILVAAGLAFLPASVSYLIGTNLFGVLANKMGRWLCSLIGMLVVGTSLLCVPLAHNIFGLIGPNAGLGLAIGMVDSSMMPIMGHLVDLRHTSVYGSVYAIADVAFCMGFAIGPSTGGAIVKAIGFPWLMVITGVINIVYAPLCYYLRSPPAKEEKLAILSQDCPMETRMYATQKPTKEFPLGEDSDEEPDHEE

SEQ ID NO: 80607 - protein, 525 aa, Homo sapiens
  Payload ID: 16066
  Gene Symbol: SLC18A1
  Gene Name: solute carrier family 18 (vesicular monoamine transporter), member 1
  Uniprot ID: P54219
  ENSP ID: ENSP00000276373
MLRTILDAPQRLLKEGRASRQLVLVVVFVALLLDNMLFTVVVPIVPTFLYDMEFKEVNSSLHLGHAGSSPHALASPAFSTIFSFFNNNTVAVEESVPSGIAWMNDTASTIPPPATEAISAHKNNCLQGTGFLEEEITRVGVLFASKAVMQLLVNPFVGPLTNRIGYHIPMFAGFVIMFLSTVMFAFSGTYTLLFVARTLQGIGSSFSSVAGLGMLASVYTDDHERGRAMGTALGGLALGLLVGAPFGSVMYEFVGKSAPFLILAFLALLDGALQLCILQPSKVSPESAKGTPLFMLLKDPYILVAAGSICFANMGVAILEPTLPIWMMQTMCSPKWQLGLAFLPASVSYLIGTNLFGVLANKMGRWLCSLIGMLVVGTSLLCVPLAHNIFGLIGPNAGLGLAIGMVDSSMMPIMGHLVDLRHTSVYGSVYAIADVAFCMGFAIGPSTGGAIVKAIGFPWLMVITGVINIVYAPLCYYLRSPPAKEEKLAILSQDCPMETRMYATQKPTKEFPLGEDSDEEPDHEE

SEQ ID NO: 80608 - protein, 472 aa, Homo sapiens
  Payload ID: 16066
  Gene Symbol: SLC18A1
  Gene Name: solute carrier family 18 (vesicular monoamine transporter), member 1
  Uniprot ID: P54219
  ENSP ID: ENSP00000371021
MLRTILDAPQRLLKEGRASRQLVLVVVFVALLLDNMLFTVVVPIVPTFLYDMEFKEVNSSLHLGHAGSSPHALASPAFSTIFSFFNNNTVAVEESVPSGIAWMNDTASTIPPPATEAISAHKNNCLQGTGFLEEEITRVGVLFASKAVMQLLVNPFVGPLTNRIGYHIPMFAGFVIMFLSTVMFAFSGTYTLLFVARTLQGIGSSFSSVAGLGMLASVYTDDHERGRAMGTALGGLALGLLVGAPFGSVMYEFVGKSAPFLILAFLALLDGALQLCILQPSKVSPESAKGTPLFMLLKDPYILVAAGSICFANMGVAILEPTLPIWMMQTMCSPKWQLGLAFLPASVSYLIGTNLFGVLANKMGRWLCSLIGMLVVGTSLLCVPLAHNIFGLIGPNAGLGLAIGMVDSSMMPIMGHLVDLRHTSVYGSVYAIADVAFCMGFAIGYSESGLPHGDPDVCNPEAHEGISSGGGQ

SEQ ID NO: 80609 - protein, 525 aa, Homo sapiens; identical to SEQ ID NO: 80607
  Payload ID: 16066
  Gene Symbol: SLC18A1
  Gene Name: solute carrier family 18 (vesicular monoamine transporter), member 1
  Uniprot ID: P54219
  ENSP ID: ENSP00000387549

SEQ ID NO: 80610 - protein, 472 aa, Homo sapiens; identical to SEQ ID NO: 80608
  Payload ID: 16066
  Gene Symbol: SLC18A1
  Gene Name: solute carrier family 18 (vesicular monoamine transporter), member 1
  Uniprot ID: P54219
  ENSP ID: ENSP00000413361

SEQ ID NO: 80611 - protein, 385 aa, Homo sapiens
  Payload ID: 16066
  Gene Symbol: SLC18A1
  Gene Name: solute carrier family 18 (vesicular monoamine transporter), member 1
  ENSP ID: ENSP00000428001
MLRTILDAPQRLLKEGRASRQLVLVVVFVALLLDNMLFTVVVPIVPTFLYDMEFKEVNSSLHLGHAGSSPHALASPAFSTIFSFFNNNTVAVEESVPSGIAWMNDTASTIPPPATEAISAHKNNCLQGTGFLEEEITRVGVLFASKAVMQLLVNPFVGPLTNRIGYHIPMFAGFVIMFLSTVMFAFSGTYTLLFVARTLQGIGSSFSSVAGLGMLASVYTDDHERGRAMGTALGGLALGLLVGAPFGSVMYEFVGKSAPFLILAFLALLDGALQLCILQPSKVSPESAKGTPLFMLLKDPYILVAAGSICFANMGVAILEPTLPIWMMQTMCSPKWQLGLAFLPASVSYLIGTNLFGVLANKMGRWLCSLIGMLVVGTSLLCLPS

SEQ ID NO: 80612 - protein, 258 aa, Homo sapiens
  Payload ID: 16066
  Gene Symbol: SLC18A1
  Gene Name: solute carrier family 18 (vesicular monoamine transporter), member 1
  ENSP ID: ENSP00000428999
MLRTILDAPQRLLKEGRASRQLVLVVVFVALLLDNMLFTVVVPIVPTFLYDMEFKEVNSSLHLGHAGSSPHALASPAFSTIFSFFNNNTVAVEESVPSGIAWMNDTASTIPPPATEAISAHKNNCLQGTGFLEEEITRVGVLFASKAVMQLLVNPFVGPLTNRIGYHIPMFAGFVIMFLSTVSLGMLASVYTDDHERGRAMGTALGGLALGLLVGAPFGSVMYEFVGKSAPFLILAFLALLDGALQLCILQPSKVSPE

SEQ ID NO: 80613 - protein, 493 aa, Homo sapiens; identical to SEQ ID NO: 80606
  Payload ID: 16066
  Gene Symbol: SLC18A1
  Gene Name: solute carrier family 18 (vesicular monoamine transporter), member 1
  Uniprot ID: P54219
  ENSP ID: ENSP00000429664

SEQ ID NO: 80614 - protein, 514 aa, Homo sapiens
  Payload ID: 16067
  Gene Symbol: SLC18A2
  Gene Name: solute carrier family 18 (vesicular monoamine transporter), member 2
  Uniprot ID: Q05940
  ENSP ID: ENSP00000298472
MALSELALVRWLQESRRSRKLILFIVFLALLLDNMLLTVVVPIIPSYLYSIKHEKNATEIQTARPVHTASISDSFQSIFSYYDNSTMVTGNATRDLTLHQTATQHMVTNASAVPSDCPSEDKDLLNENVQVGLLFASKATVQLITNPFIGLLTNRIGYPIPIFAGFCIMFVSTIMFAFSSSYAFLLIARSLQGIGSSCSSVAGMGMLASVYTDDEERGNVMGIALGGLAMGVLVGPPFGSVLYEFVGKTAPFLVLAALVLLDGAIQLFVLQPSRVQPESQKGTPLTTLLKDPYILIAAGSICFANMGIAMLEPALPIWMMETMCSRKWQLGVAFLPASISYLIGTNIFGILAHKMGRWLCALLGMIIVGVSILCIPFAKNIYGLIAPNFGVGFAIGMVDSSMMPIMGYLVDLRHVSVYGSVYAIADVAFCMGYAIGPSAGGAIAKAIGFPWLMTIIGIIDILFAPLCFFLRSPPAKEEKMAILMDHNCPIKTKMYTQNNIQSYPIGEDEESESD

SEQ ID NO: 80615 - protein, 456 aa, Homo sapiens
  Payload ID: 16068
  Gene Symbol: SLC18B1
  Gene Name: solute carrier family 18, subfamily B, member 1
  Uniprot ID: Q6NT16
  ENSP ID: ENSP00000275227
MEALGDLEGPRAPGGDDPAGSAGETPGWLSREQVFVLISAASVNLGSMMCYSILGPFFPKEAEKKGASNTIIGMIFGCFALFELLASLVFGNYLVHIGAKFMFVAGMFVSGGVTILFGVLDRVPDGPVFIAMCFLVRVMDAVSFAAAMTASSSILAKAFPNNVATVLGSLETFSGLGLILGPPVGGFLYQSFGYEVPFIVLGCVVLLMVPLNMYILPNYESDPGEHSFWKLIALPKVGLIAFVINSLSSCFGFLDPTLSLFVLEKFNLPAGYVGLVFLGMALSYAISSPLFGLLSDKRPPLRKWLLVFGNLITAGCYMLLGPVPILHIKSQLWLLVLILVVSGLSAGMSIIPTFPEILSCAHENGFEEGLSTLGLVSGLFSAMWSIGAFMGPTLGGFLYEKIGFEWAAAIQGLWALISGLAMGLFYLLEYSRRKRSKSQNILSTEEERTTLLPNET

SEQ ID NO: 80616 - protein, 107 aa, Homo sapiens
  Payload ID: 16068
  Gene Symbol: SLC18B1
  Gene Name: solute carrier family 18, subfamily B, member 1
  ENSP ID: ENSP00000356895
MEALGDLEGPRAPGGDDPAGSAGETPGWLSREQVFVLISAASVNLGSMMCYSILGPFFPKEAEKKGASNTIIGMIFGFQFTSWICGTSIPGYGTVLCHLFTTIWSPK

SEQ ID NO: 80617 - protein, 591 aa, Homo sapiens
  Payload ID: 16069
  Gene Symbol: SLC19A1
  Gene Name: solute carrier family 19 (folate transporter), member 1
  Uniprot ID: P41440
  ENSP ID: ENSP00000308895
MVPSSPAVEKQVPVEPGPDPELRSWRHLVCYLCFYGFMAQIRPGESFITPYLLGPDKNFTREQVTNEITPVLSYSYLAVLVPVFLLTDYLRYTPVLLLQGLSFVSVWLLLLLGHSVAHMQLMELFYSVTMAARIAYSSYIFSLVRPARYQRVAGYSRAAVLLGVFTSSVLGQLLVTVGRVSFSTLNYISLAFLTFSVVLALFLKRPKRSLFFNRDDRGRCETSASELERMNPGPGGKLGHALRVACGDSVLARMLRELGDSLRRPQLRLWSLWWVFNSAGYYLVVYYVHILWNEVDPTTNSARVYNGAADAASTLLGAITSFAAGFVKIRWARWSKLLIAGVTATQAGLVFLLAHTRHPSSIWLCYAAFVLFRGSYQFLVPIATFQIASSLSKELCALVFGVNTFFATIVKTIITFIVSDVRGLGLPVRKQFQLYSVYFLILSIIYFLGAMLDGLRHCQRGHHPRQPPAQGLRSAAEEKAAQALSVQDKGLGGLQPAQSPPLSPEDSLGAVGPASLEQRQSDPYLAQAPAPQAAEFLSPVTTPSPCTLCSAQASGPEAADETCPQLAVHPPGVSKLGLQCLPSDGVQNVNQ

SEQ ID NO: 80618 - protein, 489 aa, Homo sapiens
  Payload ID: 16069
  Gene Symbol: SLC19A1
  Gene Name: solute carrier family 19 (folate transporter), member 1
  Uniprot ID: P41440
  ENSP ID: ENSP00000369347
MVPSSPAVEKQVPVEPGPDPELRSWRHLVCYLCFYGFMAQIRPGESFITPYLLGPDKNFTREQVTNEITPVLSYSYLAVLVPVFLLTDYLRYTPVLLLQGLSFVSVWLLLLLGHSVAHMQLMELFYSVTMAARIAYSSYIFSLVRPARYQRVAGYSRAAVLLGVFTSSVLGQLLVTVGRVSFSTLNYISLAFLTFSVVLALFLKRPKRSLFFNRDDRGRCETSASELERMNPGPGGKLGHALRVACGDSVLARMLRELGDSLRRPQLRLWSLWWVFNSAGYYLVVYYVHILWNEVDPTTNSARVYNGAADAASTLLGAITSFAAGFVKIRWARWSKLLIAGVTATQAGLVFLLAHTRHPSSIWLCYAAFVLFRGSYQFLVPIATFQIASSLSKELCALVFGVNTFFATIVKTIITFIVSDVRGLGLPVRKQNEELHVASLSLWKSHLRLAADTLSSEGSSGSGPRSWFLSPTLRAALHGPVCPSEVCPS

SEQ ID NO: 80619 - protein, 269 aa, Homo sapiens
  Payload ID: 16069
  Gene Symbol: SLC19A1
  Gene Name: solute carrier family 19 (folate transporter), member 1
  ENSP ID: ENSP00000393988
  MOD_RES (1)..(1): Any amino acid
XLRLWSLWWVFNSAGYYLVVYYVHILWNEVDPTTNSARVYNGAADAASTLLGAITSFAAGFVKIRWARWSKLLIAGVTATQAGLVFLLAHTRHPSSIWLCYAAFVLFRGSYQFLVPIATFQIASSLSKELCALVFGVNTFFATIVKTIITFIVSDVRGLGLPVRKQALRMSRPRLGLCLPGPFPPQSAAPARAGMAASSAEDPGSERGPWRRAGTVAARGDPGGERGPWRREGTLAARGDPGGERGPWWREGTLAAKPRMQWVTRATAP

SEQ ID NO: 80620 - protein, 182 aa, Homo sapiens
  Payload ID: 16069
  Gene Symbol: SLC19A1
  Gene Name: solute carrier family 19 (folate transporter), member 1
  ENSP ID: ENSP00000401850
MVPSSPAVEKQVPVEPGPDPELRSWRHLVCYLCFYGFMAQIRPGESFITPYLLGPDKNFTREQVTNEITPVLSYSYLAVLVPVFLLTDYLRYTPVLLLQGLSFVSVWLLLLLGHSVAHMQLMELFYSVTMAARIAYSSYIFSLVRPARYQRVAGYSRAAVLLGVFTSSVLGQLLVTVGRVSF

SEQ ID NO: 80621 - protein, 154 aa, Homo sapiens
  Payload ID: 16069
  Gene Symbol: SLC19A1
  Gene Name: solute carrier family 19 (folate transporter), member 1
  ENSP ID: ENSP00000411345
MVPSSPAVEKQVPVEPGPDPELRSWRHLVCYLCFYGFMAQIRPGESFITPYLLGPDKNFTREQVTNEITPVLSYSYLAVLVPVFLLTDYLRYTPVLLLQGLSFVSVWLLLLLGHSVAHMQLMELFYSVTMAARIAYSSYIFSLVRPARYQRVAG

SEQ ID NO: 80622 - protein, 60 aa, Homo sapiens
  Payload ID: 16069
  Gene Symbol: SLC19A1
  Gene Name: solute carrier family 19 (folate transporter), member 1
  ENSP ID: ENSP00000435780
MVPSSPAVEKQVPVEPGPDPELRSWRHLVCYLCFYGFMAQIRPGESFITPYLLGPDKNFT

SEQ ID NO: 80623 - protein, 551 aa, Homo sapiens
  Payload ID: 16069
  Gene Symbol: SLC19A1
  Gene Name: solute carrier family 19 (folate transporter), member 1
  Uniprot ID: P41440
  ENSP ID: ENSP00000441772
MRPQPAEPAPGGRGNEACSIHSEVTNEITPVLSYSYLAVLVPVFLLTDYLRYTPVLLLQGLSFVSVWLLLLLGHSVAHMQLMELFYSVTMAARIAYSSYIFSLVRPARYQRVAGYSRAAVLLGVFTSSVLGQLLVTVGRVSFSTLNYISLAFLTFSVVLALFLKRPKRSLFFNRDDRGRCETSASELERMNPGPGGKLGHALRVACGDSVLARMLRELGDSLRRPQLRLWSLWWVFNSAGYYLVVYYVHILWNEVDPTTNSARVYNGAADAASTLLGAITSFAAGFVKIRWARWSKLLIAGVTATQAGLVFLLAHTRHPSSIWLCYAAFVLFRGSYQFLVPIATFQIASSLSKELCALVFGVNTFFATIVKTIITFIVSDVRGLGLPVRKQFQLYSVYFLILSIIYFLGAMLDGLRHCQRGHHPRQPPAQGLRSAAEEKAAQALSVQDKGLGGLQPAQSPPLSPEDSLGAVGPASLEQRQSDPYLAQAPAPQAAEFLSPVTTPSPCTLCSAQASGPEAADETCPQLAVHPPGVSKLGLQCLPSDGVQNVNQ

SEQ ID NO: 80624 - protein, 545 aa, Homo sapiens
  Payload ID: 16069
  Gene Symbol: SLC19A1
  Gene Name: solute carrier family 19 (folate transporter), member 1
  ENSP ID: ENSP00000457278
MVPSSPAVEKQVPVEPGPDPELRSWRHLVCYLCFYGFMAQIRPGESFITPYLLGPDKNFTREQVTNEITPVLSYSYLAVLVPVFLLTDYLRYTPVLLLQGLSFVSVWLLLLLGHSVAHMQLMELFYSVTMAARIAYSSYIFSLVRPARYQRVAGYSRAAVLLGVFTSSVLGQLLVTVGRVSFSTLNYISLAFLTFSVVLALFLKRPKRSLFFNRDDRGRCETSASELERMNPGPGGKLGHALRVACGDSVLARMLRELGDSLRRPQLRLWSLWWVFNSAGYYLVVYYVHILWNEVDPTTNSARVYNGAADAASTLLGAITSFAAGFVKIRWARWSKLLIAGVTATQAGLVFLLAHTRHPSSIWLCYAAFVLFRGSYQFLVPIATFQIASSLSKELCALVFGVNTFFATIVKTIITFIVSDVRGLGLPVRKQALRMSRPRLGLCLPGPFPPQSAAPARAGMAASSAEDPGSERGPWRRAGTVAARGDPGGERGPWRREGTLAARGDPGGERGPWWREGTLAVRGDPGGERGPWRREGTLVVKGARG

SEQ ID NO: 80625 - protein, 497 aa, Homo sapiens
  Payload ID: 16070
  Gene Symbol: SLC19A2
  Gene Name: solute carrier family 19 (thiamine transporter), member 2
  Uniprot ID: O60779
  ENSP ID: ENSP00000236137
MDVPGPVSRRAAAAAATVLLRTARVRRECWFLPTALLCAYGFFASLRPSEPFLTPYLLGPDKNLTEREVFNEIYPVWTYSYLVLLFPVFLATDYLRYKPVVLLQGLSLIVTWFMLLYAQGLLAIQFLEFFYGIATATEIAYYSYIYSVVDLGMYQKVTSYCRSATLVGFTVGSVLGQILVSVAGWSLFSLNVISLTCVSVAFAVAWFLPMPQKSLFFHHIPSTCQRVNGIKVQNGGIVTDTPASNHLPGWEDIESKIPLNMEEPPVEEPEPKPDRLLVLKVLWNDFLMCYSSRPLLCWSVWWALSTCGYFQVVNYTQGLWEKVMPSRYAAIYNGGVEAVSTLLGAVAVFAVGYIKISWSTWGEMTLSLFSLLIAAAVYIMDTVGNIWVCYASYVVFRIIYMLLITIATFQIAANLSMERYALVFGVNTFIALALQTLLTLIVVDASGLGLEITTQFLIYASYFALIAVVFLASGAVSVMKKCRKLEDPQSSSQVTTS

SEQ ID NO: 80626 - protein, 296 aa, Homo sapiens
  Payload ID: 16070
  Gene Symbol: SLC19A2
  Gene Name: solute carrier family 19 (thiamine transporter), member 2
  Uniprot ID: O60779
  ENSP ID: ENSP00000356778
MDVPGPVSRRAAAAAATVLLRTARVRRECWFLPTALLCAYGFFASLRPSEPFLTPYLLGPDKNLTEREEPKPDRLLVLKVLWNDFLMCYSSRPLLCWSVWWALSTCGYFQVVNYTQGLWEKVMPSRYAAIYNGGVEAVSTLLGAVAVFAVGYIKISWSTWGEMTLSLFSLLIAAAVYIMDTVGNIWVCYASYVVFRIIYMLLITIATFQIAANLSMERYALVFGVNTFIALALQTLLTLIVVDASGLGLEITTQFLIYASYFALIAVVFLASGAVSVMKKCRKLEDPQSSSQVTTS

SEQ ID NO: 80627 - protein, 496 aa, Homo sapiens
  Payload ID: 16071
  Gene Symbol: SLC19A3
  Gene Name: solute carrier family 19 (thiamine transporter), member 3
  Uniprot ID: Q9BZV2
  ENSP ID: ENSP00000258403
MDCYRTSLSSSWIYPTVILCLFGFFSMMRPSEPFLIPYLSGPDKNLTSAEITNEIFPVWTYSYLVLLLPVFVLTDYVRYKPVIILQGISFIITWLLLLFGQGVKTMQVVEFFYGMVTAAEVAYYAYIYSVVSPEHYQRVSGYCRSVTLAAYTAGSVLAQLLVSLANMSYFYLNVISLASVSVAFLFSLFLPMPKKSMFFHAKPSREIKKSSSVNPVLEETHEGEAPGCEEQKPTSEILSTSGKLNKGQLNSLKPSNVTVDVFVQWFQDLKECYSSKRLFYWSLWWAFATAGFNQVLNYVQILWDYKAPSQDSSIYNGAVEAIATFGGAVAAFAVGYVKVNWDLLGELALVVFSVVNAGSLFLMHYTANIWACYAGYLIFKSSYMLLITIAVFQIAVNLNVERYALVFGINTFIALVIQTIMTVIVVDQRGLNLPVSIQFLVYGSYFAVIAGIFLMRSMYITYSTKSQKDVQSPAPSENPDVSHPEEESNIIMSTKL

SEQ ID NO: 80628 - protein, 92 aa, Homo sapiens
  Payload ID: 16071
  Gene Symbol: SLC19A3
  Gene Name: solute carrier family 19 (thiamine transporter), member 3
  ENSP ID: ENSP00000386298
MDCYRTSLSSSWIYPTVILCLFGFFSMMRPSEPFLIPYLSGPDKNLTSAEITNEIFPVWTYSYLVLLLPVFVLTDYVRYKPVIILQGWNAMA

SEQ ID NO: 80629 - protein, 54 aa, Homo sapiens
  Payload ID: 16071
  Gene Symbol: SLC19A3
  Gene Name: solute carrier family 19 (thiamine transporter), member 3
  ENSP ID: ENSP00000387193
MDCYRTSLSSSWIYPTVILCLFGFFSMMRPSEPFLIPYLSGPDKNLTSAEITNE

SEQ ID NO: 80630 - protein, 496 aa, Homo sapiens; identical to SEQ ID NO: 80627
  Payload ID: 16071
  Gene Symbol: SLC19A3
  Gene Name: solute carrier family 19 (thiamine transporter), member 3
  Uniprot ID: Q9BZV2
  ENSP ID: ENSP00000397393

SEQ ID NO: 80631 - protein, 64 aa, Homo sapiens
  Payload ID: 16071
  Gene Symbol: SLC19A3
  Gene Name: solute carrier family 19 (thiamine transporter), member 3
  ENSP ID: ENSP00000398349
MDCYRTSLSSSWIYPTVILCLFGFFSMMRPSEPFLIPYLSGPDKNLTSAEITNEIFPVWTYSYL

SEQ ID NO: 80632 - protein, 132 aa, Homo sapiens
  Payload ID: 16071
  Gene Symbol: SLC19A3
  Gene Name: solute carrier family 19 (thiamine transporter), member 3
  ENSP ID: ENSP00000399001
MDCYRTSLSSSWIYPTVILCLFGFFSMMRPSEPFLIPYLSGPDKNLTSAEITNEIFPVWTYSYLVLLLPVFVLTDYVRYKPVIILQGISFIITWLLLLFGQGVKTMQVVEFFYGMVTAAEVAYYAYIYSVVS

SEQ ID NO: 80633 - protein, 56 aa, Homo sapiens
  Payload ID: 16071
  Gene Symbol: SLC19A3
  Gene Name: solute carrier family 19 (thiamine transporter), member 3
  ENSP ID: ENSP00000400627
MDCYRTSLSSSWIYPTVILCLFGFFSMMRPSEPFLIPYLSGPDKNLTSAEVEACHN

SEQ ID NO: 80634 - protein, 116 aa, Homo sapiens
  Payload ID: 16072
  Gene Symbol: SLC2A1
  Gene Name: solute carrier family 2 (facilitated glucose transporter), member 1
  ENSP ID: ENSP00000361578
MEPSSKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVS

SEQ ID NO: 80635 - protein, 44 aa, Homo sapiens
  Payload ID: 16072
  Gene Symbol: SLC2A1
  Gene Name: solute carrier family 2 (facilitated glucose transporter), member 1
  ENSP ID: ENSP00000395521
SLSVAIFSVGGMIGSFSVGLFVNRFGRVLPLTQPLGAQGMWALA

SEQ ID NO: 80636 - protein, 492 aa, Homo sapiens
  Payload ID: 16072
  Gene Symbol: SLC2A1
  Gene Name: solute carrier family 2 (facilitated glucose transporter), member 1
  Uniprot ID: P11166
  ENSP ID: ENSP00000416293
MEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTALRGALGTLHQLGIVVGILIAQVFGLDSIMGNKDLWPLLLSIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 80637 - protein, 173 aa, Homo sapiens
  Payload ID: 16072
  Gene Symbol: SLC2A1
  Gene Name: solute carrier family 2 (facilitated glucose transporter), member 1
  ENSP ID: ENSP00000486694
MEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTALRGALGTLHQLGIVVGILIAQC

SEQ ID NO: 80638 - protein, 142 aa, Homo sapiens
  Payload ID: 16072
  Gene Symbol: SLC2A1
  Gene Name: solute carrier family 2 (facilitated glucose transporter), member 1
  ENSP ID: ENSP00000487213
  MOD_RES (1)..(1): Any amino acid
XAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTALRGALGTLHQLGIVVGILIAQAAG

SEQ ID NO: 80639 - protein, 541 aa, Homo sapiens
  Payload ID: 16073
  Gene Symbol: SLC2A10
  Gene Name: solute carrier family 2 (facilitated glucose transporter), member 10
  Uniprot ID: O95528
  ENSP ID: ENSP00000352216
MGHSPPVLPLCASVSLLGGLTFGYELAVISGALLPLQLDFGLSCLEQEFLVGSLLLGALLASLVGGFLIDCYGRKQAILGSNLVLLAGSLTLGLAGSLAWLVLGRAVVGFAISLSSMACCIYVSELVGPRQRGVLVSLYEAGITVGILLSYALNYALAGTPWGWRHMFGWATAPAVLQSLSLLFLPAGTDETATHKDLIPLQGGEAPKLGPGRPRYSFLDLFRARDNMRGRTTVGLGLVLFQQLTGQPNVLCYASTIFSSVGFHGGSSAVLASVGLGAVKVAATLTAMGLVDRAGRRALLLAGCALMALSVSGIGLVSFAVPMDSGPSCLAVPNATGQTGLPGDSGLLQDSSLPPIPRTNEDQREPILSTAKKTKPHPRSGDPSAPPRLALSSALPGPPLPARGHALLRWTALLCLMVFVSAFSFGFGPVTWLVLSEIYPVEIRGRAFAFCNSFNWAANLFISLSFLDLIGTIGLSWTFLLYGLTAVLGLGFIYLFVPETKGQSLAEIDQQFQKRRFTLSFGHRQNSTGIPYSRIEISAAS

SEQ ID NO: 80640 - protein, 13 aa, Homo sapiens
  Payload ID: 16073
  Gene Symbol: SLC2A10
  Gene Name: solute carrier family 2 (facilitated glucose transporter), member 10
  ENSP ID: ENSP00000478679
MAPTRAQALSRAP

SEQ ID NO: 80641 - protein, 98 aa, Homo sapiens
  Payload ID: 16074
  Gene Symbol: SLC2A11
  Gene Name: solute carrier family 2 (facilitated glucose transporter), member 11
  ENSP ID: ENSP00000255830
MRALRRLIQGRILLLTICAAGIGGTFQFGYNLSIINAPTLHIQEFTNETWQARTGEPLPDHLVLLMWSLIVSLYPLGGLFGALLAGPLAITLGRSPSW

SEQ ID NO: 80642 - protein, 499 aa, Homo sapiens
  Payload ID: 16074
  Gene Symbol: SLC2A11
  Gene Name: solute carrier family 2 (facilitated glucose transporter), member 11
  Uniprot ID: Q9BYW1
  ENSP ID: ENSP00000326748
MLHALLRSRMIQGRILLLTICAAGIGGTFQFGYNLSIINAPTLHIQEFTNETWQARTGEPLPDHLVLLMWSLIVSLYPLGGLFGALLAGPLAITLGRKKSLLVNNIFVVSAAILFGFSRKAGSFEMIMLGRLLVGVNAGVSMNIQPMYLGESAPKELRGAVAMSSAIFTALGIVMGQVVGLRELLGGPQAWPLLLASCLVPGALQLASLPLLPESPRYLLIDCGDTEACLAALRRLRGSGDLAGELEELEEERAACQGCRARRPWELFQHRALRRQVTSLVVLGSAMELCGNDSVYAYASSVFRKAGVPEAKIQYAIIGTGSCELLTAVVSCVVIERVGRRVLLIGGYSLMTCWGSIFTVALCLQSSFPWTLYLAMACIFAFILSFGIGPAGVTGILATELFDQMARPAACMVCGALMWIMLILVGLGFPFIMEALSHFLYVPFLGVCVCGAIYTGLFLPETKGKTFQEISKELHRLNFPRRAQGPTWRSLEVIQSTEL

SEQ ID NO: 80643 - protein, 496 aa, Homo sapiens
  Payload ID: 16074
  Gene Symbol: SLC2A11
  Gene Name: solute carrier family 2 (facilitated glucose transporter), member 11
  Uniprot ID: Q9BYW1
  ENSP ID: ENSP00000342542
MRALRRLIQGRILLLTICAAGIGGTFQFGYNLSIINAPTLHIQEFTNETWQARTGEPLPDHLVLLMWSLIVSLYPLGGLFGALLAGPLAITLGRKKSLLVNNIFVVSAAILFGFSRKAGSFEMIMLGRLLVGVNAGVSMNIQPMYLGESAPKELRGAVAMSSAIFTALGIVMGQVVGLRELLGGPQAWPLLLASCLVPGALQLASLPLLPESPRYLLIDCGDTEACLAALRRLRGSGDLAGELEELEEERAACQGCRARRPWELFQHRALRRQVTSLVVLGSAMELCGNDSVYAYASSVFRKAGVPEAKIQYAIIGTGSCELLTAVVSCVVIERVGRRVLLIGGYSLMTCWGSIFTVALCLQSSFPWTLYLAMACIFAFILSFGIGPAGVTGILATELFDQMARPAACMVCGALMWIMLILVGLGFPFIMEALSHFLYVPFLGVCVCGAIYTGLFLPETKGKTFQEISKELHRLNFPRRAQGPTWRSLEVIQSTEL

SEQ ID NO: 80644 - protein, 503 aa, Homo sapiens
  Payload ID: 16074
  Gene Symbol: SLC2A11
  Gene Name: solute carrier family 2 (facilitated glucose transporter), member 11
  Uniprot ID: Q9BYW1
  ENSP ID: ENSP00000381399
MEDELEPSLRPRTQIQGRILLLTICAAGIGGTFQFGYNLSIINAPTLHIQEFTNETWQARTGEPLPDHLVLLMWSLIVSLYPLGGLFGALLAGPLAITLGRKKSLLVNNIFVVSAAILFGFSRKAGSFEMIMLGRLLVGVNAGVSMNIQPMYLGESAPKELRGAVAMSSAIFTALGIVMGQVVGLRELLGGPQAWPLLLASCLVPGALQLASLPLLPESPRYLLIDCGDTEACLAALRRLRGSGDLAGELEELEEERAACQGCRARRPWELFQHRALRRQVTSLVVLGSAMELCGNDSVYAYASSVFRKAGVPEAKIQYAIIGTGSCELLTAVVSCVVIERVGRRVLLIGGYSLMTCWGSIFTVALCLQSSFPWTLYLAMACIFAFILSFGIGPAGVTGILATELFDQMARPAACMVCGALMWIMLILVGLGFPFIMEALSHFLYVPFLGVCVCGAIYTGLFLPETKGKTFQEISKELHRLNFPRRAQGPTWRSLEVIQSTEL

SEQ ID NO: 80645 - protein, 179 aa, Homo sapiens
  Payload ID: 16074
  Gene Symbol: SLC2A11
  Gene Name: solute carrier family 2 (facilitated glucose transporter), member 11
  ENSP ID: ENSP00000384987
MRALRRLIQGRILLLTICAAGIGGTFQFGYNLSIINAPTLHIQEFTNETWQARTGEPLPDHLVLLMWSLIVSLYPLGGLFGALLAGPLAITLGRKKSLLVNNIFVVSAAILFGFSRKAGSFEMIMLGRLLVGVNAGVSMNIQPMYLGESAPKELRGAVAMSSAIFTALGIVMGQVVGLR

SEQ ID NO: 80646 - protein, 222 aa, Homo sapiens
  Payload ID: 16074
  Gene Symbol: SLC2A11
  Gene Name: solute carrier family 2 (facilitated glucose transporter), member 11
  ENSP ID: ENSP00000385156
MFKNIVLIQGRILLLTICAAGIGGTFQFGYNLSIINAPTLHIQEFTNETWQARTGEPLPDHLVLLMWSLIVSLYPLGGLFGALLAGPLAITLGRKKSLLVNNIFVVSAAILFGFSRKAGSFEMIMLGRLLVGVNAGVSMNIQPMYLGESAPKELRGAVAMSSAIFTALGIVMGQVVGLRSGSKEQVFTEERVKIWAFKDKRVPVIPEKRGEGRAWTLGKRSC

SEQ ID NO: 80647 - protein, 104 aa, Homo sapiens
  Payload ID: 16074
  Gene Symbol: SLC2A11
  Gene Name: solute carrier family 2 (facilitated glucose transporter), member 11
  ENSP ID: ENSP00000385949
MRALRRLIQGRILLLTICAAGIGGTFQFGYNLSIINAPTLHIQEFTNETWQARTGEPLPDHLVLLMWSLIVSLYPLGGLFGALLAGPLAITLGRPTSKYRCIGN

SEQ ID NO: 80648 - protein, 48 aa, Homo sapiens
  Payload ID: 16074
  Gene Symbol: SLC2A11
  Gene Name: solute carrier family 2 (facilitated glucose transporter), member 11
  ENSP ID: ENSP00000398439
MEDELEPSLRPRTQIQGRILLLTICAAGIGGTFQFGYNLSIINAPTLI

SEQ ID NO: 80649 - protein, 113 aa, Homo sapiens
  Payload ID: 16074
  Gene Symbol: SLC2A11
  Gene Name: solute carrier family 2 (facilitated glucose transporter), member 11
  ENSP ID: ENSP00000398746
MLHALLRSRMIQGRILLLTICAAGIGGTFQFGYNLSIINAPTLHIQEFTNETWQARTGEPLPDHLVLLMWSLIVSLYPLGGLFGALLAGPLAITLGSLSFCVFHFPQGRSPSW

SEQ ID NO: 80650 - protein, 105 aa, Homo sapiens
  Payload ID: 16074
  Gene Symbol: SLC2A11
  Gene Name: solute carrier family 2 (facilitated glucose transporter), member 11
  ENSP ID: ENSP00000403654
MEDELEPSLRPRTQIQGRILLLTICAAGIGGTFQFGYNLSIINAPTLHIQEFTNETWQARTGEPLPDHLVLLMWSLIVSLYPLGGLFGALLAGPLAITLGRSPSW

SEQ ID NO: 80651 - protein, 535 aa, Homo sapiens
  Payload ID: 16074
  Gene Symbol: SLC2A11
  Gene Name: solute carrier family 2 (facilitated glucose transporter), member 11
  ENSP ID: ENSP00000479754
MEDELEPSLRPRTQIQGRILLLTICAAGIGGTFQFGYNLSIINAPTLHIQEFTNETWQARTGEPLPDHLVLLMWSLIVSLYPLGGLFGALLAGPLAITLGRKKSLLVNNIFVVSAAILFGFSRKAGSFEMIMLGRLLVGVNAGVSMNIQPMYLGESAPKELRGAVAMSSAIFTALGIVMGQVVGLRELLGGPQAWPLLLASCLVPGALQLASLPLLPESPRYLLIDCGDTEACLAALRRLRGSGDLAGELEELEEERAACQGCRARRPWELFQHRALRRQVTSLVVLGSAMELCGNDSVYAYASSVFRKAGVPEAKIQYAIIGTGSCELLTAVVSVAGVDEGWGVQAGLTSTSPPPRPRQSSFPWTLYLAMACIFAFILSFGIGPAGVTGILATELFDQMARPAACMVCGALMWIMLILVGLGFPFIMVLGSFLIRRRPCPTSSMSLSLVSVSVGPSTLACSFLRPKARPSKRSPRNYTDSTSPGGPRAPRGGAWRLSSQQNSSPKGVARAKASYCPVLCFLPGPWSSLPPAFLI

SEQ ID NO: 80652 - protein, 222 aa, Homo sapiens; identical to SEQ ID NO: 80646
  Payload ID: 16074
  Gene Symbol: SLC2A11
  Gene Name: solute carrier family 2 (facilitated glucose transporter), member 11
  ENSP ID: ENSP00000480019

SEQ ID NO: 80653 - protein, 503 aa, Homo sapiens; identical to SEQ ID NO: 80644
  Payload ID: 16074
  Gene Symbol: SLC2A11
  Gene Name: solute carrier family 2 (facilitated glucose transporter), member 11
  Uniprot ID: Q9BYW1
  ENSP ID: ENSP00000480839

SEQ ID NO: 80654 - protein, 496 aa, Homo sapiens; identical to SEQ ID NO: 80643
  Payload ID: 16074
  Gene Symbol: SLC2A11
  Gene Name: solute carrier family 2 (facilitated glucose transporter), member 11
  Uniprot ID: Q9BYW1
  ENSP ID: ENSP00000482495

SEQ ID NO: 80655 - protein, 535 aa, Homo sapiens; identical to SEQ ID NO: 80651
  Payload ID: 16074
  Gene Symbol: SLC2A11
  Gene Name: solute carrier family 2 (facilitated glucose transporter), member 11
  ENSP ID: ENSP00000483038

SEQ ID NO: 80656 - protein, 499 aa, Homo sapiens; identical to SEQ ID NO: 80642
  Payload ID: 16074
  Gene Symbol: SLC2A11
  Gene Name: solute carrier family 2 (facilitated glucose transporter), member 11
  Uniprot ID: Q9BYW1
  ENSP ID: ENSP00000483163

SEQ ID NO: 80657 - protein, 105 aa, Homo sapiens; identical to SEQ ID NO: 80650
  Payload ID: 16074
  Gene Symbol: SLC2A11
  Gene Name: solute carrier family 2 (facilitated glucose transporter), member 11
  ENSP ID: ENSP00000485995

SEQ ID NO: 80658 - protein, 179 aa, Homo sapiens; identical to SEQ ID NO: 80645
  Payload ID: 16074
  Gene Symbol: SLC2A11
  Gene Name: solute carrier family 2 (facilitated glucose transporter), member 11
  ENSP ID: ENSP00000486767

SEQ ID NO: 80659 - protein, 113 aa, Homo sapiens; identical to SEQ ID NO: 80649
  Payload ID: 16074
  Gene Symbol: SLC2A11
  Gene Name: solute carrier family 2 (facilitated glucose transporter), member 11
  ENSP ID: ENSP00000486841

SEQ ID NO: 80660 - protein, 48 aa, Homo sapiens; identical to SEQ ID NO: 80648
  Payload ID: 16074
  Gene Symbol: SLC2A11
  Gene Name: solute carrier family 2 (facilitated glucose transporter), member 11
  ENSP ID: ENSP00000486863

SEQ ID NO: 80661 - protein, 98 aa, Homo sapiens; identical to SEQ ID NO: 80641
  Payload ID: 16074
  Gene Symbol: SLC2A11
  Gene Name: solute carrier family 2 (facilitated glucose transporter), member 11
  ENSP ID: ENSP00000487395

SEQ ID NO: 80662 - protein, 617 aa, Homo sapiens
  Payload ID: 16075
  Gene Symbol: SLC2A12
  Gene Name: solute carrier family 2 (facilitated glucose transporter), member 12
  Uniprot ID: Q8TD20
  ENSP ID: ENSP00000275230
MVPVENTEGPSLLNQKGTAVETEGSGSRHPPWARGCGMFTFLSSVTAAVSGLLVGYELGIISGALLQIKTLLALSCHEQEMVVSSLVIGALLASLTGGVLIDRYGRRTAIILSSCLLGLGSLVLILSLSYTVLIVGRIAIGVSISLSSIATCVYIAEIAPQHRRGLLVSLNELMIVIGILSAYISNYAFANVFHGWKYMFGLVIPLGVLQAIAMYFLPPSPRFLVMKGQEGAASKVLGRLRALSDTTEELTVIKSSLKDEYQYSFWDLFRSKDNMRTRIMIGLTLVFFVQITGQPNILFYASTVLKSVGFQSNEAASLASTGVGVVKVISTIPATLLVDHVGSKTFLCIGSSVMAASLVTMGIVNLNIHMNFTHICRSHNSINQSLDESVIYGPGNLSTNNNTLRDHFKGISSHSRSSLMPLRNDVDKRGETTSASLLNAGLSHTEYQIVTDPGDVPAFLKWLSLASLLVYVAAFSIGLGPMPWLVLSEIFPGGIRGRAMALTSSMNWGINLLISLTFLTVTDLIGLPWVCFIYTIMSLASLLFVVMFIPETKGCSLEQISMELAKVNYVKNNICFMSHHQEELVPKQPQKRKPQEQLLECNKLCGRGQSRQLSPET

SEQ ID NO: 80663 - protein, 648 aa, Homo sapiens
  Payload ID: 16076
  Gene Symbol: SLC2A13
  Gene Name: solute carrier family 2 (facilitated glucose transporter), member 13
  Uniprot ID: Q96QE2
  ENSP ID: ENSP00000280871
MSRKASENVEYTLRSLSSLMGERRRKQPEPDAASAAGECSLLAAAESSTSLQSAGAGGGGVGDLERAARRQFQQDETPAFVYVVAVFSALGGFLFGYDTGVVSGAMLLLKRQLSLDALWQELLVSSTVGAAAVSALAGGALNGVFGRRAAILLASALFTAGSAVLAAANNKETLLAGRLVVGLGIGIASMTVPVYIAEVSPPNLRGRLVTINTLFITGGQFFASVVDGAFSYLQKDGWRYMLGLAAVPAVIQFFGFLFLPESPRWLIQKGQTQKARRILSQMRGNQTIDEEYDSIKNNIEEEEKEVGSAGPVICRMLSYPPTRRALIVGCGLQMFQQLSGINTIMYYSATILQMSGVEDDRLAIWLASVTAFTNFIFTLVGVWLVEKVGRRKLTFGSLAGTTVALIILALGFVLSAQVSPRITFKPIAPSGQNATCTRYSYCNECMLDPDCGFCYKMNKSTVIDSSCVPVNKASTNEAAWGRCENETKFKTEDIFWAYNFCPTPYSWTALLGLILYLVFFAPGMGPMPWTVNSEIYPLWARSTGNACSSGINWIFNVLVSLTFLHTAEYLTYYGAFFLYAGFAAVGLLFIYGCLPETKGKKLEEIESLFDNRLCTCGTSDSDEGRYIEYIRVKGSNYHLSDNDASDVE

SEQ ID NO: 80664 - protein, 357 aa, Homo sapiens
  Payload ID: 16076
  Gene Symbol: SLC2A13
  Gene Name: solute carrier family 2 (facilitated glucose transporter), member 13
  ENSP ID: ENSP00000370239
MSRKASENVEYTLRSLSSLMGERRRKQPEPDAASAAGECSLLAAAESSTSLQSAGAGGGGVGDLERAARRQFQQDETPAFVYVVAVFSALGGFLFGYDTGVVSGAMLLLKRQLSLDALWQELLVSSTVGAAAVSALAGGALNGVFGRRAAILLASALFTAGSAVLAAANNKETLLAGRLVVGLGIGIASMTVPVYIAEVSPPNLRGRLVTINTLFITGGQFFASVVDGAFSYLQKDGWRYMLGLAAVPAVIQFFGFLFLPESPRWLIQKGQTQKARRILSQMRGNQTIDEEYDSIKNNIEEEEKEVGSAGPVICRMLSYPPTRRALIVGCGLQMFQQLSGINTIMYVFLSGFLLKRL

SEQ ID NO: 80665 - protein, 497 aa, Homo sapiens
  Payload ID: 16077
  Gene Symbol: SLC2A14
  Gene Name: solute carrier family 2 (facilitated glucose transporter), member 14
  Uniprot ID: Q8TDB8
  ENSP ID: ENSP00000340450
MDNRQNVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPMYIGEISPTALRGAFGTLNQLGIVIGILVAQIFGLELILGSEELWPVLLGFTILPAILQSAALPCCPESPRFLLINRKKEENATRILQRLWGTQDVSQDIQEMKDESARMSQEKQVTVLELFRVSSYRQPIIISIVLQLSQQLSGINAVFYYSTGIFKDAGVQQPIYATISAGVVNTIFTLLSLFLVERAGRRTLHMIGLGGMAFCSTLMTVSLLLKNHYNGMSFVCIGAILVFVACFEIGPGPIPWFIVAELFSQGPRPAAMAVAGCSNWTSNFLVGLLFPSAAYYLGAYVFIIFTGFLITFLAFTFFKVPETRGRTFEDITRAFEGQAHGADRSGKDGVMGMNSIEPAKETTTNV

SEQ ID NO: 80666 - protein, 520 aa, Homo sapiens
  Payload ID: 16077
  Gene Symbol: SLC2A14
  Gene Name: solute carrier family 2 (facilitated glucose transporter), member 14
  Uniprot ID: Q8TDB8
  ENSP ID: ENSP00000379834
MEFHNGGHVSGIGGFLVSLTSRMKPHTLAVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPMYIGEISPTALRGAFGTLNQLGIVIGILVAQIFGLELILGSEELWPVLLGFTILPAILQSAALPCCPESPRFLLINRKKEENATRILQRLWGTQDVSQDIQEMKDESARMSQEKQVTVLELFRVSSYRQPIIISIVLQLSQQLSGINAVFYYSTGIFKDAGVQQPIYATISAGVVNTIFTLLSLFLVERAGRRTLHMIGLGGMAFCSTLMTVSLLLKNHYNGMSFVCIGAILVFVACFEIGPGPIPWFIVAELFSQGPRPAAMAVAGCSNWTSNFLVGLLFPSAAYYLGAYVFIIFTGFLITFLAFTFFKVPETRGRTFEDITRAFEGQAHGADRSGKDGVMGMNSIEPAKETTTNV

SEQ ID NO: 80667 - protein, 497 aa, Homo sapiens; identical to SEQ ID NO: 80665
  Payload ID: 16077
  Gene Symbol: SLC2A14
  Gene Name: solute carrier family 2 (facilitated glucose transporter), member 14
  Uniprot ID: Q8TDB8
  ENSP ID: ENSP00000407287

SEQ ID NO: 80668 - protein, 120 aa, Homo sapiens
  Payload ID: 16077
  Gene Symbol: SLC2A14
  Gene Name: solute carrier family 2 (facilitated glucose transporter), member 14
  ENSP ID: ENSP00000437653
MEFHNGGHVSGIGGFLVSLTSRMKPHTLAVTPALIFAITVATIGSFQFGYNTGVINAPETIIKEFINKTLTDKANAPPSEVLLTNLWSLSVAIFSVGGMIGSFSVGLFVNRFGRRNSMLI

SEQ ID NO: 80669 - protein, 152 aa, Homo sapiens
  Payload ID: 16077
  Gene Symbol: SLC2A14
  Gene Name: solute carrier family 2 (facilitated glucose transporter), member 14
  ENSP ID: ENSP00000438312
MDNRQNVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPMYIGEISPTALR

SEQ ID NO: 80670 - protein, 161 aa, Homo sapiens
  Payload ID: 16077
  Gene Symbol: SLC2A14
  Gene Name: solute carrier family 2 (facilitated glucose transporter), member 14
  Uniprot ID: Q8TDB8
  ENSP ID: ENSP00000438484
MIGLGGMAFCSTLMTVSLLLKNHYNGMSFVCIGAILVFVACFEIGPGPIPWFIVAELFSQGPRPAAMAVAGCSNWTSNFLVGLLFPSAAYYLGAYVFIIFTGFLITFLAFTFFKVPETRGRTFEDITRAFEGQAHGADRSGKDGVMGMNSIEPAKETTTNV

SEQ ID NO: 80671 - protein, 22 aa, Homo sapiens
  Payload ID: 16077
  Gene Symbol: SLC2A14
  Gene Name: solute carrier family 2 (facilitated glucose transporter), member 14
  ENSP ID: ENSP00000438876
MDNRQNVTPALIFAITVATIGS

SEQ ID NO: 80672 - protein, 169 aa, Homo sapiens
  Payload ID: 16077
  Gene Symbol: SLC2A14
  Gene Name: solute carrier family 2 (facilitated glucose transporter), member 14
  ENSP ID: ENSP00000440043
MDNRQNVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPMYIGEISPTALRGAFGTLNQLGIVIGILV

SEQ ID NO: 80673 - protein, 141 aa, Homo sapiens
  Payload ID: 16077
  Gene Symbol: SLC2A14
  Gene Name: solute carrier family 2 (facilitated glucose transporter), member 14
  ENSP ID: ENSP00000440044
MEFHNGGHVSGIGGFLVSLTSRMKPHTLAVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESV

SEQ ID NO: 80674 - protein, 520 aa, Homo sapiens; identical to SEQ ID NO: 80666
  Payload ID: 16077
  Gene Symbol: SLC2A14
  Gene Name: solute carrier family 2 (facilitated glucose transporter), member 14
  Uniprot ID: Q8TDB8
  ENSP ID: ENSP00000440480

SEQ ID NO: 80675 - protein, 411 aa, Homo sapiens
  Payload ID: 16077
  Gene Symbol: SLC2A14
  Gene Name: solute carrier family 2 (facilitated glucose transporter), member 14
  Uniprot ID: Q8TDB8
  ENSP ID: ENSP00000440492
MLLRRRNSMLIVNLLAATGGCLMGLCKIAESVEMLILGRLVIGLFCGLCTGFVPMYIGEISPTALRGAFGTLNQLGIVIGILVAQIFGLELILGSEELWPVLLGFTILPAILQSAALPCCPESPRFLLINRKKEENATRILQRLWGTQDVSQDIQEMKDESARMSQEKQVTVLELFRVSSYRQPIIISIVLQLSQQLSGINAVFYYSTGIFKDAGVQQPIYATISAGVVNTIFTLLSLFLVERAGRRTLHMIGLGGMAFCSTLMTVSLLLKNHYNGMSFVCIGAILVFVACFEIGPGPIPWFIVAELFSQGPRPAAMAVAGCSNWTSNFLVGLLFPSAAYYLGAYVFIIFTGFLITFLAFTFFKVPETRGRTFEDITRAFEGQAHGADRSGKDGVMGMNSIEPAKETTTNV

SEQ ID NO: 80676 - protein, 38 aa, Homo sapiens
  Payload ID: 16077
  Gene Symbol: SLC2A14
  Gene Name: solute carrier family 2 (facilitated glucose transporter), member 14
  ENSP ID: ENSP00000440980
MDNRQNRQGLLVSPRLVQKGEIRTPGLKRSSRLDLQKC

SEQ ID NO: 80677 - protein, 84 aa, Homo sapiens
  Payload ID: 16077
  Gene Symbol: SLC2A14
  Gene Name: solute carrier family 2 (facilitated glucose transporter), member 14
  ENSP ID: ENSP00000442402
MDNRQNVTPALIFAITVATIGSFQFGYNTGVINAPETIIKEFINKTLTDKANAPPSEVLLTNLWSLSVAIFSVGGMIGSFSVGL

SEQ ID NO: 80678 - protein, 47 aa, Homo sapiens
  Payload ID: 16077
  Gene Symbol: SLC2A14
  Gene Name: solute carrier family 2 (facilitated glucose transporter), member 14
  ENSP ID: ENSP00000443076
MDNRQNVTPALIFAITVATIGSFQFGYNTGVINAPETIIKEFINKTL

SEQ ID NO: 80679 - protein, 141 aa, Homo sapiens
  Payload ID: 16077
  Gene Symbol: SLC2A14
  Gene Name: solute carrier family 2 (facilitated glucose transporter), member 14
  ENSP ID: ENSP00000443217
MDNRQNVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPM

SEQ ID NO: 80680 - protein, 411 aa, Homo sapiens; identical to SEQ ID NO: 80675
  Payload ID: 16077
  Gene Symbol: SLC2A14
  Gene Name: solute carrier family 2 (facilitated glucose transporter), member 14
  Uniprot ID: Q8TDB8
  ENSP ID: ENSP00000443903

SEQ ID NO: 80681 - protein, 13 aa, Homo sapiens
  Payload ID: 16077
  Gene Symbol: SLC2A14
  Gene Name: solute carrier family 2 (facilitated glucose transporter), member 14
  ENSP ID: ENSP00000444692
MDNRQNRWSFTMV

SEQ ID NO: 80682 - protein, 535 aa, Homo sapiens
  Payload ID: 16077
  Gene Symbol: SLC2A14
  Gene Name: solute carrier family 2 (facilitated glucose transporter), member 14
  Uniprot ID: Q8TDB8
  ENSP ID: ENSP00000445929
MQRLQLLRVEVLLGVKQGDEMRHFFFSSQTSTLEKSQNGGVGEEVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPMYIGEISPTALRGAFGTLNQLGIVIGILVAQIFGLELILGSEELWPVLLGFTILPAILQSAALPCCPESPRFLLINRKKEENATRILQRLWGTQDVSQDIQEMKDESARMSQEKQVTVLELFRVSSYRQPIIISIVLQLSQQLSGINAVFYYSTGIFKDAGVQQPIYATISAGVVNTIFTLLSLFLVERAGRRTLHMIGLGGMAFCSTLMTVSLLLKNHYNGMSFVCIGAILVFVACFEIGPGPIPWFIVAELFSQGPRPAAMAVAGCSNWTSNFLVGLLFPSAAYYLGAYVFIIFTGFLITFLAFTFFKVPETRGRTFEDITRAFEGQAHGADRSGKDGVMGMNSIEPAKETTTNV

SEQ ID NO: 80683 - protein, 520 aa, Homo sapiens; identical to SEQ ID NO: 80666
  Payload ID: 16077
  Gene Symbol: SLC2A14
  Gene Name: solute carrier family 2 (facilitated glucose transporter), member 14
  Uniprot ID: Q8TDB8
  ENSP ID: ENSP00000482927

SEQ ID NO: 80684 - protein, 524 aa, Homo sapiens
  Payload ID: 16078
  Gene Symbol: SLC2A2
  Gene Name: solute carrier family 2 (facilitated glucose transporter), member 2
  Uniprot ID: P11168
  ENSP ID: ENSP00000323568
MTEDKVTGTLVFTVITAVLGSFQFGYDIGVINAPQQVIISHYRHVLGVPLDDRKAINNYVINSTDELPTISYSMNPKPTPWAEEETVAAAQLITMLWSLSVSSFAVGGMTASFFGGWLGDTLGRIKAMLVANILSLVGALLMGFSKLGPSHILIIAGRSISGLYCGLISGLVPMYIGEIAPTALRGALGTFHQLAIVTGILISQIIGLEFILGNYDLWHILLGLSGVRAILQSLLLFFCPESPRYLYIKLDEEVKAKQSLKRLRGYDDVTKDINEMRKEREEASSEQKVSIIQLFTNSSYRQPILVALMLHVAQQFSGINGIFYYSTSIFQTAGISKPVYATIGVGAVNMVFTAVSVFLVEKAGRRSLFLIGMSGMFVCAIFMSVGLVLLNKFSWMSYVSMIAIFLFVSFFEIGPGPIPWFMVAEFFSQGPRPAALAIAAFSNWTCNFIVALCFQYIADFCGPYVFFLFAGVLLAFTLFTFFKVPETKGKSFEEIAAEFQKKSGSAHRPKAAVEMKFLGATETV

SEQ ID NO: 80685 - protein, 89 aa, Homo sapiens
  Payload ID: 16078
  Gene Symbol: SLC2A2
  Gene Name: solute carrier family 2 (facilitated glucose transporter), member 2
  ENSP ID: ENSP00000417918
MTEDKVTGTLVFTVITAVLGSFQFGYDIGVINAPQQNQSHVSSKHSVISWSSLDGVFKIGTISYTYNCWKKHIRTILWANFRPGSYVYR

SEQ ID NO: 80686 - protein, 135 aa, Homo sapiens
  Payload ID: 16078
  Gene Symbol: SLC2A2
  Gene Name: solute carrier family 2 (facilitated glucose transporter), member 2
  ENSP ID: ENSP00000418456
MTEDKVTGTLVFTVITAVLGSFQFGYDIGVINAPQQVIISHYRHVLGVPLDDRKAINNYVINSTDELPTISYSMNPKPTPWAEEETVAAAQLITMLWSLSVSSFAVGGMTASFFGGWLGDTLGRANFRPGSYVYR

SEQ ID NO: 80687 - protein, 103 aa, Homo sapiens
  Payload ID: 16078
  Gene Symbol: SLC2A2
  Gene Name: solute carrier family 2 (facilitated glucose transporter), member 2
  ENSP ID: ENSP00000418888
MYIGEIAPTALRGALGTFHQLAIVTGILISQIIGLEFILGNYDLWHILLGLSGVRAILQSLLLFFCPESPRYLYIKLDEEVKAKQSLKRLRGYDDVTKDINEM

SEQ ID NO: 80688 - protein, 496 aa, Homo sapiens
  Payload ID: 16079
  Gene Symbol: SLC2A3
  Gene Name: solute carrier family 2 (facilitated glucose transporter), member 3
  Uniprot ID: P11169
  ENSP ID: ENSP00000075120
MGTQKVTPALIFAITVATIGSFQFGYNTGVINAPEKIIKEFINKTLTDKGNAPPSEVLLTSLWSLSVAIFSVGGMIGSFSVGLFVNRFGRRNSMLIVNLLAVTGGCFMGLCKVAKSVEMLILGRLVIGLFCGLCTGFVPMYIGEISPTALRGAFGTLNQLGIVVGILVAQIFGLEFILGSEELWPLLLGFTILPAILQSAALPFCPESPRFLLINRKEEENAKQILQRLWGTQDVSQDIQEMKDESARMSQEKQVTVLELFRVSSYRQPIIISIVLQLSQQLSGINAVFYYSTGIFKDAGVQEPIYATIGAGVVNTIFTVVSLFLVERAGRRTLHMIGLGGMAFCSTLMTVSLLLKDNYNGMSFVCIGAILVFVAFFEIGPGPIPWFIVAELFSQGPRPAAMAVAGCSNWTSNFLVGLLFPSAAHYLGAYVFIIFTGFLITFLAFTFFKVPETRGRTFEDITRAFEGQAHGADRSGKDGVMEMNSIEPAKETTTNV

SEQ ID NO: 80689 - protein, 141 aa, Homo sapiens
  Payload ID: 16079
  Gene Symbol: SLC2A3
  Gene Name: solute carrier family 2 (facilitated glucose transporter), member 3
  ENSP ID: ENSP00000440750
MGTQKIIKEFINKTLTDKGNAPPSEVLLTSLWSLSVAIFSVGGMIGSFSVGLFVNRFGRRNSMLIVNLLAVTGGCFMGLCKVAKSVEMLILGRLVIGLFCGLCTGFVPMYIGEISPTALRGAFGTLNQLGIVVGILVAQIF

SEQ ID NO: 80690 - protein, 48 aa, Homo sapiens
  Payload ID: 16079
  Gene Symbol: SLC2A3
  Gene Name: solute carrier family 2 (facilitated glucose transporter), member 3
  ENSP ID: ENSP00000441496
MGTQKVTPALIFAITVATIGSFQFGYNTGVINAPEKSVLPPTLLFCRS

SEQ ID NO: 80691 - protein, 509 aa, Homo sapiens
  Payload ID: 16080
  Gene Symbol: SLC2A4
  Gene Name: solute carrier family 2 (facilitated glucose transporter), member 4
  Uniprot ID: P14672
  ENSP ID: ENSP00000320935
MPSGFQQIGSEDGEPPQQRVTGTLVLAVFSAVLGSLQFGYNIGVINAPQKVIEQSYNETWLGRQGPEGPSSIPPGTLTTLWALSVAIFSVGGMISSFLIGIISQWLGRKRAMLVNNVLAVLGGSLMGLANAAASYEMLILGRFLIGAYSGLTSGLVPMYVGEIAPTHLRGALGTLNQLAIVIGILIAQVLGLESLLGTASLWPLLLGLTVLPALLQLVLLPFCPESPRYLYIIQNLEGPARKSLKRLTGWADVSGVLAELKDEKRKLERERPLSLLQLLGSRTHRQPLIIAVVLQLSQQLSGINAVFYYSTSIFETAGVGQPAYATIGAGVVNTVFTLVSVLLVERAGRRTLHLLGLAGMCGCAILMTVALLLLERVPAMSYVSIVAIFGFVAFFEIGPGPIPWFIVAELFSQGPRPAAMAVAGFSNWTSNFIIGMGFQYVAEAMGPYVFLLFAVLLLGFFIFTFLRVPETRGRTFDQISAAFHRTPSLLEQEVKPSTELEYLGPDEND

SEQ ID NO: 80692 - protein, 451 aa, Homo sapiens
  Payload ID: 16080
  Gene Symbol: SLC2A4
  Gene Name: solute carrier family 2 (facilitated glucose transporter), member 4
  ENSP ID: ENSP00000396887
MDGEPPQQRVTGTLVLAVFSAVLGSLQFGYNIGVINAPQKVIEQSYNETWLGRQGPEGPSSIPPGTLTTLWALSVAIFSVGGMISSFLIGIISQWLGRKRAMLVNNVLAVLGGSLMGLANAAASYEMLILGRFLIGAYSGLTSGLVPMYVGEIAPTHLRGALGTLNQLAIVIGILIAQVLGLESLLGTASLWPLLLGLTVLPALLQLVLLPFCPESPRYLYIIQNLEGPARKSLKRLTGWADVSGVLAELKDEKRKLERERPLSLLQLLGSRTHRQPLIIAVVLQLSQQLSGINAVFYYSTSIFETAGVGQPAYATIGAGVVNTVFTLVSVLLVERAGRRTLHLLGLAGMCGCAILMTVALLLLERVPAMSYVSIVAIFGFVAFFEIGPGPIPWFIVAELFSQGPRPAAMAVAGFSNWTSNFIIGMGFQYVAVGPPAPASHTVGQRWASHS

SEQ ID NO: 80693 - protein, 219 aa, Homo sapiens
  Payload ID: 16080
  Gene Symbol: SLC2A4
  Gene Name: solute carrier family 2 (facilitated glucose transporter), member 4
  ENSP ID: ENSP00000459056
MPSGFQQIGSEDGEPPQQRVTGTLVLAVFSAVLGSLQFGYNIGVINAPQKVIEQSYNETWLGRQGPEGPSSIPPGTLTTLWALSVAIFSVGGMISSFLIGIISQWLGRKRAMLVNNVLAVLGGSLMGLANAAASYEMLILGRFLIGAYSGAGLGVPPGHCQPVATAPGPHSATCPPAAGPAALLSREPPLPLHHPESRGACQKESEAPDRLGRCFWSAG

SEQ ID NO: 80694 - protein, 461 aa, Homo sapiens
  Payload ID: 16080
  Gene Symbol: SLC2A4
  Gene Name: solute carrier family 2 (facilitated glucose transporter), member 4
  ENSP ID: ENSP00000459864
MPSGFQQIGSEDGEPPQQRVTGTLVLAVFSAVLGSLQFGYNIGVINAPQKVIEQSYNETWLGRQGPEGPSSIPPGTLTTLWALSVAIFSVGGMISSFLIGIISQWLGRKRAMLVNNVLAVLGGSLMGLANAAASYEMLILGRFLIGAYSGLTSGLVPMYVGEIAPTHLRGALGTLNQLAIVIGILIAQVLGLESLLGTASLWPLLLGLTVLPALLQLVLLPFCPESPRYLYIIQNLEGPARKSLKRLTGWADVSGVLAELKDEKRKLERERPLSLLQLLGSRTHRQPLIIAVVLQLSQQLSGINAVFYYSTSIFETAGVGQPAYATIGAGVVNTVFTLVSVLLVERAGRRTLHLLGLAGMCGCAILMTVALLLLERVPAMSYVSIVAIFGFVAFFEIGPGPIPWFIVAELFSQGPRPAAMAVAGFSNWTSNFIIGMGFQYVAVGPPAPASHTVGQRWASHS

SEQ ID NO: 80695 - protein, 415 aa, Homo sapiens
  Payload ID: 16080
  Gene Symbol: SLC2A4
  Gene Name: solute carrier family 2 (facilitated glucose transporter), member 4
  Uniprot ID: P14672
  ENSP ID: ENSP00000461086
MPSGFQQIGSEDGEPPQQRVTGTLVLAVFSAVLGSLQFGYNIGVINAPQKVIEQSYNETWLGRQGPEGPSSIPPGTLTTLWALSVAIFSVGGMISSFLIGIISQWLGRKRAMLVNNVLAVLGGSLMGLANAAASYEMLILGRFLIGAYSGLTSGLVPMYVGEIAPTHLRGALGTLNQLAIVIGILIAQVLGLESLLGTASLWPLLLGLTVLPALLQLVLLPFCPESPRYLYIIQNLEGPARKSLKRLTGWADVSGVLAELKDEKRKLERERPLSLLQLLGSRTHRQPLIIAVVLQLSQQLSGINAVFYYSTSIFETAGVGQPAYATIGAGVVNTVFTLVSVTAHLWNGPSHWLHLPGCPGGVVGGAGGAPDAPSPGPGGHVWLCHPDDCGSAPAGASSSHELRLHCGHLWLRGIF

SEQ ID NO: 80696 - protein, 445 aa, Homo sapiens
  Payload ID: 16081
  Gene Symbol: SLC2A6
  Gene Name: solute carrier family 2 (facilitated glucose transporter), member 6
  Uniprot ID: Q9UGQ3
  ENSP ID: ENSP00000360964
MQEPLLGAEGPDYDTFPEKPPPSPGDRARVGTLQNKRVFLATFAAVLGNFSFGYALVYTSPVIPALERSLDPDLHLTKSQASWFGSVFTLGAAAGGLSAMILNDLLGRKLSIMFSAVPSAAGYALMAGAHGLWMLLLGRTLTGFAGGLTAACIPVYVSEIAPPGVRGALGATPQLMAVFGSLSLYALGLLLPWRWLAVAGEAPVLIMILLLSFMPNSPRFLLSRGRDEEALRALAWLRGTDVDVHWEFEQIQDNVRRQSSRVSWAEARAPHVCRPITVALLMRLLQQLTGITPILVYLQSIFDSTAVLLPPKDDAAIVGAVRLLSVLIAALTMDLAGRKVLLFVSGYAVGWGPITWLLMSEVLPLRARGVASGLCVLASWLTAFVLTKSFLPVVSTFGLQVPFFFFAAICLVSLVFTGCCVPETKGRSLEQIESFFRTGRRSFLR

SEQ ID NO: 80697 - protein, 507 aa, Homo sapiens
  Payload ID: 16081
  Gene Symbol: SLC2A6
  Gene Name: solute carrier family 2 (facilitated glucose transporter), member 6
  Uniprot ID: Q9UGQ3
  ENSP ID: ENSP00000360966
MQEPLLGAEGPDYDTFPEKPPPSPGDRARVGTLQNKRVFLATFAAVLGNFSFGYALVYTSPVIPALERSLDPDLHLTKSQASWFGSVFTLGAAAGGLSAMILNDLLGRKLSIMFSAVPSAAGYALMAGAHGLWMLLLGRTLTGFAGGLTAACIPVYVSEIAPPGVRGALGATPQLMAVFGSLSLYALGLLLPWRWLAVAGEAPVLIMILLLSFMPNSPRFLLSRGRDEEALRALAWLRGTDVDVHWEFEQIQDNVRRQSSRVSWAEARAPHVCRPITVALLMRLLQQLTGITPILVYLQSIFDSTAVLLPPKDDAAIVGAVRLLSVLIAALTMDLAGRKVLLFVSAAIMFAANLTLGLYIHFGPRPLSPNSTAGLESESWGDLAQPLAAPAGYLTLVPLLATMLFIMGYAVGWGPITWLLMSEVLPLRARGVASGLCVLASWLTAFVLTKSFLPVVSTFGLQVPFFFFAAICLVSLVFTGCCVPETKGRSLEQIESFFRTGRRSFLR

SEQ ID NO: 80698 - protein, 146 aa, Homo sapiens
  Payload ID: 16081
  Gene Symbol: SLC2A6
  Gene Name: solute carrier family 2 (facilitated glucose transporter), member 6
  ENSP ID: ENSP00000398004
MILNDLLGRKLSIMFSAVPSAAGYALMAGAHGLWMLLLGRTLTGFAGGLTAACIPGLTLPSRPGLGTSIFSKTWCGGCVLQVYVSEIAPPGVRGALGATPQLMAVFGSLSLYALGKDEEALRALAWLRGTDVDVHWEFEQIQDNVR

SEQ ID NO: 80699 - protein, 219 aa, Homo sapiens
  Payload ID: 16081
  Gene Symbol: SLC2A6
  Gene Name: solute carrier family 2 (facilitated glucose transporter), member 6
  ENSP ID: ENSP00000405124
MQEPLLGAEGPDYDTFPEKPPPSPGDRARVGTLQNKRVFLATFAAVLGNFSFGYALVYTSPVIPALERSLDPDLHLTKSQASWFGSVFTLGAAAGGLSAMILNDLLGRKLSIMFSAVPSAAGYALMAGAHGLWMLLLGRTLTGFAGGLTAACIPVYVSEIAPPGVRGALGATPQLMAVFGSLSLYALGTKRPCGRWPGCVGRTSMSTGSSSRSRTTSGD

SEQ ID NO: 80700 - protein, 445 aa, Homo sapiens; identical to SEQ ID NO: 80696
  Payload ID: 16081
  Gene Symbol: SLC2A6
  Gene Name: Solute carrier family 2 (facilitated glucose transporter), member 6
  ENSP ID: ENSP00000486637

SEQ ID NO: 80701 - protein, 219 aa, Homo sapiens; identical to SEQ ID NO: 80699
  Payload ID: 16081
  Gene Symbol: SLC2A6
  Gene Name: Solute carrier family 2 (facilitated glucose transporter), member 6
  ENSP ID: ENSP00000486716

SEQ ID NO: 80702 - protein, 507 aa, Homo sapiens; identical to SEQ ID NO: 80697
  Payload ID: 16081
  Gene Symbol: SLC2A6
  Gene Name: Solute carrier family 2 (facilitated glucose transporter), member 6
  ENSP ID: ENSP00000487067

SEQ ID NO: 80703 - protein, 146 aa, Homo sapiens; identical to SEQ ID NO: 80698
  Payload ID: 16081
  Gene Symbol: SLC2A6
  Gene Name: Solute carrier family 2 (facilitated glucose transporter), member 6
  ENSP ID: ENSP00000487571

SEQ ID NO: 80704 - protein, 512 aa, Homo sapiens
  Payload ID: 16082
  Gene Symbol: SLC2A7
  Gene Name: solute carrier family 2 (facilitated glucose transporter), member 7
  Uniprot ID: Q6PXP3
  ENSP ID: ENSP00000383698
MENKEAGTPPPIPSREGRLQPTLLLATLSAAFGSAFQYGYNLSVVNTPHKVFKSFYNETYFERHATFMDGKLMLLLWSCTVSMFPLGGLLGSLLVGLLVDSCGRKGTLLINNIFAIIPAILMGVSKVAKAFELIVFSRVVLGVCAGISYSALPMYLGELAPKNLRGMVGTMTEVFVIVGVFLAQIFSLQAILGNPAGWPVLLALTGVPALLQLLTLPFFPESPRYSLIQKGDEATARQALRRLRGHTDMEAELEDMRAEARAERAEGHLSVLHLCALRSLRWQLLSIIVLMAGQQLSGINAINYYADTIYTSAGVEAAHSQYVTVGSGVVNIVMTITSAVLVERLGRRHLLLAGYGICGSACLVLTVVLLFQNRVPELSYLGIICVFAYIAGHSIGPSPVPSVVRTEIFLQSSRRAAFMVDGAVHWLTNFIIGFLFPSIQEAIGAYSFIIFAGICLLTAIYIYVVIPETKGKTFVEINRIFAKRNRVKLPEEKEETIDAGPPTASPAKETSF

SEQ ID NO: 80705 - protein, 214 aa, Homo sapiens
  Payload ID: 16083
  Gene Symbol: SLC2A8
  Gene Name: solute carrier family 2 (facilitated glucose transporter), member 8
  ENSP ID: ENSP00000362450
MAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEFSSLMEVLRPYGAFWLASAFCIFSVLFTLFCVPETKGKTLEQITAHFEGR

SEQ ID NO: 80706 - protein, 411 aa, Homo sapiens
  Payload ID: 16083
  Gene Symbol: SLC2A8
  Gene Name: solute carrier family 2 (facilitated glucose transporter), member 8
  ENSP ID: ENSP00000362458
MTPEDPEETQPLLGPPGGSAPRGRRVFLAAFAAALGPLSFGFALGYSSPAIPSLQRAAPPAPRLDDAAASWFGAVVTLGAAAGGVLGGWLVDRAGRKLSLLLCSVPFVAGFAVITAAQDVWMLLGGRLLTGLACGVASLVAPVYISEIAYPAVRGLLGSCVQLMVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGGPQALWSLLACLRFLHLQCPFHFVLCP

SEQ ID NO: 80707 - protein, 477 aa, Homo sapiens
  Payload ID: 16083
  Gene Symbol: SLC2A8
  Gene Name: solute carrier family 2 (facilitated glucose transporter), member 8
  Uniprot ID: Q9NY64
  ENSP ID: ENSP00000362469
MTPEDPEETQPLLGPPGGSAPRGRRVFLAAFAAALGPLSFGFALGYSSPAIPSLQRAAPPAPRLDDAAASWFGAVVTLGAAAGGVLGGWLVDRAGRKLSLLLCSVPFVAGFAVITAAQDVWMLLGGRLLTGLACGVASLVAPVYISEIAYPAVRGLLGSCVQLMVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEFSSLMEVLRPYGAFWLASAFCIFSVLFTLFCVPETKGKTLEQITAHFEGR

SEQ ID NO: 80708 - protein, 267 aa, Homo sapiens
  Payload ID: 16083
  Gene Symbol: SLC2A8
  Gene Name: solute carrier family 2 (facilitated glucose transporter), member 8
  ENSP ID: ENSP00000389070
MTCSLGKVYISEIAYPAVRGLLGSCVQLMVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFP

SEQ ID NO: 80709 - protein, 276 aa, Homo sapiens
  Payload ID: 16083
  Gene Symbol: SLC2A8
  Gene Name: solute carrier family 2 (facilitated glucose transporter), member 8
  ENSP ID: ENSP00000391213
QLMVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEFSSLMLLLLL

SEQ ID NO: 80710 - protein, 265 aa, Homo sapiens
  Payload ID: 16083
  Gene Symbol: SLC2A8
  Gene Name: solute carrier family 2 (facilitated glucose transporter), member 8
  ENSP ID: ENSP00000392434
MVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEF

SEQ ID NO: 80711 - protein, 241 aa, Homo sapiens
  Payload ID: 16083
  Gene Symbol: SLC2A8
  Gene Name: solute carrier family 2 (facilitated glucose transporter), member 8
  ENSP ID: ENSP00000404893
MTCSLGKVYISEIAYPAVRGLLGSCVQLMVVVGILLAYLAGWVLEWRWLAVLGCVPPSLMLLLMCFMPETPRFLLTQHRRQEAMAALRFLWGSEQGWEDPPIGAEQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFP

SEQ ID NO: 80712 - protein, 256 aa, Homo sapiens
  Payload ID: 16083
  Gene Symbol: SLC2A8
  Gene Name: solute carrier family 2 (facilitated glucose transporter), member 8
  ENSP ID: ENSP00000411726
MTPEDPEETQPLLGPPGGSAPRGRRVFLAAFAAALGPLSFGFALGYSSPAIPSLQRAAPPAPRLDDAAASWFGVYISEIAYPAVRGLLGSCVQLMVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLS

SEQ ID NO: 80713 - protein, 169 aa, Homo sapiens
  Payload ID: 16083
  Gene Symbol: SLC2A8
  Gene Name: solute carrier family 2 (facilitated glucose transporter), member 8
  ENSP ID: ENSP00000413973
  MOD_RES (1)..(1): Any amino acid
XGRRVFLAAFAAALGPLSFGFALGYSSPAIPSLQRAAPPAPRLDDAAASWFGVYISEIAYPAVRGLLGSCVQLMVVVGILLAYLAGWVLEWRWLAVLGCVPPSLMLLLMCFMPETPRFLLTQHRRQEAMAALRFLWGSEQGWEDPPIGAEQQLSGVNAVMFYAETIFEE

SEQ ID NO: 80714 - protein, 314 aa, Homo sapiens
  Payload ID: 16083
  Gene Symbol: SLC2A8
  Gene Name: solute carrier family 2 (facilitated glucose transporter), member 8
  ENSP ID: ENSP00000477568
MVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEFSSLMEVLRPYGAFWLASAFCIFSVLFTLFCVPETKGKTLEQITAHFEGR

SEQ ID NO: 80715 - protein, 540 aa, Homo sapiens
  Payload ID: 16084
  Gene Symbol: SLC2A9
  Gene Name: solute carrier family 2 (facilitated glucose transporter), member 9
  Uniprot ID: Q9NRM0
  ENSP ID: ENSP00000264784
MARKQNRNSKELGLVPLTDDTSHAGPPGPGRALLECDHLRSGVPGGRRRKDWSCSLLVASLAGAFGSSFLYGYNLSVVNAPTPYIKAFYNESWERRHGRPIDPDTLTLLWSVTVSIFAIGGLVGTLIVKMIGKVLGRKHTLLANNGFAISAALLMACSLQAGAFEMLIVGRFIMGIDGGVALSVLPMYLSEISPKEIRGSLGQVTAIFICIGVFTGQLLGLPELLGKESTWPYLFGVIVVPAVVQLLSLPFLPDSPRYLLLEKHNEARAVKAFQTFLGKADVSQEVEEVLAESRVQRSIRLVSVLELLRAPYVRWQVVTVIVTMACYQLCGLNAIWFYTNSIFGKAGIPPAKIPYVTLSTGGIETLAAVFSGLVIEHLGRRPLLIGGFGLMGLFFGTLTITLTLQDHAPWVPYLSIVGILAIIASFCSGPGGIPFILTGEFFQQSQRPAAFIIAGTVNWLSNFAVGLLFPFIQKSLDTYCFLVFATICITGAIYLYFVLPETKNRTYAEISQAFSKRNKAYPPEEKIDSAVTDGKINGRP

SEQ ID NO: 80716 - protein, 511 aa, Homo sapiens
  Payload ID: 16084
  Gene Symbol: SLC2A9
  Gene Name: solute carrier family 2 (facilitated glucose transporter), member 9
  Uniprot ID: Q9NRM0
  ENSP ID: ENSP00000311383
MKLSKKDRGEDEESDSAKKKLDWSCSLLVASLAGAFGSSFLYGYNLSVVNAPTPYIKAFYNESWERRHGRPIDPDTLTLLWSVTVSIFAIGGLVGTLIVKMIGKVLGRKHTLLANNGFAISAALLMACSLQAGAFEMLIVGRFIMGIDGGVALSVLPMYLSEISPKEIRGSLGQVTAIFICIGVFTGQLLGLPELLGKESTWPYLFGVIVVPAVVQLLSLPFLPDSPRYLLLEKHNEARAVKAFQTFLGKADVSQEVEEVLAESRVQRSIRLVSVLELLRAPYVRWQVVTVIVTMACYQLCGLNAIWFYTNSIFGKAGIPPAKIPYVTLSTGGIETLAAVFSGLVIEHLGRRPLLIGGFGLMGLFFGTLTITLTLQDHAPWVPYLSIVGILAIIASFCSGPGGIPFILTGEFFQQSQRPAAFIIAGTVNWLSNFAVGLLFPFIQKSLDTYCFLVFATICITGAIYLYFVLPETKNRTYAEISQAFSKRNKAYPPEEKIDSAVTDGKINGRP

SEQ ID NO: 80717 - protein, 511 aa, Homo sapiens; identical to SEQ ID NO: 80716
  Payload ID: 16084
  Gene Symbol: SLC2A9
  Gene Name: solute carrier family 2 (facilitated glucose transporter), member 9
  Uniprot ID: Q9NRM0
  ENSP ID: ENSP00000422209

SEQ ID NO: 80718 - protein, 198 aa, Homo sapiens
  Payload ID: 16084
  Gene Symbol: SLC2A9
  Gene Name: solute carrier family 2 (facilitated glucose transporter), member 9
  ENSP ID: ENSP00000426800
MKLSKKDRGEDEESDSAKKKLDWSCSLLVASLAGAFGSSFLYGYNLSVVNAPTPYIKAFYNESWERRHGRPIDPDTLTLLWSVTVSIFAIGGLVGTLIVKMIGKVLGRKHTLLANNGFAISAALLMACSLQAGAFEMLIVGRFIMGIDGGVALSVLPMYLSEISPKEIRGSLGQVTAIFICIGVFTGQLLGLPELLGK

SEQ ID NO: 80719 - protein, 244 aa, Homo sapiens
  Payload ID: 16085
  Gene Symbol: SLC2A5
  Gene Name: solute carrier family 2 (facilitated glucose/fructose transporter), member 5
  Uniprot ID: P22732
  ENSP ID: ENSP00000366631
MEQQDQSMKEGRLTLVLALATLIAAFGSSFQYGYNVAAVNSPALLMQQFYNETYYGRTGEFMEDFPLTLLWSVTVSMFPFGGFIGSLLVGPLVNKFGRKGALLFNNIFSIVPAILMGCSRVATSFELIIISRLLVGICAGVSSNVVPMYLGELAPKNLRGALGVVPQLFITVGILVAQIFGLRNLLANVDGEFRTSREHPHPFTTTLGPLLVFQSHHHRTGLSADWSLLTGWMSLGGPSCPEPT

SEQ ID NO: 80720 - protein, 501 aa, Homo sapiens
  Payload ID: 16085
  Gene Symbol: SLC2A5
  Gene Name: solute carrier family 2 (facilitated glucose/fructose transporter), member 5
  Uniprot ID: P22732
  ENSP ID: ENSP00000366641
MEQQDQSMKEGRLTLVLALATLIAAFGSSFQYGYNVAAVNSPALLMQQFYNETYYGRTGEFMEDFPLTLLWSVTVSMFPFGGFIGSLLVGPLVNKFGRKGALLFNNIFSIVPAILMGCSRVATSFELIIISRLLVGICAGVSSNVVPMYLGELAPKNLRGALGVVPQLFITVGILVAQIFGLRNLLANVDGWPILLGLTGVPAALQLLLLPFFPESPRYLLIQKKDEAAAKKALQTLRGWDSVDREVAEIRQEDEAEKAAGFISVLKLFRMRSLRWQLLSIIVLMGGQQLSGVNAIYYYADQIYLSAGVPEEHVQYVTAGTGAVNVVMTFCAVFVVELLGRRLLLLLGFSICLIACCVLTAALALQDTVSWMPYISIVCVISYVIGHALGPSPIPALLITEIFLQSSRPSAFMVGGSVHWLSNFTVGLIFPFIQEGLGPYSFIVFAVICLLTTIYIFLIVPETKAKTFIEINQIFTKMNKVSEVYPEKEELKELPPVTSEQ

SEQ ID NO: 80721 - protein, 190 aa, Homo sapiens
  Payload ID: 16085
  Gene Symbol: SLC2A5
  Gene Name: solute carrier family 2 (facilitated glucose/fructose transporter), member 5
  ENSP ID: ENSP00000464880
MEQQDQSMKEGRLTLVLALATLIAAFGSSFQYGYNVAAVNSPALLMQQFYNETYYGRTGEFMEDFPLTLLWSVTVSMFPFGGFIGSLLVGPLVNKFGRKGALLFNNIFSIVPAILMGCSRVATSFELIIISRLLVGICAGVSSNVVPMYLGELAPKNLRGALGVVPQLFITVGILVAQIFGLRNLLANVD

SEQ ID NO: 80722 - protein, 81 aa, Homo sapiens
  Payload ID: 16085
  Gene Symbol: SLC2A5
  Gene Name: solute carrier family 2 (facilitated glucose/fructose transporter), member 5
  ENSP ID: ENSP00000465285
MEQQDQSMKEGRLTLVLALATLIAAFGSSFQYGYNVAAVNSPALLMQQFYNETYYGRTGEFMEDFPLTLLWSVTVSMFPFG

SEQ ID NO: 80723 - protein, 166 aa, Homo sapiens
  Payload ID: 16085
  Gene Symbol: SLC2A5
  Gene Name: solute carrier family 2 (facilitated glucose/fructose transporter), member 5
  ENSP ID: ENSP00000465382
MEQQDQSMKEGRLTLVLALATLIAAFGSSFQYGYNVAAVNSPALLMQQFYNETYYGRTGEFMEDFPLTLLWSVTVSMFPFGGFIGSLLVGPLVNKFGRKGALLFNNIFSIVPAILMGCSRVATSFELIIISRLLVGICAGVSSNVVPMYLGELAPKNLRGALGVVP

SEQ ID NO: 80724 - protein, 190 aa, Homo sapiens; identical to SEQ ID NO: 80721
  Payload ID: 16085
  Gene Symbol: SLC2A5
  Gene Name: solute carrier family 2 (facilitated glucose/fructose transporter), member 5
  ENSP ID: ENSP00000465507

SEQ ID NO: 80725 - protein, 190 aa, Homo sapiens; identical to SEQ ID NO: 80721
  Payload ID: 16085
  Gene Symbol: SLC2A5
  Gene Name: solute carrier family 2 (facilitated glucose/fructose transporter), member 5
  ENSP ID: ENSP00000467039

SEQ ID NO: 80726 - protein, 139 aa, Homo sapiens
  Payload ID: 16085
  Gene Symbol: SLC2A5
  Gene Name: solute carrier family 2 (facilitated glucose/fructose transporter), member 5
  ENSP ID: ENSP00000467840
MEQQDQSMKEGRLTLVLALATLIAAFGSSFQYGYNVAAVNSPALLMQQFYNETYYGRTGEFMEDFPLTLLWSVTVSMFPFGGFIGSLLVGPLVNKFGRKGALLFNNIFSIVPAILMGCSRVATSFELIIISRLLVGICA

SEQ ID NO: 80727 - protein, 190 aa, Homo sapiens; identical to SEQ ID NO: 80721
  Payload ID: 16085
  Gene Symbol: SLC2A5
  Gene Name: solute carrier family 2 (facilitated glucose/fructose transporter), member 5
  ENSP ID: ENSP00000468590

SEQ ID NO: 80728 - protein, 679 aa, Homo sapiens
  Payload ID: 16086
  Gene Symbol: SLC20A1
  Gene Name: solute carrier family 20 (phosphate transporter), member 1
  Uniprot ID: Q8WUM9
  ENSP ID: ENSP00000272542
MATLITSTTAATAASGPLVDYLWMLILGFIIAFVLAFSVGANDVANSFGTAVGSGVVTLKQACILASIFETVGSVLLGAKVSETIRKGLIDVEMYNSTQGLLMAGSVSAMFGSAVWQLVASFLKLPISGTHCIVGATIGFSLVAKGQEGVKWSELIKIVMSWFVSPLLSGIMSGILFFLVRAFILHKADPVPNGLRALPVFYACTVGINLFSIMYTGAPLLGFDKLPLWGTILISVGCAVFCALIVWFFVCPRMKRKIEREIKCSPSESPLMEKKNSLKEDHEETKLSVGDIENKHPVSEVGPATVPLQAVVEERTVSFKLGDLEEAPERERLPSVDLKEETSIDSTVNGAVQLPNGNLVQFSQAVSNQINSSGHYQYHTVHKDSGLYKELLHKLHLAKVGDCMGDSGDKPLRRNNSYTSYTMAICGMPLDSFRAKEGEQKGEEMEKLTWPNADSKKRIRMDSYTSYCNAVSDLHSASEIDMSVKAEMGLGDRKGSNGSLEEWYDQDKPEVSLLFQFLQILTACFGSFAHGGNDVSNAIGPLVALYLVYDTGDVSSKVATPIWLLLYGGVGICVGLWVWGRRVIQTMGKDLTPITPSSGFSIELASALTVVIASNIGLPISTTHCKVGSVVSVGWLRSKKAVDWRLFRNIFMAWFVTVPISGVISAAIMAIFRYVILRM

SEQ ID NO: 80729 - protein, 213 aa, Homo sapiens
  Payload ID: 16086
  Gene Symbol: SLC20A1
  Gene Name: solute carrier family 20 (phosphate transporter), member 1
  ENSP ID: ENSP00000390021
  MOD_RES (1)..(1): Any amino acid
XLFFLVRAFILHKADPVPNGLRALPVFYACTVGINLFSIMYTGAPLLGFDKLPLWGTILISVGCAVFCALIVWFFVCPRMKRKIERPATVPLQAVVEERTVSFKLGDLEEAPERERLPSVDLKEETSIDSTVNGAVQLPNGNLVQFSQAVSNQINSSGHYQYHTVHKDSGLYKELLHKLHLAKVGDCMGDSGDKPLRRNNSYTSYTMAICGMP

SEQ ID NO: 80730 - protein, 89 aa, Homo sapiens
  Payload ID: 16086
  Gene Symbol: SLC20A1
  Gene Name: solute carrier family 20 (phosphate transporter), member 1
  ENSP ID: ENSP00000392050
  MOD_RES (1)..(1): Any amino acid
XELIKIVMSWFVSPLLSGIMSGILFFLVRAFILHKADPVPNGLRALPVFYACTVGINLFSIMYTGAPWLKSPRRWLACAHFRRLQASVR

SEQ ID NO: 80731 - protein, 98 aa, Homo sapiens
  Payload ID: 16086
  Gene Symbol: SLC20A1
  Gene Name: solute carrier family 20 (phosphate transporter), member 1
  ENSP ID: ENSP00000403763
  MOD_RES (1)..(1): Any amino acid
XFFLVRAFILHKADPVPNGLRALPVFYACTVGINLFSIMYTGAPWLKSPRRWLACAHFRRLQASCWALTNFLCGVPSSSRWDVQFSVPLSSGSLYVPG

SEQ ID NO: 80732 - protein, 115 aa, Homo sapiens
  Payload ID: 16086
  Gene Symbol: SLC20A1
  Gene Name: solute carrier family 20 (phosphate transporter), member 1
  ENSP ID: ENSP00000413393
RAFILHKADPVPNGLRALPVFYACTVGINLFSIMYTGAPLLGFDKLPLWGTILISVGCAVFCALIVWFFVCPRMKRKIERCGGGENSLIQTWRFGGSSREREASQRGLERGNQHR

SEQ ID NO: 80733 - protein, 652 aa, Homo sapiens
  Payload ID: 16087
  Gene Symbol: SLC20A2
  Gene Name: solute carrier family 20 (phosphate transporter), member 2
  Uniprot ID: Q08357
  ENSP ID: ENSP00000340465
MAMDEYLWMVILGFIIAFILAFSVGANDVANSFGTAVGSGVVTLRQACILASIFETTGSVLLGAKVGETIRKGIIDVNLYNETVETLMAGEVSAMVGSAVWQLIASFLRLPISGTHCIVGSTIGFSLVAIGTKGVQWMELVKIVASWFISPLLSGFMSGLLFVLIRIFILKKEDPVPNGLRALPVFYAATIAINVFSIMYTGAPVLGLVLPMWAIALISFGVALLFAFFVWLFVCPWMRRKITGKLQKEGALSRVSDESLSKVQEAESPVFKELPGAKANDDSTIPLTGAAGETLGTSEGTSAGSHPRAAYGRALSMTHGSVKSPISNGTFGFDGHTRSDGHVYHTVHKDSGLYKDLLHKIHIDRGPEEKPAQESNYRLLRRNNSYTCYTAAICGLPVHATFRAADSSAPEDSEKLVGDTVSYSKKRLRYDSYSSYCNAVAEAEIEAEEGGVEMKLASELADPDQPREDPAEEEKEEKDAPEVHLLFHFLQVLTACFGSFAHGGNDVSNAIGPLVALWLIYKQGGVTQEAATPVWLLFYGGVGICTGLWVWGRRVIQTMGKDLTPITPSSGFTIELASAFTVVIASNIGLPVSTTHCKVGSVVAVGWIRSRKAVDWRLFRNIFVAWFVTVPVAGLFSAAVMALLMYGILPYV

SEQ ID NO: 80734 - protein, 70 aa, Homo sapiens
  Payload ID: 16087
  Gene Symbol: SLC20A2
  Gene Name: solute carrier family 20 (phosphate transporter), member 2
  ENSP ID: ENSP00000427756
MAMDEYLWMVILGFIIAFILAFSVGANDVANSFGTAVGSGVVTLRQACILASIFETTGSVLLGAKVGETI

SEQ ID NO: 80735 - protein, 47 aa, Homo sapiens
  Payload ID: 16087
  Gene Symbol: SLC20A2
  Gene Name: solute carrier family 20 (phosphate transporter), member 2
  ENSP ID: ENSP00000429299
MAMDEYLWMVILGFIIAFILAFSVGANDVANSFGTAVGSGVVTLRQA

SEQ ID NO: 80736 - protein, 652 aa, Homo sapiens; identical to SEQ ID NO: 80733
  Payload ID: 16087
  Gene Symbol: SLC20A2
  Gene Name: solute carrier family 20 (phosphate transporter), member 2
  Uniprot ID: Q08357
  ENSP ID: ENSP00000429712

SEQ ID NO: 80737 - protein, 652 aa, Homo sapiens; identical to SEQ ID NO: 80733
  Payload ID: 16087
  Gene Symbol: SLC20A2
  Gene Name: solute carrier family 20 (phosphate transporter), member 2
  Uniprot ID: Q08357
  ENSP ID: ENSP00000429754

SEQ ID NO: 80738 - protein, 105 aa, Homo sapiens
  Payload ID: 16087
  Gene Symbol: SLC20A2
  Gene Name: solute carrier family 20 (phosphate transporter), member 2
  ENSP ID: ENSP00000429989
MAMDEYLWMVILGFIIAFILAFSVGANDVANSFGTAVGSGVVTLRQACILASIFETTGSVLLGAKVGETIRKGIIDVNLYNETVETLMAGEVSAMVGRDDDTTDS

SEQ ID NO: 80739 - protein, 78 aa, Homo sapiens
  Payload ID: 16087
  Gene Symbol: SLC20A2
  Gene Name: solute carrier family 20 (phosphate transporter), member 2
  ENSP ID: ENSP00000430166
MAMDEYLWMVILGFIIAFILAFSVGANDVANSFGTAVGSGVVTLRQACILASIFETTGSVLLGAKVGETIRKGIIDVN

SEQ ID NO: 80740 - protein, 28 aa, Homo sapiens
  Payload ID: 16087
  Gene Symbol: SLC20A2
  Gene Name: solute carrier family 20 (phosphate transporter), member 2
  ENSP ID: ENSP00000430462
MAMDEYLWMVILGFIIAFILAFSVGAND

SEQ ID NO: 80741 - protein, 550 aa, Homo sapiens
  Payload ID: 16088
  Gene Symbol: SLC22A6
  Gene Name: solute carrier family 22 (organic anion transporter), member 6
  Uniprot ID: Q4U2R8
  ENSP ID: ENSP00000353597
MAFNDLLQQVGGVGRFQQIQVTLVVLPLLLMASHNTLQNFTAAIPTHHCRPPADANLSKNGGLEVWLPRDRQGQPESCLRFTSPQWGLPFLNGTEANGTGATEPCTDGWIYDNSTFPSTIVTEWDLVCSHRALRQLAQSLYMVGVLLGAMVFGYLADRLGRRKVLILNYLQTAVSGTCAAFAPNFPIYCAFRLLSGMALAGISLNCMTLNVEWMPIHTRACVGTLIGYVYSLGQFLLAGVAYAVPHWRHLQLLVSAPFFAFFIYSWFFIESARWHSSSGRLDLTLRALQRVARINGKREEGAKLSMEVLRASLQKELTMGKGQASAMELLRCPTLRHLFLCLSMLWFATSFAYYGLVMDLQGFGVSIYLIQVIFGAVDLPAKLVGFLVINSLGRRPAQMAALLLAGICILLNGVIPQDQSIVRTSLAVLGKGCLAASFNCIFLYTGELYPTMIRQTGMGMGSTMARVGSIVSPLVSMTAELYPSMPLFIYGAVPVAASAVTVLLPETLGQPLPDTVQDLESRKGKQTRQQQEHQKYMVPLQASAQEKNGL

SEQ ID NO: 80742 - protein, 563 aa, Homo sapiens
  Payload ID: 16088
  Gene Symbol: SLC22A6
  Gene Name: solute carrier family 22 (organic anion transporter), member 6
  Uniprot ID: Q4U2R8
  ENSP ID: ENSP00000367102
MAFNDLLQQVGGVGRFQQIQVTLVVLPLLLMASHNTLQNFTAAIPTHHCRPPADANLSKNGGLEVWLPRDRQGQPESCLRFTSPQWGLPFLNGTEANGTGATEPCTDGWIYDNSTFPSTIVTEWDLVCSHRALRQLAQSLYMVGVLLGAMVFGYLADRLGRRKVLILNYLQTAVSGTCAAFAPNFPIYCAFRLLSGMALAGISLNCMTLNVEWMPIHTRACVGTLIGYVYSLGQFLLAGVAYAVPHWRHLQLLVSAPFFAFFIYSWFFIESARWHSSSGRLDLTLRALQRVARINGKREEGAKLSMEVLRASLQKELTMGKGQASAMELLRCPTLRHLFLCLSMLWFATSFAYYGLVMDLQGFGVSIYLIQVIFGAVDLPAKLVGFLVINSLGRRPAQMAALLLAGICILLNGVIPQDQSIVRTSLAVLGKGCLAASFNCIFLYTGELYPTMIRQTGMGMGSTMARVGSIVSPLVSMTAELYPSMPLFIYGAVPVAASAVTVLLPETLGQPLPDTVQDLESRWAPTQKEAGIYPRKGKQTRQQQEHQKYMVPLQASAQEKNGL

SEQ ID NO: 80743 - protein, 506 aa, Homo sapiens
  Payload ID: 16088
  Gene Symbol: SLC22A6
  Gene Name: solute carrier family 22 (organic anion transporter), member 6
  Uniprot ID: Q4U2R8
  ENSP ID: ENSP00000396401
MAFNDLLQQVGGVGRFQQIQVTLVVLPLLLMASHNTLQNFTAAIPTHHCRPPADANLSKNGGLEVWLPRDRQGQPESCLRFTSPQWGLPFLNGTEANGTGATEPCTDGWIYDNSTFPSTIVTEWDLVCSHRALRQLAQSLYMVGVLLGAMVFGYLADRLGRRKVLILNYLQTAVSGTCAAFAPNFPIYCAFRLLSGMALAGISLNCMTLNVEWMPIHTRACVGTLIGYVYSLGQFLLAGVAYAVPHWRHLQLLVSAPFFAFFIYSWFFIESARWHSSSGRLDLTLRALQRVARINGKREEGAKLSMEVLRASLQKELTMGKGQASAMELLRCPTLRHLFLCLSMLWFATSFAYYGLVMDLQGFGVSIYLIQVIFGAVDLPAKLVGFLVINSLGRRPAQMAALLLAGICILLNGVIPQDQSIVRTSLAVLGKGCLAASFNCIFLYTGELYPTMIRAVTVLLPETLGQPLPDTVQDLESRKGKQTRQQQEHQKYMVPLQASAQEKNGL

SEQ ID NO: 80744 - protein, 519 aa, Homo sapiens
  Payload ID: 16088
  Gene Symbol: SLC22A6
  Gene Name: solute carrier family 22 (organic anion transporter), member 6
  Uniprot ID: Q4U2R8
  ENSP ID: ENSP00000404441
MAFNDLLQQVGGVGRFQQIQVTLVVLPLLLMASHNTLQNFTAAIPTHHCRPPADANLSKNGGLEVWLPRDRQGQPESCLRFTSPQWGLPFLNGTEANGTGATEPCTDGWIYDNSTFPSTIVTEWDLVCSHRALRQLAQSLYMVGVLLGAMVFGYLADRLGRRKVLILNYLQTAVSGTCAAFAPNFPIYCAFRLLSGMALAGISLNCMTLNVEWMPIHTRACVGTLIGYVYSLGQFLLAGVAYAVPHWRHLQLLVSAPFFAFFIYSWFFIESARWHSSSGRLDLTLRALQRVARINGKREEGAKLSMEVLRASLQKELTMGKGQASAMELLRCPTLRHLFLCLSMLWFATSFAYYGLVMDLQGFGVSIYLIQVIFGAVDLPAKLVGFLVINSLGRRPAQMAALLLAGICILLNGVIPQDQSIVRTSLAVLGKGCLAASFNCIFLYTGELYPTMIRAVTVLLPETLGQPLPDTVQDLESRWAPTQKEAGIYPRKGKQTRQQQEHQKYMVPLQASAQEKNGL

SEQ ID NO: 80745 - protein, 261 aa, Homo sapiens
  Payload ID: 16088
  Gene Symbol: SLC22A6
  Gene Name: solute carrier family 22 (organic anion transporter), member 6
  ENSP ID: ENSP00000445946
MAFNDLLQQVGGVGRFQQIQVTLVVLPLLLMASHNTLQNFTAAIPTHHCRPPADANLSKNGGLEVWLPRDRQGQPESCLRFTSPQWGLPFLNGTEANGTGATEPCTDGWIYDNSTFPSTIVTEGPTPAGPVLVHGGGAARSHGVRLPCRQARPPEGTHLELPADSCVRDLRSLRTQLPHLLRLPAPLGHGSGWHLPQLHDTECGVDAHSHTGLRGHLDWLCLQPGPVPPGWCGLRCAPLAPPAATGLCAFFCLLHLLLVLH

SEQ ID NO: 80746 - protein, 539 aa, Homo sapiens
  Payload ID: 16089
  Gene Symbol: SLC22A7
  Gene Name: solute carrier family 22 (organic anion transporter), member 7
  Uniprot ID: Q9Y694
  ENSP ID: ENSP00000361655
MGFEELLEQVGGFGPFQLRNVALLALPRVLLPLHFLLPIFLAAVPAHRCALPGAPANFSHQDVWLEAHLPREPDGTLSSCLRFAYPQALPNTTLGEERQSRGELEDEPATVPCSQGWEYDHSEFSSTIATEWDLVCEQKGLNRAASTFFFAGVLVGAVAFGYLSDRFGRRRLLLVAYVSTLVLGLASAASVSYVMFAITRTLTGSALAGFTIIVMPLELEWLDVEHRTVAGVLSSTFWTGGVMLLALVGYLIRDWRWLLLAVTLPCAPGILSLWWVPESARWLLTQGHVKEAHRYLLHCARLNGRPVCEDSFSQEAVSKVAAGERVVRRPSYLDLFRTPRLRHISLCCVVVWFGVNFSYYGLSLDVSGLGLNVYQTQLLFGAVELPSKLLVYLSVRYAGRRLTQAGTLLGTALAFGTRLLVSSDMKSWSTVLAVMGKAFSEAAFTTAYLFTSELYPTVLRQTGMGLTALVGRLGGSLAPLAALLDGVWLSLPKLTYGGIALLAAGTALLLPETRQAQLPETIQDVERKRCVHRTVSVYV

SEQ ID NO: 80747 - protein, 548 aa, Homo sapiens
  Payload ID: 16089
  Gene Symbol: SLC22A7
  Gene Name: solute carrier family 22 (organic anion transporter), member 7
  Uniprot ID: Q9Y694
  ENSP ID: ENSP00000361666
MGFEELLEQVGGFGPFQLRNVALLALPRVLLPLHFLLPIFLAAVPAHRCALPGAPANFSHQDVWLEAHLPREPDGTLSSCLRFAYPQALPNTTLGEERQSRGELEDEPATVPCSQGWEYDHSEFSSTIATESQWDLVCEQKGLNRAASTFFFAGVLVGAVAFGYLSDRFGRRRLLLVAYVSTLVLGLASAASVSYVMFAITRTLTGSALAGFTIIVMPLELEWLDVEHRTVAGVLSSTFWTGGVMLLALVGYLIRDWRWLLLAVTLPCAPGILSLWWVPESARWLLTQGHVKEAHRYLLHCARLNGRPVCEDSFSQEAVSKVAAGERVVRRPSYLDLFRTPRLRHISLCCVVVWFGVNFSYYGLSLDVSGLGLNVYQTQLLFGAVELPSKLLVYLSVRYAGRRLTQAGTLLGTALAFGTRLLVSSDMKSWSTVLAVMGKAFSEAAFTTAYLFTSELYPTVLRQTGMGLTALVGRLGGSLAPLAALLDGVWLSLPKLTYGGIALLAAGTALLLPETRQAQLPETIQDVERKSAPTSLQEEEMPMKQVQN

SEQ ID NO: 80748 - protein, 546 aa, Homo sapiens
  Payload ID: 16089
  Gene Symbol: SLC22A7
  Gene Name: solute carrier family 22 (organic anion transporter), member 7
  Uniprot ID: Q9Y694
  ENSP ID: ENSP00000361670
MGFEELLEQVGGFGPFQLRNVALLALPRVLLPLHFLLPIFLAAVPAHRCALPGAPANFSHQDVWLEAHLPREPDGTLSSCLRFAYPQALPNTTLGEERQSRGELEDEPATVPCSQGWEYDHSEFSSTIATEWDLVCEQKGLNRAASTFFFAGVLVGAVAFGYLSDRFGRRRLLLVAYVSTLVLGLASAASVSYVMFAITRTLTGSALAGFTIIVMPLELEWLDVEHRTVAGVLSSTFWTGGVMLLALVGYLIRDWRWLLLAVTLPCAPGILSLWWVPESARWLLTQGHVKEAHRYLLHCARLNGRPVCEDSFSQEAVSKVAAGERVVRRPSYLDLFRTPRLRHISLCCVVVWFGVNFSYYGLSLDVSGLGLNVYQTQLLFGAVELPSKLLVYLSVRYAGRRLTQAGTLLGTALAFGTRLLVSSDMKSWSTVLAVMGKAFSEAAFTTAYLFTSELYPTVLRQTGMGLTALVGRLGGSLAPLAALLDGVWLSLPKLTYGGIALLAAGTALLLPETRQAQLPETIQDVERKSAPTSLQEEEMPMKQVQN

SEQ ID NO: 80749 - protein, 211 aa, Homo sapiens
  Payload ID: 16089
  Gene Symbol: SLC22A7
  Gene Name: solute carrier family 22 (organic anion transporter), member 7
  ENSP ID: ENSP00000393836
MLQPHLLPYQAVSKVAAGERVVRRPSYLDLFRTPRLRHISLCCVVVWFGVNFSYYGLSLDVSGLGLNVYQTQLLFGAVELPSKLLVYLSVRYAGRRLTQAGTLLGTALAFGTRLLVSSDMKSWSTVLAVMGKAFSEAAFTTAYLFTSELYPTVLRQTGMGLTALVGRLGGSLAPLAALLDGVWLSLPKLTYGGIALLAAGTALLLPETRQA

SEQ ID NO: 80750 - protein, 278 aa, Homo sapiens
  Payload ID: 16089
  Gene Symbol: SLC22A7
  Gene Name: solute carrier family 22 (organic anion transporter), member 7
  ENSP ID: ENSP00000411818
MGFEELLEQVGGFGPFQLRNVALLALPRVLLPLHFLLPIFLAAVPAHRCALPGAPANFSHQDVWLEAHLPREPDGTLSSCLRFAYPQALPNTTLGEERQSRGELEDEPATVPCSQGWEYDHSEFSSTIATESQVGIYIIHLEVECRWRQSPWEAAGRGLPWEEAEAAGLGRDKVSYSPSWRESLGGLLSGMEWDLVCEQKGLNRAASTFFFAGVLVGAVAFGYLSDRFGRRRLLLVAYVSTLVLGLASAASVSYVMFAITRTLTGSALAGFTIIVMPL

SEQ ID NO: 80751 - protein, 147 aa, Homo sapiens
  Payload ID: 16089
  Gene Symbol: SLC22A7
  Gene Name: solute carrier family 22 (organic anion transporter), member 7
  ENSP ID: ENSP00000416052
MEWDLVCEQKGLNRAASTFFFAGVLVGAVAFGYLSDRFGRRRLLLVAYVSTLVLGLASAASVSYVMFAITRTLTGSALAGFTIIVMPLGEAELEWLDVEHRTVAGVLSSTFWTGGVMLLALVGYLIRDWRWLLLAVTLPCAPGILSL

SEQ ID NO: 80752 - protein, 235 aa, Homo sapiens
  Payload ID: 16089
  Gene Symbol: SLC22A7
  Gene Name: solute carrier family 22 (organic anion transporter), member 7
  ENSP ID: ENSP00000434707
MGFEELLEQVGGFGPFQLRNVALLALPRVLLPLHFLLPIFLAAVPAHRCALPGAPANFSHQDVWLEAHLPREPDGTLSSCLRFAYPQALPNTTLGEERQSRGELEDEPATVPCSQGWEYDHSEFSSTIATESQVGIYIIHLEVECRWRQSPWEAAGRGLPWEEAEAAGLGRDKVSYSPSWRESLGGLLSGMEVPEWQSSPQKAPGSGEEELVPAGEGLMFIGGPFLPVLAVGSGV

SEQ ID NO: 80753 - protein, 533 aa, Homo sapiens
  Payload ID: 16090
  Gene Symbol: SLC22A8
  Gene Name: solute carrier family 22 (organic anion transporter), member 8
  ENSP ID: ENSP00000311463
MTFSEILDRVGSMGHFQFLHVAILGLPILNMANHNLLQIFTAATPVHHCRPPHNASTGPWVLPMGPNGKPERCLRFVHPPNASLPNDTQRAMEPCLDGWVYNSTKDSIVTEWDLVCNSNKLKEMAQSIFMAGILIGGLVLGDLSDRFGRRPILTCSYLLLAASGSGAAFSPTFPIYMVFRFLCGFGISGITLSTVILNVEWVPTRMRAIMSTALGYCYTFGQFILPGLAYAIPQWRWLQLTVSIPFFVFFLSSWWTPESIRWLVLSGKSSKALKILRRVAVFNGKKEEGERLSLEELKLNLQKEISLAKAKYTASDLFRIPMLRRMTFCLSLAWFATGFAYYSLAMGVEEFGVNLYILQIIFGGVDVPAKFITILSLSYLGRHTTQAAALLLAGGAILALTFVPLDLQTVRTVLAVFGKGCLSSSFSCLFLYTSELYPTVIRQTGMGVSNLWTRVGSMVSPLVKITGEVQPFIPNIIYGITALLGGSAALFLPETLNQPLPETIEDLENWSVTASGPISAPPWGSRSGPRAFP

SEQ ID NO: 80754 - protein, 542 aa, Homo sapiens
  Payload ID: 16090
  Gene Symbol: SLC22A8
  Gene Name: solute carrier family 22 (organic anion transporter), member 8
  Uniprot ID: Q8TCC7
  ENSP ID: ENSP00000337335
MTFSEILDRVGSMGHFQFLHVAILGLPILNMANHNLLQIFTAATPVHHCRPPHNASTGPWVLPMGPNGKPERCLRFVHPPNASLPNDTQRAMEPCLDGWVYNSTKDSIVTEWDLVCNSNKLKEMAQSIFMAGILIGGLVLGDLSDRFGRRPILTCSYLLLAASGSGAAFSPTFPIYMVFRFLCGFGISGITLSTVILNVEWVPTRMRAIMSTALGYCYTFGQFILPGLAYAIPQWRWLQLTVSIPFFVFFLSSWWTPESIRWLVLSGKSSKALKILRRVAVFNGKKEEGERLSLEELKLNLQKEISLAKAKYTASDLFRIPMLRRMTFCLSLAWFATGFAYYSLAMGVEEFGVNLYILQIIFGGVDVPAKFITILSLSYLGRHTTQAAALLLAGGAILALTFVPLDLQTVRTVLAVFGKGCLSSSFSCLFLYTSELYPTVIRQTGMGVSNLWTRVGSMVSPLVKITGEVQPFIPNIIYGITALLGGSAALFLPETLNQPLPETIEDLENWSLRAKKPKQEPEVEKASQRIPLQPHGPGLGSS

SEQ ID NO: 80755 - protein, 542 aa, Homo sapiens; identical to SEQ ID NO: 80754
  Payload ID: 16090
  Gene Symbol: SLC22A8
  Gene Name: solute carrier family 22 (organic anion transporter), member 8
  Uniprot ID: Q8TCC7
  ENSP ID: ENSP00000398548

SEQ ID NO: 80756 - protein, 451 aa, Homo sapiens
  Payload ID: 16090
  Gene Symbol: SLC22A8
  Gene Name: solute carrier family 22 (organic anion transporter), member 8
  Uniprot ID: Q8TCC7
  ENSP ID: ENSP00000441658
MEPCLDGWVYNSTKDSIVTEWDLVCNSNKLKEMAQSIFMAGILIGGLVLGDLSDRFGRRPILTCSYLLLAASGSGAAFSPTFPIYMVFRFLCGFGISGITLSTVILNVEWVPTRMRAIMSTALGYCYTFGQFILPGLAYAIPQWRWLQLTVSIPFFVFFLSSWWTPESIRWLVLSGKSSKALKILRRVAVFNGKKEEGERLSLEELKLNLQKEISLAKAKYTASDLFRIPMLRRMTFCLSLAWFATGFAYYSLAMGVEEFGVNLYILQIIFGGVDVPAKFITILSLSYLGRHTTQAAALLLAGGAILALTFVPLDLQTVRTVLAVFGKGCLSSSFSCLFLYTSELYPTVIRQTGMGVSNLWTRVGSMVSPLVKITGEVQPFIPNIIYGITALLGGSAALFLPETLNQPLPETIEDLENWSLRAKKPKQEPEVEKASQRIPLQPHGPGLGSS

SEQ ID NO: 80757 - protein, 419 aa, Homo sapiens
  Payload ID: 16090
  Gene Symbol: SLC22A8
  Gene Name: solute carrier family 22 (organic anion transporter), member 8
  Uniprot ID: Q8TCC7
  ENSP ID: ENSP00000443368
MAQSIFMAGILIGGLVLGDLSDRFGRRPILTCSYLLLAASGSGAAFSPTFPIYMVFRFLCGFGISGITLSTVILNVEWVPTRMRAIMSTALGYCYTFGQFILPGLAYAIPQWRWLQLTVSIPFFVFFLSSWWTPESIRWLVLSGKSSKALKILRRVAVFNGKKEEGERLSLEELKLNLQKEISLAKAKYTASDLFRIPMLRRMTFCLSLAWFATGFAYYSLAMGVEEFGVNLYILQIIFGGVDVPAKFITILSLSYLGRHTTQAAALLLAGGAILALTFVPLDLQTVRTVLAVFGKGCLSSSFSCLFLYTSELYPTVIRQTGMGVSNLWTRVGSMVSPLVKITGEVQPFIPNIIYGITALLGGSAALFLPETLNQPLPETIEDLENWSLRAKKPKQEPEVEKASQRIPLQPHGPGLGSS

SEQ ID NO: 80758 - protein, 553 aa, Homo sapiens
  Payload ID: 16091
  Gene Symbol: SLC22A9
  Gene Name: solute carrier family 22 (organic anion transporter), member 9
  Uniprot ID: Q8IVM8
  ENSP ID: ENSP00000279178
MAFQDLLGHAGDLWRFQILQTVFLSIFAVATYLHFMLENFTAFIPGHRCWVHILDNDTVSDNDTGALSQDALLRISIPLDSNMRPEKCRRFVHPQWQLLHLNGTFPNTSDADMEPCVDGWVYDRISFSSTIVTEWDLVCDSQSLTSVAKFVFMAGMMVGGILGGHLSDRFGRRFVLRWCYLQVAIVGTCAALAPTFLIYCSLRFLSGIAAMSLITNTIMLIAEWATHRFQAMGITLGMCPSGIAFMTLAGLAFAIRDWHILQLVVSVPYFVIFLTSSWLLESARWLIINNKPEEGLKELRKAAHRSGMKNARDTLTLEILKSTMKKELEAAQKKKPSLCEMLHMPNICKRISLLSFTRFANFMAYFGLNLHVQHLGNNVFLLQTLFGAVILLANCVAPWALKYMNRRASQMLLMFLLAICLLAIIFVPQEMQTLREVLATLGLGASALANTLAFAHGNEVIPTIIRARAMGINATFANIAGALAPLMMILSVYSPPLPWIIYGVFPFISGFAFLLLPETRNKPLFDTIQDEKNERKDPREPKQEDPRVEVTQF

SEQ ID NO: 80759 - protein, 238 aa, Homo sapiens
  Payload ID: 16091
  Gene Symbol: SLC22A9
  Gene Name: solute carrier family 22 (organic anion transporter), member 9
  Uniprot ID: Q8IVM8
  ENSP ID: ENSP00000440206
MAFQDLLGHAGDLWRFQILQTVFLSIFAVATYLHFMLENFTAFIPGHRCWVHILDNDTVSDNDTGALSQDALLRISIPLDSNMRPEKCRRFVHPQWQLLHLNGTFPNTSDADMEPCVDGWVYDRISFSSTIVTEWDLVCDSQSLTSVAKFVFMAGMMVGGILGGHLSDSSRVGNTQIPGHGNYIGNVPFWYCIYDPGRPGFCHSRLAYPPAGGVCTILCDLSDLKLAARVCSVAHYQQ

SEQ ID NO: 80760 - protein, 550 aa, Homo sapiens
  Payload ID: 16092
  Gene Symbol: SLC22A11
  Gene Name: solute carrier family 22 (organic anion/urate transporter), member 11
  Uniprot ID: Q9NSA0
  ENSP ID: ENSP00000301891
MAFSKLLEQAGGVGLFQTLQVLTFILPCLMIPSQMLLENFSAAIPGHRCWTHMLDNGSAVSTNMTPKALLTISIPPGPNQGPHQCRRFRQPQWQLLDPNATATSWSEADTEPCVDGWVYDRSVFTSTIVAKWDLVCSSQGLKPLSQSIFMSGILVGSFIWGLLSYRFGRKPMLSWCCLQLAVAGTSTIFAPTFVIYCGLRFVAAFGMAGIFLSSLTLMVEWTTTSRRAVTMTVVGCAFSAGQAALGGLAFALRDWRTLQLAASVPFFAISLISWWLPESARWLIIKGKPDQALQELRKVARINGHKEAKNLTIEVLMSSVKEEVASAKEPRSVLDLFCVPVLRWRSCAMLVVNFSLLISYYGLVFDLQSLGRDIFLLQALFGAVDFLGRATTALLLSFLGRRTIQAGSQAMAGLAILANMLVPQDLQTLRVVFAVLGKGCFGISLTCLTIYKAELFPTPVRMTADGILHTVGRLGAMMGPLILMSRQALPLLPPLLYGVISIASSLVVLFFLPETQGLPLPDTIQDLESQKSTAAQGNRQEAVTVESTSL

SEQ ID NO: 80761 - protein, 481 aa, Homo sapiens
  Payload ID: 16092
  Gene Symbol: SLC22A11
  Gene Name: solute carrier family 22 (organic anion/urate transporter), member 11
  ENSP ID: ENSP00000366804
MAFSKLLEQAGGVGLFQTLQVLTFILPCLMIPSQMLLENFSAAIPGHRCWTHMLDNGSAVSTNMTPKALLTISIPPGPNQGPHQCRRFRQPQWQLLDPNATATSWSEADTEPCVDGWVYDRSVFTSTIVAKWDLVCSSQGLKPLSQSIFMSGILVGSFIWGLLSYRFGRKPMLSWCCLQLAVAGTSTIFAPTFVIYCGLRFVAAFGMAGIFLSSLTLMVEWTTTSRRAVTMTVVGCAFSAGQAALGGLAFALRDWRTLQLAASVPFFAISLISWWLPESARWLIIKGKPDQALQELRKVARINGHKEAKNLTIEVLMSSVKEEVASAKEPRSVLDLFCVPVLRWRSCAMLVVNFSLLISYYGLVFDLQSLGRDIFLLQALFGAVDFLGRATTALLLSFLGRRTIQAGSQAMAGLAILANMLVPQDLQTLRVVFAVLGKGCFGISLTCLTIYKAELFPTPVRKSTAAQGNRQEAVTVESTSL

SEQ ID NO: 80762 - protein, 442 aa, Homo sapiens
  Payload ID: 16092
  Gene Symbol: SLC22A11
  Gene Name: solute carrier family 22 (organic anion/urate transporter), member 11
  Uniprot ID: Q9NSA0
  ENSP ID: ENSP00000366809
MAFSKLLEQAGGVGLFQTLQVLTFILPCLMIPSQMLLENFSAAIPGHRCWTHMLDNGSAVSTNMTPKALLTISIPPGPNQGPHQCRRFRQPQWQLLDPNATATSWSEADTEPCVDGWVYDRSVFTSTIVAKWDLVCSSQGLKPLSQSIFMSGILVGSFIWGLLSYRFGRKPMLSWCCLQLAVAGTSTIFAPTFVIYCGLRFVAAFGMAGIFLSSLTLMVEWTTTSRRAVTMTVVGCAFSAGQAALGGLAFALRDWRTLQLAASVPFFAISLISWWLPESARWLIIKGKPDQALQELRKVARINGHKEAKNLTIEVLMSSVKEEVASAKEPRSVLDLFCVPVLRWRSCAMLVVKMTADGILHTVGRLGAMMGPLILMSRQALPLLPPLLYGVISIASSLVVLFFLPETQGLPLPDTIQDLESQKSTAAQGNRQEAVTVESTSL

SEQ ID NO: 80763 - protein, 73 aa, Homo sapiens
  Payload ID: 16092
  Gene Symbol: SLC22A11
  Gene Name: solute carrier family 22 (organic anion/urate transporter), member 11
  ENSP ID: ENSP00000394043
  MOD_RES (1)..(1): Any amino acid
XFSLLISYYGLVFDLQSLGRDIFLLQALFGAVDFLGRATTALLLSFLGRRTIQAGSQAMAGLAILANMLVPQG

SEQ ID NO: 80764 - protein, 153 aa, Homo sapiens
  Payload ID: 16092
  Gene Symbol: SLC22A11
  Gene Name: solute carrier family 22 (organic anion/urate transporter), member 11
  ENSP ID: ENSP00000413508
FSLLISYYGLVFDLQSLGRDIFLLQALFGAVDFLGRATTALLLSFLGRRTIQAGSQAMAGLAILANMLVPQDLQTLRVVFAVLGKGCFGISLTCLTIYKAELFPTPVRLVVLFFLPETQGLPLPDTIQDLESQKSTAAQGNRQEAVTVESTSL

SEQ ID NO: 80765 - protein, 519 aa, Homo sapiens
  Payload ID: 16093
  Gene Symbol: SLC22A12
  Gene Name: solute carrier family 22 (organic anion/urate transporter), member 12
  Uniprot ID: Q96S37
  ENSP ID: ENSP00000336836
MAFSELLDLVGGLGRFQVLQTMALMVSIMWLCTQSMLENFSAAVPSHRCWAPLLDNSTAQASILGSLSPEALLAISIPPGPNQRPHQCRRFRQPQWQLLDPNATATSWSEADTEPCVDGWVYDRSIFTSTIVAKWNLVCDSHALKPMAQSIYLAGILVGAAACGPASDRFGRRLVLTWSYLQMAVMVMEWTAARARPLVMTLNSLGFSFGHGLTAAVAYGVRDWTLLQLVVSVPFFLCFLYSWWLAESARWLLTTGRLDWGLQELWRVAAINGKGAVQDTLTPEVLLSAMREELSMGQPPASLGTLLRMPGLRFRTCISTLCWFAFGFTFFGLALDLQALGSNIFLLQMFIGVVDIPAKMGALLLLSHLGRRPTLAASLLLAGLCILANTLVPHEMGALRSALAVLGLGGVGAAFTCITIYSSELFPTVLRMTAVGLGQMAARGGAILGPLVRLLGVHGPWLPLLVYGTVPVLSGLAALLLPETQSLPLPDTIQDVQNQAVKKATHGTLGNSVLKSTQF

SEQ ID NO: 80766 - protein, 445 aa, Homo sapiens
  Payload ID: 16093
  Gene Symbol: SLC22A12
  Gene Name: solute carrier family 22 (organic anion/urate transporter), member 12
  Uniprot ID: Q96S37
  ENSP ID: ENSP00000366790
MAFSELLDLVGGLGRFQVLQTMALMVSIMWLCTQSMLENFSAAVPSHRCWAPLLDNSTAQASILGSLSPEALLAISIPPGPNQRPHQCRRFRQPQWQLLDPNATATSWSEADTEPCVDGWVYDRSIFTSTIVAKWNLVCDSHALKPMAQSIYLAGILVGAAACGPASDRWLAESARWLLTTGRLDWGLQELWRVAAINGKGAVQDTLTPEVLLSAMREELSMGQPPASLGTLLRMPGLRFRTCISTLCWFAFGFTFFGLALDLQALGSNIFLLQMFIGVVDIPAKMGALLLLSHLGRRPTLAASLLLAGLCILANTLVPHEMGALRSALAVLGLGGVGAAFTCITIYSSELFPTVLRMTAVGLGQMAARGGAILGPLVRLLGVHGPWLPLLVYGTVPVLSGLAALLLPETQSLPLPDTIQDVQNQAVKKATHGTLGNSVLKSTQF

SEQ ID NO: 80767 - protein, 445 aa, Homo sapiens; identical to SEQ ID NO: 80766
  Payload ID: 16093
  Gene Symbol: SLC22A12
  Gene Name: solute carrier family 22 (organic anion/urate transporter), member 12
  Uniprot ID: Q96S37
  ENSP ID: ENSP00000366795

SEQ ID NO: 80768 - protein, 553 aa, Homo sapiens
  Payload ID: 16093
  Gene Symbol: SLC22A12
  Gene Name: solute carrier family 22 (organic anion/urate transporter), member 12
  Uniprot ID: Q96S37
  ENSP ID: ENSP00000366797
MAFSELLDLVGGLGRFQVLQTMALMVSIMWLCTQSMLENFSAAVPSHRCWAPLLDNSTAQASILGSLSPEALLAISIPPGPNQRPHQCRRFRQPQWQLLDPNATATSWSEADTEPCVDGWVYDRSIFTSTIVAKWNLVCDSHALKPMAQSIYLAGILVGAAACGPASDRFGRRLVLTWSYLQMAVMGTAAAFAPAFPVYCLFRFLLAFAVAGVMMNTGTLLMEWTAARARPLVMTLNSLGFSFGHGLTAAVAYGVRDWTLLQLVVSVPFFLCFLYSWWLAESARWLLTTGRLDWGLQELWRVAAINGKGAVQDTLTPEVLLSAMREELSMGQPPASLGTLLRMPGLRFRTCISTLCWFAFGFTFFGLALDLQALGSNIFLLQMFIGVVDIPAKMGALLLLSHLGRRPTLAASLLLAGLCILANTLVPHEMGALRSALAVLGLGGVGAAFTCITIYSSELFPTVLRMTAVGLGQMAARGGAILGPLVRLLGVHGPWLPLLVYGTVPVLSGLAALLLPETQSLPLPDTIQDVQNQAVKKATHGTLGNSVLKSTQF

SEQ ID NO: 80769 - protein, 332 aa, Homo sapiens
  Payload ID: 16093
  Gene Symbol: SLC22A12
  Gene Name: solute carrier family 22 (organic anion/urate transporter), member 12
  Uniprot ID: Q96S37
  ENSP ID: ENSP00000438437
MEWTAARARPLVMTLNSLGFSFGHGLTAAVAYGVRDWTLLQLVVSVPFFLCFLYSWWLAESARWLLTTGRLDWGLQELWRVAAINGKGAVQDTLTPEVLLSAMREELSMGQPPASLGTLLRMPGLRFRTCISTLCWFAFGFTFFGLALDLQALGSNIFLLQMFIGVVDIPAKMGALLLLSHLGRRPTLAASLLLAGLCILANTLVPHEMGALRSALAVLGLGGVGAAFTCITIYSSELFPTVLRMTAVGLGQMAARGGAILGPLVRLLGVHGPWLPLLVYGTVPVLSGLAALLLPETQSLPLPDTIQDVQNQAVKKATHGTLGNSVLKSTQF

SEQ ID NO: 80770 - protein, 551 aa, Homo sapiens
  Payload ID: 16094
  Gene Symbol: SLC22A13
  Gene Name: solute carrier family 22 (organic anion/urate transporter), member 13
  Uniprot ID: Q9Y226
  ENSP ID: ENSP00000310241
MAQFVQVLAEIGDFGRFQIQLLILLCVLNFLSPFYFFAHVFMVLDEPHHCAVAWVKNHTFNLSAAEQLVLSVPLDTAGHPEPCLMFRPPPANASLQDILSHRFNETQPCDMGWEYPENRLPSLKNEFNLVCDRKHLKDTTQSVFMAGLLVGTLMFGPLCDRIGRKATILAQLLLFTLIGLATAFVPSFELYMALRFAVATAVAGLSFSNVTLLTEWVGPSWRTQAVVLAQCNFSLGQMVLAGLAYGFRNWRLLQITGTAPGLLLFFYFWALPESARWLLTRGRMDEAIQLIQKAASVNRRKLSPELMNQLVPEKTGPSGNALDLFRHPQLRKVTLIIFCVWFVDSLGYYGLSLQVGDFGLDVYLTQLIFGAVEVPARCSSIFMMQRFGRKWSQLGTLVLGGLMCIIIIFIPADLPVVVTMLAVVGKMATAAAFTISYVYSAELFPTILRQTGMGLVGIFSRIGGILTPLVILLGEYHAALPMLIYGSLPIVAGLLCTLLPETHGQGLKDTLQDLELGPHPRSPKSVPSEKETEAKGRTSSPGVAFVSSTYF

SEQ ID NO: 80771 - protein, 231 aa, Homo sapiens
  Payload ID: 16094
  Gene Symbol: SLC22A13
  Gene Name: solute carrier family 22 (organic anion/urate transporter), member 13
  ENSP ID: ENSP00000395106
RFQIQLLILLCVLNFLSPFYFFAHVFMVLDEPHHCAVAWVKNHTFNLSAAEQLVLSVPLDTAGHPEPCLMFRPPPANASLQDILSHRFNETQPCDMGWEYPENRLPSLKNEFNLVCDRKHLKDTTQSVFMAGLLVGTLMFGPLCDRDRMGGALMEDAGRGPGPVQLLPRADGACGTRLRFPQLEAPSDHRHCAWLTALLLLLGSARICTLAPDPWEDGRGDTTDPEGGLGQ

SEQ ID NO: 80772 - protein, 506 aa, Homo sapiens
  Payload ID: 16095
  Gene Symbol: SLC22A1
  Gene Name: solute carrier family 22 (organic cation transporter), member 1
  Uniprot ID: O15245
  ENSP ID: ENSP00000318103
MPTVDDILEQVGESGWFQKQAFLILCLLSAAFAPICVGIVFLGFTPDHHCQSPGVAELSQRCGWSPAEELNYTVPGLGPAGEAFLGQCRRYEVDWNQSALSCVDPLASLATNRSHLPLGPCQDGWVYDTPGSSIVTEFNLVCADSWKLDLFQSCLNAGFLFGSLGVGYFADRFGRKLCLLGTVLVNAVSGVLMAFSPNYMSMLLFRLLQGLVSKGNWMAGYTLITEFVGSGSRRTVAIMYQMAFTVGLVALTGLAYALPHWRWLQLAVSLPTFLFLLYYWCVPESPRWLLSQKRNTEAIKIMDHIAQKNGKLPPADLKMLSLEEDVTEKLSPSFADLFRTPRLRKRTFILMYLWFTDSVLYQGLILHMGATSGNLYLDFLYSALVEIPGAFIALITIDRVGRIYPMAMSNLLAGAACLVMIFISPDLHWLNIIIMCVGRMGITIAIQMICLVNAELYPTFVSGVGPACRGSDATSSRDQGGRFARDHEGRREPWEKSKAQRKHDLP

SEQ ID NO: 80773 - protein, 554 aa, Homo sapiens
  Payload ID: 16095
  Gene Symbol: SLC22A1
  Gene Name: solute carrier family 22 (organic cation transporter), member 1
  Uniprot ID: O15245
  ENSP ID: ENSP00000355930
MPTVDDILEQVGESGWFQKQAFLILCLLSAAFAPICVGIVFLGFTPDHHCQSPGVAELSQRCGWSPAEELNYTVPGLGPAGEAFLGQCRRYEVDWNQSALSCVDPLASLATNRSHLPLGPCQDGWVYDTPGSSIVTEFNLVCADSWKLDLFQSCLNAGFLFGSLGVGYFADRFGRKLCLLGTVLVNAVSGVLMAFSPNYMSMLLFRLLQGLVSKGNWMAGYTLITEFVGSGSRRTVAIMYQMAFTVGLVALTGLAYALPHWRWLQLAVSLPTFLFLLYYWCVPESPRWLLSQKRNTEAIKIMDHIAQKNGKLPPADLKMLSLEEDVTEKLSPSFADLFRTPRLRKRTFILMYLWFTDSVLYQGLILHMGATSGNLYLDFLYSALVEIPGAFIALITIDRVGRIYPMAMSNLLAGAACLVMIFISPDLHWLNIIIMCVGRMGITIAIQMICLVNAELYPTFVRNLGVMVCSSLCDIGGIITPFIVFRLREVWQALPLILFAVLGLLAAGVTLLLPETKGVALPETMKDAENLGRKAKPKENTIYLKVQTSEPSGT

SEQ ID NO: 80774 - protein, 483 aa, Homo sapiens
  Payload ID: 16095
  Gene Symbol: SLC22A1
  Gene Name: solute carrier family 22 (organic cation transporter), member 1
  Uniprot ID: O15245
  ENSP ID: ENSP00000409557
MPTVDDILEQVGESGWFQKQAFLILCLLSAAFAPICVGIVFLGFTPDHHCQSPGVAELSQRCGWSPAEELNYTVPGLGPAGEAFLGQCRRYEVDWNQSALSCVDPLASLATNRSHLPLGPCQDGWVYDTPGSSIVTEFNLVCADSWKLDLFQSCLNAGFLFGSLGVGYFADRFGRKLCLLGTVLVNAVSGVLMAFSPNYMSMLLFRLLQGLVSKGNWMAGYTLITEFVGSGSRRTVAIMYQMAFTVGLVALTGLAYALPHWRWLQLAVSLPTFLFLLYYWCVPESPRWLLSQKRNTEAIKIMDHIAQKNGKLPPADLKMLSLEEDVTEKLSPSFADLFRTPRLRKRTFILMYLWFTDSVLYQGLILHMGATSGNLYLDFLYSALVEIPGAFIALITIDRVGRIYPMAMSNLLAGAACLVMIFISPDLHWLNIIIMCVGRMGITIAIQMICLVNAELYPTFVRKAKPKENTIYLKVQTSEPSGT

SEQ ID NO: 80775 - protein, 353 aa, Homo sapiens
  Payload ID: 16095
  Gene Symbol: SLC22A1
  Gene Name: solute carrier family 22 (organic cation transporter), member 1
  Uniprot ID: O15245
  ENSP ID: ENSP00000439274
MPTVDDILEQVGESGWFQKQAFLILCLLSAAFAPICVGIVFLGFTPDHHCQSPGVAELSQRCGWSPAEELNYTVPGLGPAGEAFLGQCRRYEVDWNQSALSCVDPLASLATNRSHLPLGPCQDGWVYDTPGSSIVTEFNLVCADSWKLDLFQSCLNAGFLFGSLGVGYFADRFGRKLCLLGTVLVNAVSGVLMAFSPNYMSMLLFRLLQGLVSKGNWMAGYTLITEFVGSGSRRTVAIMYQMAFTVGLVALTGLAYALPHWRWLQLAVSLPTFLFLLYYWCVPESPRWLLSQKRNTEAIKIMDHIAQKNGKLPPADLKMLSLEEDVTEKLSPSFADLFRTPRLRKRTFILMYL

SEQ ID NO: 80776 - protein, 48 aa, Homo sapiens
  Payload ID: 16095
  Gene Symbol: SLC22A1
  Gene Name: solute carrier family 22 (organic cation transporter), member 1
  ENSP ID: ENSP00000440105
MAFSPNYMSMLLFRLLQGLVSKGNWMAGYTLITEFVGSGSRRTVAIMY

SEQ ID NO: 80777 - protein, 140 aa, Homo sapiens
  Payload ID: 16095
  Gene Symbol: SLC22A1
  Gene Name: solute carrier family 22 (organic cation transporter), member 1
  ENSP ID: ENSP00000443245
MPTVDDILEQVGESGWFQKQAFLILCLLSAAFAPICVGIVFLGFTPDHHCQSPGVAELSQRCGWSPAEELNYTVPGLGPAGEAFLGQCRRYEVDWNQSALSCVDPLASLATNRSHLPLGPCQDGWVYDTPGSSIVTEVWP

SEQ ID NO: 80778 - protein, 150 aa, Homo sapiens
  Payload ID: 16096
  Gene Symbol: SLC22A18AS
  Gene Name: solute carrier family 22 (organic cation transporter), member 18 antisense
  Uniprot ID: Q8N1D0
  ENSP ID: ENSP00000487669
MRCAEGAWWFSPDGPAGSAASIWPAEGAEGLPGQLGRDRLEVVYSVPDNVPGQNGSRRPLVCKITGKCLSVCSEENAKAGGCSAFPLLLSQLGARMTGREHAHKGPELTTPDSGLPRPPNPALAGFRALAQHSPPLGTSTPSAVLLSAAT

SEQ ID NO: 80779 - protein, 253 aa, Homo sapiens
  Payload ID: 16096
  Gene Symbol: SLC22A18AS
  Gene Name: solute carrier family 22 (organic cation transporter), member 18 antisense
  Uniprot ID: Q8N1D0
  ENSP ID: ENSP00000487968
MGELPGSEGMWENCPLGWVKKKASGTLAPLDFLLQRKRLWLWASEPVRPQPQGIHRFREARRQFCRMRGSRLTGGRKGFGSSGLRFGRGGFSEEVMPQPVLKAMRCAEGAWWFSPDGPAGSAASIWPAEGAEGLPGQLGRDRLEVVYSVPDNVPGQNGSRRPLVCKITGKCLSVCSEENAKAGGCSAFPLLLSQLGARMTGREHAHKGPELTTPDSGLPRPPNPALAGFRALAQHSPPLGTSTPSAVLLSAAT

SEQ ID NO: 80780 - protein, 150 aa, Homo sapiens; identical to SEQ ID NO: 80778
  Payload ID: 16096
  Gene Symbol: SLC22A18AS
  Gene Name: solute carrier family 22 (organic cation transporter), member 18 antisense
  Uniprot ID: Q8N1D0
  ENSP ID: ENSP00000488024

SEQ ID NO: 80781 - protein, 334 aa, Homo sapiens
  Payload ID: 16097
  Gene Symbol: SLC22A2
  Gene Name: solute carrier family 22 (organic cation transporter), member 2
  ENSP ID: ENSP00000355919
MFFLLALLSATFAPIYVGIVFLGFTPDHRCRSPGVAELSLRCGWSPAEELNYTVPGPGPAGEASPRQCRRYEVDWNQSTFDCVDPLASLDTNRSRLPLGPCRDGWVYETPGSSIVTEFNLVCANSWMLDLFQSSVNVGFFIGSMSIGYIADRFGRKLCLLTTVLINAAAGVLMAISPTYTWMLIFRLIQGLVSKAGWLIGYILITEFVGRRYRRTVGIFYQVAYTVGLLVLAGVAYALPHWRWLQFTVSLPNFFFLLYYWCIPESPRWLISQNKNAEAMRIIKHIAKKNGKSLPASLQRLRLEEETGKKLNPSFLDLVRTPQIRKHTMILMYNW

SEQ ID NO: 80782 - protein, 555 aa, Homo sapiens
  Payload ID: 16097
  Gene Symbol: SLC22A2
  Gene Name: solute carrier family 22 (organic cation transporter), member 2
  Uniprot ID: O15244
  ENSP ID: ENSP00000355920
MPTTVDDVLEHGGEFHFFQKQMFFLLALLSATFAPIYVGIVFLGFTPDHRCRSPGVAELSLRCGWSPAEELNYTVPGPGPAGEASPRQCRRYEVDWNQSTFDCVDPLASLDTNRSRLPLGPCRDGWVYETPGSSIVTEFNLVCANSWMLDLFQSSVNVGFFIGSMSIGYIADRFGRKLCLLTTVLINAAAGVLMAISPTYTWMLIFRLIQGLVSKAGWLIGYILITEFVGRRYRRTVGIFYQVAYTVGLLVLAGVAYALPHWRWLQFTVSLPNFFFLLYYWCIPESPRWLISQNKNAEAMRIIKHIAKKNGKSLPASLQRLRLEEETGKKLNPSFLDLVRTPQIRKHTMILMYNWFTSSVLYQGLIMHMGLAGDNIYLDFFYSALVEFPAAFMIILTIDRIGRRYPWAASNMVAGAACLASVFIPGDLQWLKIIISCLGRMGITMAYEIVCLVNAELYPTFIRNLGVHICSSMCDIGGIITPFLVYRLTNIWLELPLMVFGVLGLVAGGLVLLLPETKGKALPETIEEAENMQRPRKNKEKMIYLQVQKLDIPLN

SEQ ID NO: 80783 - protein, 556 aa, Homo sapiens
  Payload ID: 16098
  Gene Symbol: SLC22A3
  Gene Name: solute carrier family 22 (organic cation transporter), member 3
  Uniprot ID: O75751
  ENSP ID: ENSP00000275300
MPSFDEALQRVGEFGRFQRRVFLLLCLTGVTFAFLFVGVVFLGTQPDHYWCRGPSAAALAERCGWSPEEEWNRTAPASRGPEPPERRGRCQRYLLEAANDSASATSALSCADPLAAFPNRSAPLVPCRGGWRYAQAHSTIVSEFDLVCVNAWMLDLTQAILNLGFLTGAFTLGYAADRYGRIVIYLLSCLGVGVTGVVVAFAPNFPVFVIFRFLQGVFGKGTWMTCYVIVTEIVGSKQRRIVGIVIQMFFTLGIIILPGIAYFIPNWQGIQLAITLPSFLFLLYYWVVPESPRWLITRKKGDKALQILRRIAKCNGKYLSSNYSEITVTDEEVSNPSFLDLVRTPQMRKCTLILMFAWFTSAVVYQGLVMRLGIIGGNLYIDFFISGVVELPGALLILLTIERLGRRLPFAASNIVAGVACLVTAFLPEGIAWLRTTVATLGRLGITMAFEIVYLVNSELYPTTLRNFGVSLCSGLCDFGGIIAPFLLFRLAAVWLELPLIIFGILASICGGLVMLLPETKGIALPETVDDVEKLGSPHSCKCGRNKKTPVSRSHL

SEQ ID NO: 80784 - protein, 543 aa, Homo sapiens
  Payload ID: 16099
  Gene Symbol: SLC22A16
  Gene Name: solute carrier family 22 (organic cation/carnitine transporter), member 16
  Uniprot ID: Q86VW1
  ENSP ID: ENSP00000328583
MRTLHAVSHPYSNSMRFQRVLYFICAFQNISCGIHYLASVFMGVTPHHVCRPPGNLQNGEIWELSRCSRNKRENTSSLGYEYTGSKKEFPCVDGYIYDQNTWKSTAVTQWNLVCDRKWLAMLIQPLFMFGVLLGSVTFGYFSDRLGRRVVLWATSSSMFLFGIAAAFAVDYYTFMAARFFLAMVASGYLVVGFVYVMEFIGMKSRTWASVHLHSFFAVGTLLVALTGYLVRTWWLYQMILSTVTVPFILCCWVLPETPFWLLSEGRYEEAQKIVDIMAKWNRASSCKLSELLSLDLQGPVSNSPTEVQKHNLSYLFYNWSITKRTLTVWLIWFTGSLGFYSFSLNSVNLGGNEYLNLFLLGVVEIPAYTFVCIAMDKVGRRTVLAYSLFCSALACGVVMVIPQKHYILGVVTAMVGKFAIGAAFGLIYLYTAELYPTIVRSLAVGSGSMVCRLASILAPFSVDLSSIWIFIPQLFVGTMALLSGVLTLKLPETLGKRLATTWEEAAKLESENESKSSKLLLTTNNSGLEKTEAITPRDSGLGE

SEQ ID NO: 80785 - protein, 577 aa, Homo sapiens
  Payload ID: 16099
  Gene Symbol: SLC22A16
  Gene Name: solute carrier family 22 (organic cation/carnitine transporter), member 16
  Uniprot ID: Q86VW1
  ENSP ID: ENSP00000357915
MGSRHFEGIYDHVGHFGRFQRVLYFICAFQNISCGIHYLASVFMGVTPHHVCRPPGNVSQVVFHNHSNWSLEDTGALLSSGQKDYVTVQLQNGEIWELSRCSRNKRENTSSLGYEYTGSKKEFPCVDGYIYDQNTWKSTAVTQWNLVCDRKWLAMLIQPLFMFGVLLGSVTFGYFSDRLGRRVVLWATSSSMFLFGIAAAFAVDYYTFMAARFFLAMVASGYLVVGFVYVMEFIGMKSRTWASVHLHSFFAVGTLLVALTGYLVRTWWLYQMILSTVTVPFILCCWVLPETPFWLLSEGRYEEAQKIVDIMAKWNRASSCKLSELLSLDLQGPVSNSPTEVQKHNLSYLFYNWSITKRTLTVWLIWFTGSLGFYSFSLNSVNLGGNEYLNLFLLGVVEIPAYTFVCIAMDKVGRRTVLAYSLFCSALACGVVMVIPQKHYILGVVTAMVGKFAIGAAFGLIYLYTAELYPTIVRSLAVGSGSMVCRLASILAPFSVDLSSIWIFIPQLFVGTMALLSGVLTLKLPETLGKRLATTWEEAAKLESENESKSSKLLLTTNNSGLEKTEAITPRDSGLGE

SEQ ID NO: 80786 - protein, 432 aa, Homo sapiens
  Payload ID: 16099
  Gene Symbol: SLC22A16
  Gene Name: solute carrier family 22 (organic cation/carnitine transporter), member 16
  ENSP ID: ENSP00000395642
DYVTVQLQNGEIWELSRCSRNKRENTSSLGYEYTGSKKEFPCVDGYIYDQNTWKSTAVTQWNLVCDRKWLAMLIQPLFMFGVLLGSVTFGYFSDRLGRRVVLWATSSSMFLFGIAAAFAVDYYTFMAARFFLAMVASGYLVVGFVYVMEFIGMKSRTWASVHLHSFFAVGTLLVALTGYLVRTWWLYQMILSTVTVPFILCCWVLPETPFWLLSEGRYEEAQKIVDIMAKWNRASSCKLSELLSLDLQGPVSNSPTEVQKHNLSYLFYNWSITKRTLTVWLIWFTGSLGFYSFSLNSVNLGGNEYLNLFLLGVVEIPAYTFVCIAMDKVGRRTVLAYSLFCSALACGVVMVIPQKHYILGVVTAMVGKFAIGAAFGLIYLYTAELYPTIVRSLAVGSGSMVCRLASILAPFSVDLSSIWIFIPQLLGQHLQE

SEQ ID NO: 80787 - protein, 174 aa, Homo sapiens
  Payload ID: 16099
  Gene Symbol: SLC22A16
  Gene Name: solute carrier family 22 (organic cation/carnitine transporter), member 16
  ENSP ID: ENSP00000401007
MGVTPHHVCRPPGNVSQVVFHNHSNWSLEDTGALLSSGQKDYVTVQLQNGEIWELSRCSRNKRENTSSLGYEYTGSKKEFPCVDGYIYDQNTWKSTAVTQWNLVCDRKWLAMLIQPLFMFGVLLGSVTFGYFSDRLGRRVVLWATSSSMFLFGIAAAFAVDYYTFMAARFFLAM

SEQ ID NO: 80788 - protein, 267 aa, Homo sapiens
  Payload ID: 16099
  Gene Symbol: SLC22A16
  Gene Name: solute carrier family 22 (organic cation/carnitine transporter), member 16
  ENSP ID: ENSP00000409306
MSAGPQAMLGRRVVLWATSSSMFLFGIAAAFAVDYYTFMAARFFLAMVASGYLVVGFVYVMEFIGMKSRTWASVHLHSFFAVGTLLVALTGYLVRTWWLYQMILSTVTVPFILCCWVLPETPFWLLSEGRYEEAQKIVDIMAKWNRASSCKLSELLSLDLQGPVSNSPTEVQKHNLSYLFYNWSITKRTLTVWLIWFTGSLGFYSFSLNSVNLGGNEYLNLFLLGVVEIPAYTFVCIAMDKVGRRTVLAYSLFCSALACGVVMVIPQ

SEQ ID NO: 80789 - protein, 351 aa, Homo sapiens
  Payload ID: 16099
  Gene Symbol: SLC22A16
  Gene Name: solute carrier family 22 (organic cation/carnitine transporter), member 16
  ENSP ID: ENSP00000416310
MGVTPHHVCRPPGNVSQVVFHNHSNWSLEDTGALLSSGQKDYVTVQLQNGEIWELSRCSRNKRENTSSLGYEYTGSKKEFPCVDGYIYDQNTWKSTAVTQWNLVCDRKWLAMLIQPLFMFGVLLGSVTFGYFSDRLGRRVVLWATSSSMFLFGIAAAFAVDYYTFMAARFFLAMVASGYLVVGFVYVMEFIGMKSRTWASVHLHSFFAVGTLLVALTGYLVRTWWLYQMILSTVTVPFILCCWVLPETPFWLLSEGRYEEAQKIVDIMAKWNRASSCKLSELLSLDLQGPVSNSPTEVQKHNLSYLFYNWSITKRTLTVWLIWFTGSLGFYSFSLNSVNLGGNEYLNLFLL

SEQ ID NO: 80790 - protein, 557 aa, Homo sapiens
  Payload ID: 16100
  Gene Symbol: SLC22A5
  Gene Name: solute carrier family 22 (organic cation/carnitine transporter), member 5
  Uniprot ID: O76082
  ENSP ID: ENSP00000245407
MRDYDEVTAFLGEWGPFQRLIFFLLSASIIPNGFTGLSSVFLIATPEHRCRVPDAANLSSAWRNHTVPLRLRDGREVPHSCRRYRLATIANFSALGLEPGRDVDLGQLEQESCLDGWEFSQDVYLSTIVTEWNLVCEDDWKAPLTISLFFVGVLLGSFISGQLSDRFGRKNVLFVTMGMQTGFSFLQIFSKNFEMFVVLFVLVGMGQISNYVAAFVLGTEILGKSVRIIFSTLGVCIFYAFGYMVLPLFAYFIRDWRMLLVALTMPGVLCVALWWFIPESPRWLISQGRFEEAEVIIRKAAKANGIVVPSTIFDPSELQDLSSKKQQSHNILDLLRTWNIRMVTIMSIMLWMTISVGYFGLSLDTPNLHGDIFVNCFLSAMVEVPAYVLAWLLLQYLPRRYSMATALFLGGSVLLFMQLVPPDLYYLATVLVMVGKFGVTAAFSMVYVYTAELYPTVVRNMGVGVSSTASRLGSILSPYFVYLGAYDRFLPYILMGSLTILTAILTLFLPESFGTPLPDTIDQMLRVKGMKHRKTPSHTRMLKDGQERPTILKSTAF

SEQ ID NO: 80791 - protein, 240 aa, Homo sapiens
  Payload ID: 16100
  Gene Symbol: SLC22A5
  Gene Name: solute carrier family 22 (organic cation/carnitine transporter), member 5
  ENSP ID: ENSP00000388838
DVDLGQLEQESCLDGWEFSQDVYLSTIVTEQDSGAYNAMKNRMGKKPALCLPAQWNLVCEDDWKAPLTISLFFVGVLLGSFISGQLSDRFGRKNVLFVTMGMQTGFSFLQIFSKNFEMFVVLFVLVGMGQISNYVAAFVLGTEILGKSVRIIFSTLGVCIFYAFGYMVLPLFAYFIRDWRMLLVALTMPGVLCVALWWFIPESPRWLISQGRFEEAEVIIRKAAKANGIVVPSTIFDPSE

SEQ ID NO: 80792 - protein, 37 aa, Homo sapiens
  Payload ID: 16100
  Gene Symbol: SLC22A5
  Gene Name: solute carrier family 22 (organic cation/carnitine transporter), member 5
  ENSP ID: ENSP00000389284
  MOD_RES (1)..(1): Any amino acid
XFLQLQDLSSKKQQSHNILDLLRTWNIRMVTIMSIML

SEQ ID NO: 80793 - protein, 141 aa, Homo sapiens
  Payload ID: 16100
  Gene Symbol: SLC22A5
  Gene Name: solute carrier family 22 (organic cation/carnitine transporter), member 5
  ENSP ID: ENSP00000400553
MRDYDEVTAFLGEWGPFQRLIFFLLSASIIPNGFTGLSSVFLIATPEHRCRVPDAANLSSAWRNHTVPLRLRDGREVPHSCRRYRLATIANFSALGLEPGRDVDLGQLEQESCLDGWEFSQDVYLSTIVTEGQKFLASQFV

SEQ ID NO: 80794 - protein, 136 aa, Homo sapiens
  Payload ID: 16100
  Gene Symbol: SLC22A5
  Gene Name: solute carrier family 22 (organic cation/carnitine transporter), member 5
  ENSP ID: ENSP00000401860
  MOD_RES (1)..(1): Any amino acid
XTEILGKSVRIIFSTLGVCIFYAFGYMVLPLFAYFIRDWRMLLVALTMPGVLCVALWWFIPESPRWLISQGRFEEAEVIIRKAAKANGIVVPSTIFDPSELQDLSSKKQQSHNILDLLRTWNIRMVTIMSIMLCDG

SEQ ID NO: 80795 - protein, 581 aa, Homo sapiens
  Payload ID: 16100
  Gene Symbol: SLC22A5
  Gene Name: solute carrier family 22 (organic cation/carnitine transporter), member 5
  Uniprot ID: O76082
  ENSP ID: ENSP00000402760
MRDYDEVTAFLGEWGPFQRLIFFLLSASIIPNGFTGLSSVFLIATPEHRCRVPDAANLSSAWRNHTVPLRLRDGREVPHSCRRYRLATIANFSALGLEPGRDVDLGQLEQESCLDGWEFSQDVYLSTIVTEQDSGAYNAMKNRMGKKPALCLPAQWNLVCEDDWKAPLTISLFFVGVLLGSFISGQLSDRFGRKNVLFVTMGMQTGFSFLQIFSKNFEMFVVLFVLVGMGQISNYVAAFVLGTEILGKSVRIIFSTLGVCIFYAFGYMVLPLFAYFIRDWRMLLVALTMPGVLCVALWWFIPESPRWLISQGRFEEAEVIIRKAAKANGIVVPSTIFDPSELQDLSSKKQQSHNILDLLRTWNIRMVTIMSIMLWMTISVGYFGLSLDTPNLHGDIFVNCFLSAMVEVPAYVLAWLLLQYLPRRYSMATALFLGGSVLLFMQLVPPDLYYLATVLVMVGKFGVTAAFSMVYVYTAELYPTVVRNMGVGVSSTASRLGSILSPYFVYLGAYDRFLPYILMGSLTILTAILTLFLPESFGTPLPDTIDQMLRVKGMKHRKTPSHTRMLKDGQERPTILKSTAF

SEQ ID NO: 80796 - protein, 551 aa, Homo sapiens
  Payload ID: 16101
  Gene Symbol: SLC22A4
  Gene Name: solute carrier family 22 (organic cation/zwitterion transporter), member 4
  Uniprot ID: Q9H015
  ENSP ID: ENSP00000200652
MRDYDEVIAFLGEWGPFQRLIFFLLSASIIPNGFNGMSVVFLAGTPEHRCRVPDAANLSSAWRNNSVPLRLRDGREVPHSCSRYRLATIANFSALGLEPGRDVDLGQLEQESCLDGWEFSQDVYLSTVVTEWNLVCEDNWKVPLTTSLFFVGVLLGSFVSGQLSDRFGRKNVLFATMAVQTGFSFLQIFSISWEMFTVLFVIVGMGQISNYVVAFILGTEILGKSVRIIFSTLGVCTFFAVGYMLLPLFAYFIRDWRMLLLALTVPGVLCVPLWWFIPESPRWLISQRRFREAEDIIQKAAKMNNIAVPAVIFDSVEELNPLKQQKAFILDLFRTRNIAIMTIMSLLLWMLTSVGYFALSLDAPNLHGDAYLNCFLSALIEIPAYITAWLLLRTLPRRYIIAAVLFWGGGVLLFIQLVPVDYYFLSIGLVMLGKFGITSAFSMLYVFTAELYPTLVRNMAVGVTSTASRVGSIIAPYFVYLGAYNRMLPYIVMGSLTVLIGILTLFFPESLGMTLPETLEQMQKVKWFRSGKKTRDSMETEENPKVLITAF

SEQ ID NO: 80797 - protein, 541 aa, Homo sapiens
  Payload ID: 16102
  Gene Symbol: SLC22A10
  Gene Name: solute carrier family 22, member 10
  Uniprot ID: Q63ZE4
  ENSP ID: ENSP00000327569
MAFEELLSQVGGLGRFQMLHLVFILPSLMLLIPHILLENFAAAIPGHRCWVHMLDNNTGSGNETGILSEDALLRISIPLDSNLRPEKCRRFVHPQWQLLHLNGTIHSTSEADTEPCVDGWVYDQSYFPSTIVTKWDLVCDYQSLKSVVQFLLLTGMLVGGIIGGHVSDRFGRRFILRWCLLQLAITDTCAAFAPTFPVYCVLRFLAGFSSMIIISNNSLPITEWIRPNSKALVVILSSGALSIGQIILGGLAYVFRDWQTLHVVASVPFFVFFLLSRWLVESARWLIITNKLDEGLKALRKVARTNGIKNAEETLNIEVVRSTMQEELDAAQTKTTVCDLFRNPSMRKRICILVFLRFANTIPFYGTMVNLQHVGSNIFLLQVLYGAVALIVRCLALLTLNHMGRRISQILFMFLVGLSILANTFVPKEMQTLRVALACLGIGCSAATFSSVAVHFIELIPTVLRARASGIDLTASRIGAALAPLLMTLTVFFTTLPWIIYGIFPIIGGLIVFLLPETKNLPLPDTIKDVENQKKNLKEKA

SEQ ID NO: 80798 - protein, 372 aa, Homo sapiens
  Payload ID: 16102
  Gene Symbol: SLC22A10
  Gene Name: solute carrier family 22, member 10
  ENSP ID: ENSP00000433048
MLDNNTGSGNETGILSEDALLRISIPLDSNLRPEKCRRFVHPQWQLLHLNGTIHSTSEADTEPCVDGWVYDQSYFPSTIVTKWDLVCDYQSLKSVVQFLLLTGMLVGGIIGGHVSDRFGRRFILRWCLLQLAITDTCAAFAPTFPVYCVLRFLAGFSSMIIISNNSLPITEWIRPNSKALVVILSSGALSIGQIILGGLAYVFRDWQTLHVVASVPFFVFFLLSRWLVESARWLIITNKLDEGLKALRKVARTNGIKNAEETLNIEVVRSTMQEELDAAQTKTTVCDLFRNPSMRKRICILVFLRFANTIPFYGTMVNLQHVGSNIFLLQKCRPCVWLWHVWESAVLLLLFPVLLFTSLNSSPLFSGQELQE

SEQ ID NO: 80799 - protein, 264 aa, Homo sapiens
  Payload ID: 16102
  Gene Symbol: SLC22A10
  Gene Name: solute carrier family 22, member 10
  ENSP ID: ENSP00000433817
MLDNNTGSGNETGILSEDALLRISIPLDSNLRPEKCRRFVHPQWQLLHLNGTIHSTSEADTEPCVDGWVYDQSYFPSTIVTKWDLVCDYQSLKSVVQFLLLTGMLVGGIIGGHVSDRWLVESARWLIITNKLDEGLKALRKVARTNGIKNAEETLNIEVVRSTMQEELDAAQTKTTVCDLFRNPSMRKRICILVFLRFANTIPFYGTMVNLQHVGSNIFLLQKCRPCVWLWHVWESAVLLLLFPVLLFTSLNSSPLFSGQELQE

SEQ ID NO: 80800 - protein, 205 aa, Homo sapiens
  Payload ID: 16102
  Gene Symbol: SLC22A10
  Gene Name: solute carrier family 22, member 10
  ENSP ID: ENSP00000433908
MLDNNTGSGNETGILSEDALLRISIPLDSNLRPEKCRRFVHPQWQLLHLNGTIHSTSEADTEPCVDGWVYDQSYFPSTIVTKWDLVCDYQSLKSVVQFLLLTGMLVGGIIGGHVSDRWLVESARWLIITNKLDEGLKALRKVARTNGIKNAEETLNIEVVRSTMQEELDAAQTKTTVCDLFRNPSMRKRICILVFLRKKNLKEKA

SEQ ID NO: 80801 - protein, 594 aa, Homo sapiens
  Payload ID: 16103
  Gene Symbol: SLC22A14
  Gene Name: solute carrier family 22, member 14
  Uniprot ID: Q9Y267
  ENSP ID: ENSP00000273173
MAGEENFKEELRSQDASRNLNQHEVAGHPHSWSLEMLLRRLRAVHTKQDDKFANLLDAVGEFGTFQQRLVALTFIPSIMSAFFMFADHFVFTAQKPYCNTSWILAVGPHLSKAEQLNLTIPQAPNGSFLTCFMYLPVPWNLDSIIQFGLNDTDTCQDGWIYPDAKKRSLINEFDLVCGMETKKDTAQIMFMAGLPIGSLIFRLITDKMGRYPAILLSLLGLIIFGFGTAFMNSFHLYLFFRFGISQSVVGYAISSISLATEWLVGEHRAHAIILGHCFFAVGAVLLTGIAYSLPHWQLLFLVGGILVIPFISYIWILPESPRWLMMKGKVKEAKQVLCYAASVNKKTIPSNLLDELQLPRKKVTRASVLDFCKNRQLCKVTLVMSCVWFTVSYTYFTLSLRMRELGVSVHFRHVVPSIMEVPARLCCIFLLQQIGRKWSLAVTLLQAIIWCLLLLFLPEGEDGLRLKWPRCPATELKSMTILVLMLREFSLAATVTVFFLYTAELLPTVLRATGLGLVSLASVAGAILSLTIISQTPSLLPIFLCCVLAIVAFSLSSLLPETRDQPLSESLNHSSQIRNKVKDMKTKETSSDDV

SEQ ID NO: 80802 - protein, 594 aa, Homo sapiens; identical to SEQ ID NO: 80801
  Payload ID: 16103
  Gene Symbol: SLC22A14
  Gene Name: solute carrier family 22, member 14
  Uniprot ID: Q9Y267
  ENSP ID: ENSP00000396283

SEQ ID NO: 80803 - protein, 119 aa, Homo sapiens
  Payload ID: 16103
  Gene Symbol: SLC22A14
  Gene Name: solute carrier family 22, member 14
  ENSP ID: ENSP00000442528
MYLPVPWNLDSIIQFGLNDTDTCQDGWIYPDAKKRSLINEFDLVCGMETKKDTAQIMFMAGLPIGSLIFRLITDKMGRYPAILLSLLGLIIFGFGTAFMNSFHLYLFFRFGISQSVVGY

SEQ ID NO: 80804 - protein, 245 aa, Homo sapiens
  Payload ID: 16104
  Gene Symbol: SLC22A15
  Gene Name: solute carrier family 22, member 15
  Uniprot ID: Q8IZD6
  ENSP ID: ENSP00000358514
MEVEEAFQAVGEMGIYQMYLCFLLAVLLQLYVATEAILIALVGATPSYHWDLAELLPNQSHGNQSAGEDQAFGDWLLTANGSEIHKHVHFSSSFTSIASEWFLIANRSYKVSAASSFFFSGVFVGVISFGQLSDRFGRKKVYLTGFALDILFAIANGFSPSYEFFAVTRFLVGMMNGGMSLVAFVLLNECVGTAYWALAGSIGGLFFAVGIAQYALLGYFIRSWRTLAILVNLQGTVVFLLSLVD

SEQ ID NO: 80805 - protein, 547 aa, Homo sapiens
  Payload ID: 16104
  Gene Symbol: SLC22A15
  Gene Name: solute carrier family 22, member 15
  Uniprot ID: Q8IZD6
  ENSP ID: ENSP00000358515
MEVEEAFQAVGEMGIYQMYLCFLLAVLLQLYVATEAILIALVGATPSYHWDLAELLPNQSHGNQSAGEDQAFGDWLLTANGSEIHKHVHFSSSFTSIASEWFLIANRSYKVSAASSFFFSGVFVGVISFGQLSDRFGRKKVYLTGFALDILFAIANGFSPSYEFFAVTRFLVGMMNGGMSLVAFVLLNECVGTAYWALAGSIGGLFFAVGIAQYALLGYFIRSWRTLAILVNLQGTVVFLLSLFIPESPRWLYSQGRLSEAEEALYLIAKRNRKLKCTFSLTHPANRSCRETGSFLDLFRYRVLLGHTLILMFIWFVCSLVYYGLTLSAGDLGGSIYANLALSGLIEIPSYPLCIYLINQKWFGRKRTLSAFLCLGGLACLIVMFLPEKKDTGVFAVVNSHSLSLLGKLTISAAFNIVYIYTSELYPTVIRNVGLGTCSMFSRVGGIIAPFIPSLKYVQWSLPFIVFGATGLTSGLLSLLLPETLNSPLLETFSDLQVYSYRRLGEEALSLQALDPQQCVDKESSLGSESEEEEEFYDADEETQMIK

SEQ ID NO: 80806 - protein, 538 aa, Homo sapiens
  Payload ID: 16105
  Gene Symbol: SLC22A17
  Gene Name: solute carrier family 22, member 17
  Uniprot ID: Q8WUG5
  ENSP ID: ENSP00000206544
MASDPIFTLAPPLHCHYGAFPPNASGWEQPPNASGVSVASAALAASAASRVATSTDPSCSGFAPPDFNHCLKDWDYNGLPVLTTNAIGQWDLVCDLGWQVILEQILFILGFASGYLFLGYPADRFGRRGIVLLTLGLVGPCGVGGAAAGSSTGVMALRFLLGFLLAGVDLGVYLMRLELCDPTQRLRVALAGELVGVGGHFLFLGLALVSKDWRFLQRMITAPCILFLFYGWPGLFLESARWLIVKRQIEEAQSVLRILAERNRPHGQMLGEEAQEALQDLENTCPLPATSSFSFASLLNYRNIWKNLLILGFTNFIAHAIRHCYQPVGGGGSPSDFYLCSLLASGTAALACVFLGVTVDRFGRRGILLLSMTLTGIASLVLLGLWDCEHPIFPTVWAQQGNPNRDLNEAAITTFSVLGLFSSQAAAILSTLLAAEVIPTTVRGRGLGLIMALGALGGLSGPAQRLHMGHGAFLQHVVLAACALLCILSIMLLPETKRKLLPEVLRDGELCRRPSLLRQPPPTRCDHVPLLATPNPAL

SEQ ID NO: 80807 - protein, 520 aa, Homo sapiens
  Payload ID: 16105
  Gene Symbol: SLC22A17
  Gene Name: solute carrier family 22, member 17
  Uniprot ID: Q8WUG5
  ENSP ID: ENSP00000346824
MASDPIFTLAPPLHCHYGAFPPNASGWEQPPNASGVSVASAALAASAASRVATSTDPSCSGFAPPDFNHCLKDWDYNGLPVLTTNAIGQWDLVCDLGWQVILEQILFILGFASGYLFLGYPADRFGRRGIVLLTLGLVGPCGVGGAAAGSSTGVMALRFLLGFLLAGVDLGVYLMRLELCDPTQRLRVALAGELVGVGGHFLFLGLALVSKDWRFLQRMITAPCILFLFYGWPGLFLESARWLIVKRQIEEAQSVLRILAERNRPHGQMLGEEAQEALQDLENTCPLPATSSFSFASLLNYRNIWKNLLILGFTNFIAHAIRHCYQPVGGGGSPSDFYLCSLLASGTAALACVFLGVTVDRFGRRGILLLSMTLTGIASLVLLGLWDYLNEAAITTFSVLGLFSSQAAAILSTLLAAEVIPTTVRGRGLGLIMALGALGGLSGPAQRLHMGHGAFLQHVVLAACALLCILSIMLLPETKRKLLPEVLRDGELCRRPSLLRQPPPTRCDHVPLLATPNPAL

SEQ ID NO: 80808 - protein, 409 aa, Homo sapiens
  Payload ID: 16105
  Gene Symbol: SLC22A17
  Gene Name: solute carrier family 22, member 17
  ENSP ID: ENSP00000380430
MAFLCSPPTPSARFGRRGIVLLTLGLVGPCGVGGAAAGSSTGVMALRFLLGFLLAGVDLGVYLMRLELCDPTQRLRVALAGELVGVGGHFLFLGLALVSKDWRFLQRMITAPCILFLFYGWPGLFLESARWLIVKRQIEEAQSVLRILAERNRPHGQMLGEEAQEALQDLENTCPLPATSSFSFASLLNYRNIWKNLLILGFTNFIAHAIRHCYQPVGGGGSPSDFYLCSLLASGTAALACVFLGVTVDRFGRRGILLLSMTLTGIASLVLLGLWDYLNEAAITTFSVLGLFSSQAAAILSTLLAAEVIPTTVRGRGLGLIMALGALGGLSGPAQRLHMGHGAFLQHVVLAACALLCILSIMLLPETKRKLLPEVLRDGELCRRPSLLRQPPPTRCDHVPLLATPNPAL

SEQ ID NO: 80809 - protein, 538 aa, Homo sapiens; identical to SEQ ID NO: 80806
  Payload ID: 16105
  Gene Symbol: SLC22A17
  Gene Name: solute carrier family 22, member 17
  Uniprot ID: Q8WUG5
  ENSP ID: ENSP00000380437

SEQ ID NO: 80810 - protein, 424 aa, Homo sapiens
  Payload ID: 16106
  Gene Symbol: SLC22A18
  Gene Name: solute carrier family 22, member 18
  Uniprot ID: Q96BI1
  ENSP ID: ENSP00000307859
MQGARAPRDQGRSPGRMSALGRSSVILLTYVLAATELTCLFMQFSIVPYLSRKLGLDSIAFGYLQTTFGVLQLLGGPVFGRFADQRGARAALTLSFLAALALYLLLAAASSPALPGVYLLFASRLPGALMHTLPAAQMVITDLSAPEERPAALGRLGLCFGVGVILGSLLGGTLVSAYGIQCPAILAALATLLGAVLSFTCIPASTKGAKTDAQAPLPGGPRASVFDLKAIASLLRLPDVPRIFLVKVASNCPTGLFMVMFSIISMDFFQLEAAQAGYLMSFFGLLQMVTQGLVIGQLSSHFSEEVLLRASVLVFIVVGLAMAWMSSVFHFCLLVPGLVFSLCTLNVVTDSMLIKAVSTSDTGTMLGLCASVQPLLRTLGPTVGGLLYRSFGVPVFGHVQVAINTLVLLVLWRKPMPQRKDKVR

SEQ ID NO: 80811 - protein, 424 aa, Homo sapiens; identical to SEQ ID NO: 80810
  Payload ID: 16106
  Gene Symbol: SLC22A18
  Gene Name: solute carrier family 22, member 18
  Uniprot ID: Q96BI1
  ENSP ID: ENSP00000311139

SEQ ID NO: 80812 - protein, 424 aa, Homo sapiens; identical to SEQ ID NO: 80810
  Payload ID: 16106
  Gene Symbol: SLC22A18
  Gene Name: solute carrier family 22, member 18
  Uniprot ID: Q96BI1
  ENSP ID: ENSP00000369948

SEQ ID NO: 80813 - protein, 326 aa, Homo sapiens
  Payload ID: 16106
  Gene Symbol: SLC22A18
  Gene Name: solute carrier family 22, member 18
  ENSP ID: ENSP00000392072
MQGARAPRDQGRSPGRMSALGRSSVILLTYVLAATELTCLFMQFSIVPYLSRKLGLDSIAFGYLQTTFGVLQLLGGPVFGRIQCPAILAALATLLGAVLSFTCIPASTKGAKTDAQAPLPGGPRASVFDLKAIASLLRLPDVPRIFLVKVASNCPTGLFMVMFSIISMDFFQLEAAQAGYLMSFFGLLQMVTQGLVIGQLSSHFSEEVLLRASVLVFIVVGLAMAWMSSVFHFCLLVPGLVFSLCTLNVVTDSMLIKAVSTSDTGTMLGLCASVQPLLRTLGPTVGGLLYRSFGVPVFGHVQVAINTLVLLVLWRKPMPQRKDKVR

SEQ ID NO: 80814 - protein, 134 aa, Homo sapiens
  Payload ID: 16106
  Gene Symbol: SLC22A18
  Gene Name: solute carrier family 22, member 18
  ENSP ID: ENSP00000433019
MQGARAPRDQGRSPGRMSALGRSSVILLTYVLAATELTCLFMQFSIVPYLSRKLGLDSIAFGYLQTTFGVLQLLGGPVFGRFADQRGARAALTLSFLAALALYLLLAAASSPALPGVYLLFASRLPGALMHTLP

SEQ ID NO: 80815 - protein, 424 aa, Homo sapiens
  Payload ID: 16106
  Gene Symbol: SLC22A18
  Gene Name: solute carrier family 22, member 18
  ENSP ID: ENSP00000479357
MQGARAPRDQGQSPGRMSALGRSSVILLTYVLAATELTCLFMQFSIVPYLSRKLGLDSIAFGYLQTTFGVLQLLGGPVFGRFADQRGARAALTLSFLAALALYLLLAAASSPALPGVYLLFASRLPGALMHTLPAAQMVITDLSAPEERPAALGRLGLCFGVGVILGSLLGGTLVSAYGIQCPAILAALATLLGAVLSFTCIPASTKGAKTDAQAPLPGGPRASVFDLKAIASLLRLPDVPRIFLVKVASNCPTGLFMVMFSIISMDFFQLEAAQAGYLMSFFGLLQMVTQGLVIGQLSSHFSEEVLLRASVLVFIVVGLAMAWMSSVFHFCLLVPGLVFSLCTLNVVTDSMLIKAVSTSDTGTMLGLCASVQPLLRTLGPTVGGLLYRSFGVPVFGHVQVAINTLVLLVLWRKPMPQRKDKVR

SEQ ID NO: 80816 - protein, 424 aa, Homo sapiens; identical to SEQ ID NO: 80815
  Payload ID: 16106
  Gene Symbol: SLC22A18
  Gene Name: solute carrier family 22, member 18
  ENSP ID: ENSP00000480848

SEQ ID NO: 80817 - protein, 424 aa, Homo sapiens; identical to SEQ ID NO: 80815
  Payload ID: 16106
  Gene Symbol: SLC22A18
  Gene Name: solute carrier family 22, member 18
  ENSP ID: ENSP00000482330

SEQ ID NO: 80818 - protein, 326 aa, Homo sapiens
  Payload ID: 16106
  Gene Symbol: SLC22A18
  Gene Name: solute carrier family 22, member 18
  ENSP ID: ENSP00000488029
MQGARAPRDQGQSPGRMSALGRSSVILLTYVLAATELTCLFMQFSIVPYLSRKLGLDSIAFGYLQTTFGVLQLLGGPVFGRIQCPAILAALATLLGAVLSFTCIPASTKGAKTDAQAPLPGGPRASVFDLKAIASLLRLPDVPRIFLVKVASNCPTGLFMVMFSIISMDFFQLEAAQAGYLMSFFGLLQMVTQGLVIGQLSSHFSEEVLLRASVLVFIVVGLAMAWMSSVFHFCLLVPGLVFSLCTLNVVTDSMLIKAVSTSDTGTMLGLCASVQPLLRTLGPTVGGLLYRSFGVPVFGHVQVAINTLVLLVLWRKPMPQRKDKVR

SEQ ID NO: 80819 - protein, 134 aa, Homo sapiens
  Payload ID: 16106
  Gene Symbol: SLC22A18
  Gene Name: solute carrier family 22, member 18
  ENSP ID: ENSP00000488483
MQGARAPRDQGQSPGRMSALGRSSVILLTYVLAATELTCLFMQFSIVPYLSRKLGLDSIAFGYLQTTFGVLQLLGGPVFGRFADQRGARAALTLSFLAALALYLLLAAASSPALPGVYLLFASRLPGALMHTLP

SEQ ID NO: 80820 - protein, 361 aa, Homo sapiens
  Payload ID: 16107
  Gene Symbol: SLC22A23
  Gene Name: solute carrier family 22, member 23
  Uniprot ID: A1A5C7
  ENSP ID: ENSP00000369653
MAIDRRREAAGGGPGRQPAPAEENGSLPPGDAAASAPLGGRAGPGGGAEIQPLPPLHPGGGPHPSCCSAAAAPSLLLLDYDGSVLPFLGGLGGGYQKTLVLLTWIPALFIGFSQFSDSFLLDQPNFWCRGAGKGTELAGVTTTGRGGDMGNWTSLPTTPFATAPWEAAGNRSNSSGADGGDTPPLPSPPDKGDNASNCDCRAWDYGIRAGLVQNVVSKWDLVCDNAWKVHIAKFSLLVGLIFGYLITGCIADWVGRRPVLLFSIIFILIFGLTVALSVNVTMFSTLRFFEGFCLAGIILTLYALRIELCPPGKRFMITMVASFVAMAGQFLMPGLAALCRDWQVLQALIICPFLLMLLYWS

SEQ ID NO: 80821 - protein, 405 aa, Homo sapiens
  Payload ID: 16107
  Gene Symbol: SLC22A23
  Gene Name: solute carrier family 22, member 23
  Uniprot ID: A1A5C7
  ENSP ID: ENSP00000369657
MFSTLRFFEGFCLAGIILTLYALRIELCPPGKRFMITMVASFVAMAGQFLMPGLAALCRDWQVLQALIICPFLLMLLYWSIFPESLRWLMATQQFESAKRLILHFTQKNRMNPEGDIKGVIPELEKELSRRPKKVCIVKVVGTRNLWKNIVVLCVNSLTGYGIHHCFARSMMGHEVKVPLLENFYADYYTTASIALVSCLAMCVVVRFLGRRGGLLLFMILTALASLLQLGLLNLIGKYSQHPDSGMSDSVKDKFSIAFSIVGMFASHAVGSLSVFFCAEITPTVIRCGGLGLVLASAGFGMLTAPIIELHNQKGYFLHHIIFACCTLICIICILLLPESRDQNLPENISNGEHYTRQPLLPHKKGEQPLLLTNAELKDYSGLHDAAAAGDTLPEGATANGMKAM

SEQ ID NO: 80822 - protein, 686 aa, Homo sapiens
  Payload ID: 16107
  Gene Symbol: SLC22A23
  Gene Name: solute carrier family 22, member 23
  Uniprot ID: A1A5C7
  ENSP ID: ENSP00000385028
MAIDRRREAAGGGPGRQPAPAEENGSLPPGDAAASAPLGGRAGPGGGAEIQPLPPLHPGGGPHPSCCSAAAAPSLLLLDYDGSVLPFLGGLGGGYQKTLVLLTWIPALFIGFSQFSDSFLLDQPNFWCRGAGKGTELAGVTTTGRGGDMGNWTSLPTTPFATAPWEAAGNRSNSSGADGGDTPPLPSPPDKGDNASNCDCRAWDYGIRAGLVQNVVSKWDLVCDNAWKVHIAKFSLLVGLIFGYLITGCIADWVGRRPVLLFSIIFILIFGLTVALSVNVTMFSTLRFFEGFCLAGIILTLYALRIELCPPGKRFMITMVASFVAMAGQFLMPGLAALCRDWQVLQALIICPFLLMLLYWSIFPESLRWLMATQQFESAKRLILHFTQKNRMNPEGDIKGVIPELEKELSRRPKKVCIVKVVGTRNLWKNIVVLCVNSLTGYGIHHCFARSMMGHEVKVPLLENFYADYYTTASIALVSCLAMCVVVRFLGRRGGLLLFMILTALASLLQLGLLNLIGKYSQHPDSGMSDSVKDKFSIAFSIVGMFASHAVGSLSVFFCAEITPTVIRCGGLGLVLASAGFGMLTAPIIELHNQKGYFLHHIIFACCTLICIICILLLPESRDQNLPENISNGEHYTRQPLLPHKKGEQPLLLTNAELKDYSGLHDAAAAGDTLPEGATANGMKAM

SEQ ID NO: 80823 - protein, 694 aa, Homo sapiens
  Payload ID: 16107
  Gene Symbol: SLC22A23
  Gene Name: solute carrier family 22, member 23
  ENSP ID: ENSP00000410245
MAIDRRREAAGGGPGRQPAPAEENGSLPPGDAAASAPLGGRAGPGGGAEIQPLPPLHPGGGPHPSCCSAAAAPSLLLLDYDGSVLPFLGGLGGGYQKTLVLLTWIPALFIGFSQFSDSFLLDQPNFWCRGAGKGTELAGVTTTGRGGDMGNWTSLPTTPFATAPWEAAGNRSNSSGADGGDTPPLPSPPDKGDNASNCDCRAWDYGIRAGLVQNVVSKWDLVCDNAWKVHIAKFSLLVGLIFGYLITGCIADWVGRRPVLLFSIIFILIFGLTVALSVNVTMFSTLRFFEGFCLAGIILTLYALRIELCPPGKRFMITMVASFVAMAGQFLMPGLAALCRDWQVLQALIICPFLLMLLYWSIFPESLRWLMATQQFESAKRLILHFTQKNRMNPEGDIKGVIPELEKELSRRPKKVCIVKVVGTRNLWKNIVVLCVNSLTGYGIHHCFARSMMGHEVKVPLLENFYADYYTTASIALVSCLAMCVVVRFLGRRGGLLLFMILTALASLLQLGLLNLIGKYSQHPDSELQLKLAVGMSDSVKDKFSIAFSIVGMFASHAVGSLSVFFCAEITPTVIRCGGLGLVLASAGFGMLTAPIIELHNQKGYFLHHIIFACCTLICIICILLLPESRDQNLPENISNGEHYTRQPLLPHKKGEQPLLLTNAELKDYSGLHDAAAAGDTLPEGATANGMKAM

SEQ ID NO: 80824 - protein, 92 aa, Homo sapiens
  Payload ID: 16107
  Gene Symbol: SLC22A23
  Gene Name: solute carrier family 22, member 23
  ENSP ID: ENSP00000417737
MFSTLRFFEGFCLAGIILTLYALRIELCPPGKRFMITMVASFVAMAGQFLMPGLAALCRDWQVLQALIICPFLLMLLYWSYYLWLLSGYSQS

SEQ ID NO: 80825 - protein, 440 aa, Homo sapiens
  Payload ID: 16107
  Gene Symbol: SLC22A23
  Gene Name: solute carrier family 22, member 23
  ENSP ID: ENSP00000418134
NSSGADGGDTPPLPSPPDKGDNASNCDCRAWDYGIRAGLVQNVVSKWDLVCDNAWKVHIAKFSLLVGLIFGYLITGCIADWVGRRPVLLFSIIFILIFGLTVALSVNVTMFSTLRFFEGFCLAGIILTLYALRIELCPPGKRFMITMVASFVAMAGQFLMPGLAALCRDWQVLQALIICPFLLMLLYWSIFPESLRWLMATQQFESAKRLILHFTQKNRMNPEGDIKGVIPELEKELSRRPKKVCIVKVVGTRNLWKNIVVLCVNSLTGYGIHHCFARSMMGHEVKVPLLENFYADYYTTASIALVSCLAMCVVVRFLGRRGGLLLFMILTALASLLQLGLLNLIGKYSQHPDSGMSDSVKDKFSIAFSIVGMFASHAVGSLSVFFCAEITPTVIRCVMGDTPGDAGFSEIKDESLAPGWCGINQRQLCLWLWTHQLRGS

SEQ ID NO: 80826 - protein, 386 aa, Homo sapiens
  Payload ID: 16107
  Gene Symbol: SLC22A23
  Gene Name: solute carrier family 22, member 23
  ENSP ID: ENSP00000418985
MPVGPQHPSFKRSSLDTFHGCCQQQETGALPWDTDTKRWRPELNWDLVCDNAWKVHIAKFSLLVGLIFGYLITGCIADWVGRRPVLLFSIIFILIFGLTVALSVNVTMFSTLRFFEGFCLAGIILTLYALRIELCPPGKRFMITMVASFVAMAGQFLMPGLAALCRDWQVLQALIICPFLLMLLYWSIFPESLRWLMATQQFESAKRLILHFTQKNRMNPEGDIKGVIPELEKELSRRPKKVCIVKVVGTRNLWKNIVVLCVNSLTGYGIHHCFARSMMGHEVKVPLLENFYADYYTTASIALVSCLAMCVVVRFLGRRGGLLLFMILTALASLLQLGLLNLIGKYSQHPDSGMSDSVKDKFSIAFSIVGMFASHAVGSLSVFFCA

SEQ ID NO: 80827 - protein, 405 aa, Homo sapiens; identical to SEQ ID NO: 80821
  Payload ID: 16107
  Gene Symbol: SLC22A23
  Gene Name: solute carrier family 22, member 23
  Uniprot ID: A1A5C7
  ENSP ID: ENSP00000419463

SEQ ID NO: 80828 - protein, 322 aa, Homo sapiens
  Payload ID: 16108
  Gene Symbol: SLC22A24
  Gene Name: solute carrier family 22, member 24
  Uniprot ID: Q8N4F4
  ENSP ID: ENSP00000321549
MGFDVLLDQVGGMGRFQICLIAFFCITNILLFPNIVLENFTAFTPSHRCWVPLLDNDTVSDNDTGTLSKDDLLRISIPLDSNLRPQKCQRFIHPQWQLLHLNGTFPNTNEPDTEPCVDGWVYDRSSFLSTIVTEWDLVCESQSLKSMVQSLFMAGSLLGGLIYGHLSDRVGRKIICKLCFLQLAISNTCAAFAPTFLVYCILRFLAGFSTMTILGNTFILSLEWTLPRSRSMTIMVLLCSYSVGQMLLGGLAFAIQDWHILQLTVSTPIIVLFLSSWYEQSPHSLPVSEAMVDIERKILTPGICSVSGLVLSHDVHSTYCVT

SEQ ID NO: 80829 - protein, 551 aa, Homo sapiens
  Payload ID: 16108
  Gene Symbol: SLC22A24
  Gene Name: solute carrier family 22, member 24
  ENSP ID: ENSP00000396586
MGFDVLLDQVGGMGRFQICLIAFFCITNILLFPNIVLENFTAFTPSHRCWVPLLDNDTVSDNDTGTLSKDDLLRISIPLDSNLRPQKCQRFIHPQWQLLHLNGTFPNTNEPDTEPCVDGWVYDRSSFLSTIVTEWDLVCESQSLKSMVQSLFMAGSLLGGLIYGHLSDRVGRKIICKLCFLQLAISNTCAAFAPTFLVYCILRFLAGFSTMTILGNTFILSLEWTLPRSRSMTIMVLLCSYSVGQMLLGGLAFAIQDWHILQLTVSTPIIVLFLSSWKMVESARWLIINNQLDEGLKELRRVAHINGKKNTEETLTTELVRSTMKKELDAVRIKTSIFSLFRAPKLRMRVFGLCFVRFAITVPFYGLILNLQHLGSNVSLFQILCGAVTFTARCVSLLTLNHMGRRISQILFTFPVGLFILVNTFLPQEMQILRVVLATLGIGSVSAASNSASVHHNELVPTILRSTVAGINAVSGRTGAALAPLLMTLMAYSPHLPWISYGVFPILAVPVILLLPETRDLPLPNTIQDVENEKDSRNIKQEDTCMKVTQF

SEQ ID NO: 80830 - protein, 552 aa, Homo sapiens
  Payload ID: 16108
  Gene Symbol: SLC22A24
  Gene Name: solute carrier family 22, member 24
  ENSP ID: ENSP00000480336
MGFDVLLDQVGGMGRFQICLIAFFCITNILLFPNIVLENFTAFTPSHRCWVPLLDNDTVSDNDTGTLSKDDLLRISIPLDSNLRPQKCQRFIHPQWQLLHLNGTFPNTNEPDTEPCVDGWVYDRSSFLSTIVTEWDLVCESQSLKSMVQSLFMAGSLLGGLIYGHLSDRVGRKIICKLCFLQLAISNTCAAFAPTFLVYCILRFLAGFSTMTILGNTFILSLEWTLPRSRSMTIMVLLCSYSVGQMLLGGLAFAIQDWHILQLTVSTPIIVLFLSSWKMVESARWLIINNQLDEGLKELRRVAHINGKKNTEETLTTELVRSTMKKELDAVRIKTSIFSLFRAPKLRMRVFGLCFVRFAITVPFYGLILNLQHLGSNVSLFQILCGAVTFTARCVSLLTLNHMGRRISQILFTFPVGLFILVNTFLPQEMQILRVVLATLGIGSVSAASNSASVHHNELVPTILRSTVAGINAVSGRTGAALAPLLMTLMAYSPHLPWISYGVFPILAVPVILLLPETRDLPLPNTIQDVENDRKDSRNIKQEDTCMKVTQF

SEQ ID NO: 80831 - protein, 547 aa, Homo sapiens
  Payload ID: 16109
  Gene Symbol: SLC22A25
  Gene Name: solute carrier family 22, member 25
  Uniprot ID: Q6T423
  ENSP ID: ENSP00000307443
MAFQDLLDQVGGLGRFQILQMVFLIMFNVIVYHQTQLENFAAFILDHRCWVHILDNDTIPDNDPGTLSQDALLRISIPFDSNLRPEKCRRFVHPQWKLIHLNGTFPNTSEPDTEPCVDGWVYDQSSFPSTIVTKWDLVCESQPLNSVAKFLFMAGMMVGGNLYGHLSDRFGRKFVLRWSYLQLAIVGTCAAFAPTILVYCSLRFLAGAATFSIIVNTVLLIVEWITHQFCAMALTLTLCAASIGHITLGSLAFVIRDQCILQLVMSAPCFVFFLFSRWLAESARWLIINNKPEEGLKELRKAAHRNGMKNAEDILTMEVLKSTMKQELEAAQKKHSLCELLRIPNICKRICFLSFVRFASTIPFWGLTLHLQHLGNNVFLLQTLFGAVTLLANCVAPWALNHMSRRLSQMLLMFLLATCLLAIIFVPQEMQTLRVVLATLGVGAASLGITCSTAQENELIPSIIRGRATGITGNFANIGGALASLMMILSIYSRPLPWIIYGVFAILSGLVVLLLPETRNQPLLDSIQDVENEGVNSLAAPQRSSVL

SEQ ID NO: 80832 - protein, 202 aa, Homo sapiens
  Payload ID: 16109
  Gene Symbol: SLC22A25
  Gene Name: solute carrier family 22, member 25
  ENSP ID: ENSP00000431235
  MOD_RES (1)..(1): Any amino acid
XAFQDLLDQVGGLGRFQILQMVFLIMFNVIVYHQTQLENFAAFILDHRCWVHILDNDTIPDNDPGTLSQDALLRISIPFDSNLRPEKCRRFVHPQWKLIHLNGTFPNTSEPDTEPCVDGWVYDQSSFPSTIVTKWDLVCESQPLNSVAKFLFMAGMMVGGNLYGHLSDRKPLSSPNHVSTDCDEGLEVPIAIHQHHVFWYLS

SEQ ID NO: 80833 - protein, 399 aa, Homo sapiens
  Payload ID: 16109
  Gene Symbol: SLC22A25
  Gene Name: solute carrier family 22, member 25
  ENSP ID: ENSP00000432242
  MOD_RES (1)..(1): Any amino acid
XFQDLLDQVGGLGRFQILQMVFLIMFNVIVYHQTQLENFAAFILDHRCWVHILDNDTIPDNDPGTLSQDALLRISIPFDSNLRPEKCRRFVHPQWKLIHLNGTFPNTSEPDTEPCVDGWVYDQSSFPSTIVTKWDLVCESQPLNSVAKFLFMAGMMVGGNLYGHLSDRFGRKFVLRWSYLQLAIVGTCAAFAPTILVYCSLRFLAGAATFSIIVNTVLLIVEWITHQFCAMALTLTLCAASIGHITLGSLAFVIRDQCILQLVMSAPCFVFFLFSRWLAESARWLIINNKPEEGLKELRKAAHRNGMKNAEDILTMEVLKSTMKQELEAAQKKHSLCELLRIPNICKRICFLSFVRSAGVCWRSTPDPVCLGITSGGCRTAKIPACSFLWKLHFRGAPA

SEQ ID NO: 80834 - protein, 156 aa, Homo sapiens
  Payload ID: 16109
  Gene Symbol: SLC22A25
  Gene Name: solute carrier family 22, member 25
  ENSP ID: ENSP00000435614
MAFQDLLDQVGGLGRFQILQMVFLIMFNVIVYHQTQLENFAAFILDHRCWVHILDNDTIPDNDPGTLSQDALLRISIPFDSNLRPEKCRRFVHPQWKLIHLNGTFPNTSEPDTEPCVDGWVYDQSSFPSTIVTKVAGRVCSVAHYQQQTRRGLKGT

SEQ ID NO: 80835 - protein, 556 aa, Homo sapiens
  Payload ID: 16110
  Gene Symbol: SLC22A31
  Gene Name: solute carrier family 22, member 31
  ENSP ID: ENSP00000474621
MEQEARVLRAAGGFGRARRLLASASWVPCIVLGLVLSSEELLTAQPAPHCRPDPTLLPPALRALRGPALLDAAIPRLGPTRAPAEALGVLSPSYLAPLTRAPRPSSWASCSGAAAGPTWNLVCGDGWKVPLEQVSHLLGWLLGCVILGAGCDRFGRRAVFVASLVLTTGLGASEALAASFPTLLVLRLLHGGTLAGALLALYLARLELCDPPHRLAFSMGAGLFSVVGTLLLPGLAALVQDWRLLQGLGALMSGLLLLFWGFPALFPESPCWLLATGQVARARKILWRFAEASGVGPGDSSLEENSLATELTMLSARSPQPRYHSPLGLLRTRVTWRNGLILGFSSLVGGGIRASFRRSLAPQVPTFYLPYFLEAGLEAAALVFLLLTADCCGRRPVLLLGTMVTGLASLLLLAGAQYLPGWTVLFLSVLGLLASRAVSALSSLFAAEVFPTVIRGAGLGLVLGAGFLGQAAGPLDTLHGRQGFFLQQVVFASLAVLALLCVLLLPESRSRGLPQSLQDADRLRRSPLLRGRPRQDHLPLLPPSNSYWAGHTPEQH

SEQ ID NO: 80836 - protein, 338 aa, Homo sapiens
  Payload ID: 16110
  Gene Symbol: SLC22A31
  Gene Name: solute carrier family 22, member 31
  ENSP ID: ENSP00000481421
MGAGLFSVVGTLLLPGLAALVQDWRLLQGLGALMSGLLLLFWGFPALFPESPCWLLATGQVARARKILWRFAEASGVGPGDSSLEENSLATELTMLSARSPQPRYHSPLGLLRTRVTWRNGLILGFSSLVGGGIRASFRRSLAPQVPTFYLPYFLEAGLEAAALVFLLLTADCCGRRPVLLLGTMVTGLASLLLLAGAQYLPGWTVLFLSVLGLLASRAVSALSSLFAAEVFPTVIRGAGLGLVLGAGFLGQAAGPLDTLHGRQGFFLQQVVFASLAVLALLCVLLLPESRSRGLPQSLQDADRLRRSPLLRGRPRQDHLPLLPPSNSYWAGHTPEQH

SEQ ID NO: 80837 - protein, 598 aa, Homo sapiens
  Payload ID: 16111
  Gene Symbol: SLC23A1
  Gene Name: solute carrier family 23 (ascorbic acid transporter), member 1
  Uniprot ID: Q9UHI7
  ENSP ID: ENSP00000302701
MRAQEDLEGRTQHETTRDPSTPLPTEPKFDMLYKIEDVPPWYLCILLGFQHYLTCFSGTIAVPFLLAEALCVGHDQHMVSQLIGTIFTCVGITTLIQTTVGIRLPLFQASAFAFLVPAKAILALERWKCPPEEEIYGNWSLPLNTSHIWHPRIREVQGAIMVSSVVEVVIGLLGLPGALLNYIGPLTVTPTVSLIGLSVFQAAGDRAGSHWGISACSILLIILFSQYLRNLTFLLPVYRWGKGLTLLRIQIFKMFPIMLAIMTVWLLCYVLTLTDVLPTDPKAYGFQARTDARGDIMAIAPWIRIPYPCQWGLPTVTAAAVLGMFSATLAGIIESIGDYYACARLAGAPPPPVHAINRGIFTEGICCIIAGLLGTGNGSTSSSPNIGVLGITKVGSRRVVQYGAAIMLVLGTIGKFTALFASLPDPILGGMFCTLFGMITAVGLSNLQFVDMNSSRNLFVLGFSMFFGLTLPNYLESNPGAINTGILEVDQILIVLLTTEMFVGGCLAFILDNTVPGSPEERGLIQWKAGAHANSDMSSSLKSYDFPIGMGIVKRITFLKYIPICPVFKGFSSSSKDQIAIPEDTPENTETASVCTKV

SEQ ID NO: 80838 - protein, 602 aa, Homo sapiens
  Payload ID: 16111
  Gene Symbol: SLC23A1
  Gene Name: solute carrier family 23 (ascorbic acid transporter), member 1
  Uniprot ID: Q9UHI7
  ENSP ID: ENSP00000302851
MRAQEDLEGRTQHETTRDPSTPLPTEPKFDMLYKIEDVPPWYLCILLGFQHYLTCFSGTIAVPFLLAEALCVGHDQHMVSQLIGTIFTCVGITTLIQTTVGIRLPLFQASAFAFLVPAKAILALERWKCPPEEEIYGNWSLPLNTSHIWHPRIREVGLHVQGAIMVSSVVEVVIGLLGLPGALLNYIGPLTVTPTVSLIGLSVFQAAGDRAGSHWGISACSILLIILFSQYLRNLTFLLPVYRWGKGLTLLRIQIFKMFPIMLAIMTVWLLCYVLTLTDVLPTDPKAYGFQARTDARGDIMAIAPWIRIPYPCQWGLPTVTAAAVLGMFSATLAGIIESIGDYYACARLAGAPPPPVHAINRGIFTEGICCIIAGLLGTGNGSTSSSPNIGVLGITKVGSRRVVQYGAAIMLVLGTIGKFTALFASLPDPILGGMFCTLFGMITAVGLSNLQFVDMNSSRNLFVLGFSMFFGLTLPNYLESNPGAINTGILEVDQILIVLLTTEMFVGGCLAFILDNTVPGSPEERGLIQWKAGAHANSDMSSSLKSYDFPIGMGIVKRITFLKYIPICPVFKGFSSSSKDQIAIPEDTPENTETASVCTKV

SEQ ID NO: 80839 - protein, 136 aa, Homo sapiens
  Payload ID: 16111
  Gene Symbol: SLC23A1
  Gene Name: solute carrier family 23 (ascorbic acid transporter), member 1
  ENSP ID: ENSP00000422688
  MOD_RES (1)..(1): Any amino acid
XPLNTSHIWHPRIRELHSPDHPLLPVPAQPHLPAACLPLGQGPHSPPHPDLQNVSCQWGLPTVTAAAVLGMFSATLAGIIESIGDYYACARLAGAPPPPVHAINRGIFTEGICCIIAGLLGTGNGSTSSSPNIGVL

SEQ ID NO: 80840 - protein, 169 aa, Homo sapiens
  Payload ID: 16111
  Gene Symbol: SLC23A1
  Gene Name: solute carrier family 23 (ascorbic acid transporter), member 1
  ENSP ID: ENSP00000427271
KLVQQLWKLGAVAKRERRGQADRGTVWTPAGGRTQCCGMKLLPSWRAVLPLGPSGRAWPWAQRPRRTAQTCAPKMRAQEDLEGRTQHETTRDPSTPLPTEPKFDMLYKIEDVPPWYLCILLGFQHYLTCFSGTIAVPFLLAEALCVGHDQHMVSQLIGTIFTCVGITTL

SEQ ID NO: 80841 - protein, 650 aa, Homo sapiens
  Payload ID: 16112
  Gene Symbol: SLC23A2
  Gene Name: solute carrier family 23 (ascorbic acid transporter), member 2
  Uniprot ID: Q9UGH3
  ENSP ID: ENSP00000344322
MMGIGKNTTSKSMEAGSSTEGKYEDEAKHPAFFTLPVVINGGATSSGEQDNEDTELMAIYTTENGIAEKSSLAETLDSTGSLDPQRSDMIYTIEDVPPWYLCIFLGLQHYLTCFSGTIAVPFLLADAMCVGYDQWATSQLIGTIFFCVGITTLLQTTFGCRLPLFQASAFAFLAPARAILSLDKWKCNTTDVSVANGTAELLHTEHIWYPRIREIQGAIIMSSLIEVVIGLLGLPGALLKYIGPLTITPTVALIGLSGFQAAGERAGKHWGIAMLTIFLVLLFSQYARNVKFPLPIYKSKKGWTAYKLQLFKMFPIILAILVSWLLCFIFTVTDVFPPDSTKYGFYARTDARQGVLLVAPWFKVPYPFQWGLPTVSAAGVIGMLSAVVASIIESIGDYYACARLSCAPPPPIHAINRGIFVEGLSCVLDGIFGTGNGSTSSSPNIGVLGITKVGSRRVIQCGAALMLALGMIGKFSALFASLPDPVLGALFCTLFGMITAVGLSNLQFIDLNSSRNLFVLGFSIFFGLVLPSYLRQNPLVTGITGIDQVLNVLLTTAMFVGGCVAFILDNTIPGTPEERGIRKWKKGVGKGNKSLDGMESYNLPFGMNIIKKYRCFSYLPISPTFVGYTWKGLRKSDNSRSSDEDSQATG

SEQ ID NO: 80842 - protein, 650 aa, Homo sapiens; identical to SEQ ID NO: 80841
  Payload ID: 16112
  Gene Symbol: SLC23A2
  Gene Name: solute carrier family 23 (ascorbic acid transporter), member 2
  Uniprot ID: Q9UGH3
  ENSP ID: ENSP00000368637

SEQ ID NO: 80843 - protein, 304 aa, Homo sapiens
  Payload ID: 16112
  Gene Symbol: SLC23A2
  Gene Name: solute carrier family 23 (ascorbic acid transporter), member 2
  ENSP ID: ENSP00000396364
  MOD_RES (1)..(1): Any amino acid
XGYDQWATSQLIGTIFFCVGITTLLQTTFGCRTIFLVLLFSQYARNVKFPLPIYKSKKGWTAYKLQLFKMFPIILAILVSWLLCFIFTVTDVFPPDSTKYGFYARTDARQGVLLVAPWFKVPYPFQWGLPTVSAAGVIGMLSAVVASIIESIGDYYACARLSCAPPPPIHAINRGIFVEGLSCVLDGIFGTGNGSTSSSPNIGVLGITKVGSRRVIQCGAALMLALGMIGKFSALFASLPDPVLGALFCTLFGMITAVGLSNLQFIDLNSSRNLFVLGFSIFFGLVLPSYLRQNPLVTGITGID

SEQ ID NO: 80844 - protein, 493 aa, Homo sapiens
  Payload ID: 16113
  Gene Symbol: SLC23A3
  Gene Name: solute carrier family 23, member 3
  Uniprot ID: Q6PIS1
  ENSP ID: ENSP00000295738
MSRSPLNPSQLRSVGSQDALAPLPPPAPQNPSTHSWDPLCGSLPWGLSCLLALQHVLVMASLLCVSHLLLLCSLSPGGLSYSPSQLLASSFFSCGMSTILQTWMGSRLPLVQAPSLEFLIPALVLTSQKLPRAIQTPGNSSLMLHLCRGPSCHGLGHWNTSLQEVSGAVVVSGLLQGMMGLLGSPGHVFPHCGPLVLAPSLVVAGLSAHREVAQFCFTHWGLALLTWAPASFMCAPGGELQRHQLTLLSLSSGSFRNCLPPPRHHGFGCLTQAGSQQVAHLVGLLCVGLGLSPRLAQLLTTIPLPVVGGVLGVTQAVVLSAGFSSFYLADIDSGRNIFIVGFSIFMALLLPRWFREAPVLFSTGWSPLDVLLHSLLTQPIFLAGLSGFLLENTIPGTQLERGLGQGLPSPFTAQEARMPQKPREKAAQVYRLPFPIQNLCPCIPQPLHCLCPLPEDPGDEEGGSSEPEEMADLLPGSGEPCPESSREGFRSQK

SEQ ID NO: 80845 - protein, 610 aa, Homo sapiens
  Payload ID: 16113
  Gene Symbol: SLC23A3
  Gene Name: solute carrier family 23, member 3
  Uniprot ID: Q6PIS1
  ENSP ID: ENSP00000386473
MSRSPLNPSQLRSVGSQDALAPLPPPAPQNPSTHSWDPLCGSLPWGLSCLLALQHVLVMASLLCVSHLLLLCSLSPGGLSYSPSQLLASSFFSCGMSTILQTWMGSRLPLVQAPSLEFLIPALVLTSQKLPRAIQTPGNSSLMLHLCRGPSCHGLGHWNTSLQEVSGAVVVSGLLQGMMGLLGSPGHVFPHCGPLVLAPSLVVAGLSAHREVAQFCFTHWGLALLVILLMVVCSQHLGSCQFHVCPWRRASTSSTHTPLPVFRLLSVLIPVACVWIVSAFVGFSVIPQELSAPTKAPWIWLPHPGEWNWPLLTPRALAAGISMALAASTSSLGCYALCGRLLHLPPPPPHACSRGLSLEGLGSVLAGLLGSPMGTASSFPNVGKVGLIQAGSQQVAHLVGLLCVGLGLSPRLAQLLTTIPLPVVGGVLGVTQAVVLSAGFSSFYLADIDSGRNIFIVGFSIFMALLLPRWFREAPVLFSTGWSPLDVLLHSLLTQPIFLAGLSGFLLENTIPGTQLERGLGQGLPSPFTAQEARMPQKPREKAAQVYRLPFPIQNLCPCIPQPLHCLCPLPEDPGDEEGGSSEPEEMADLLPGSGEPCPESSREGFRSQK

SEQ ID NO: 80846 - protein, 259 aa, Homo sapiens
  Payload ID: 16113
  Gene Symbol: SLC23A3
  Gene Name: solute carrier family 23, member 3
  ENSP ID: ENSP00000386989
MSRSPLNPSQLRSVGSQDALAPLPPPAPQNPSTHSWDPLCGSLPWGLSCLLALQHVLVMASLLCVSHLLLLCSLSPGGLSYSPSQLLASSFFSCGMSTILQTWMGSRLPLVQAPSLEFLIPALVLTSQKLPRAIQTPGNSSLMLHLCRGPSCHGLGHWNTSLQEVSGAVVVSGLLQGMMGLLGSPGHVFPHCGPLVLAPSLVVAGLSAHREVAQFCFTHWGLALLVILLMVVCSQHLGSCQFHVCPWRRASTSSTHTPL

SEQ ID NO: 80847 - protein, 179 aa, Homo sapiens
  Payload ID: 16113
  Gene Symbol: SLC23A3
  Gene Name: solute carrier family 23, member 3
  ENSP ID: ENSP00000388907
MSRSPLNPSQLRSVGSQDALAPLPPPAPQNPSTHSWDPLCGSLPWGLSCLLALQHVLVMASLLCVSHLLLLCSLSPGGLSYSPSQLLASSFFSCASLMLHLCRGPSCHGLGHWNTSLQEVSGAVVVSGLLQGMMGLLGSPGHVFPHCGPLVLAPSLVVAGLSAHREVAQFCFTHWGLAL

SEQ ID NO: 80848 - protein, 11 aa, Homo sapiens
  Payload ID: 16113
  Gene Symbol: SLC23A3
  Gene Name: solute carrier family 23, member 3
  ENSP ID: ENSP00000404697
  MOD_RES (1)..(1): Any amino acid
XCGCLLSRLHP

SEQ ID NO: 80849 - protein, 618 aa, Homo sapiens
  Payload ID: 16113
  Gene Symbol: SLC23A3
  Gene Name: solute carrier family 23, member 3
  Uniprot ID: Q6PIS1
  ENSP ID: ENSP00000406546
MSRSPLNPSQLRSVGSQDALAPLPPPAPQNPSTHSWDPLCGSLPWGLSCLLALQHVLVMASLLCVSHLLLLCSLSPGGLSYSPSQLLASSFFSCGMSTILQTWMGSRLPLVQAPSLEFLIPALVLTSQKLPRAIQTPGNCEHRARARASLMLHLCRGPSCHGLGHWNTSLQEVSGAVVVSGLLQGMMGLLGSPGHVFPHCGPLVLAPSLVVAGLSAHREVAQFCFTHWGLALLVILLMVVCSQHLGSCQFHVCPWRRASTSSTHTPLPVFRLLSVLIPVACVWIVSAFVGFSVIPQELSAPTKAPWIWLPHPGEWNWPLLTPRALAAGISMALAASTSSLGCYALCGRLLHLPPPPPHACSRGLSLEGLGSVLAGLLGSPMGTASSFPNVGKVGLIQAGSQQVAHLVGLLCVGLGLSPRLAQLLTTIPLPVVGGVLGVTQAVVLSAGFSSFYLADIDSGRNIFIVGFSIFMALLLPRWFREAPVLFSTGWSPLDVLLHSLLTQPIFLAGLSGFLLENTIPGTQLERGLGQGLPSPFTAQEARMPQKPREKAAQVYRLPFPIQNLCPCIPQPLHCLCPLPEDPGDEEGGSSEPEEMADLLPGSGEPCPESSREGFRSQK

SEQ ID NO: 80850 - protein, 1099 aa, Homo sapiens
  Payload ID: 16114
  Gene Symbol: SLC24A1
  Gene Name: solute carrier family 24 (sodium/potassium/calcium exchanger), member 1
  Uniprot ID: O60721
  ENSP ID: ENSP00000261892
MGKLIRMGPQERWLLRTKRLHWSRLLFLLGMLIIGSTYQHLRRPRGLSSLWAAVSSHQPIKLASRDLSSEEMMMMSSSPSKPSSEMGGKMLVPQASVGSDEATLSMTVENIPSMPKRTAKMIPTTTKNNYSPTAAGTERRKEDTPTSSRTLTYYTSTSSRQIVKKYTPTPRGEMKSYSPTQVREKVKYTPSPRGRRVGTYVPSTFMTMETSHAITPRTTVKDSDITATYKILETNSLKRIMEETTPTTLKGMFDSTPTFLTHEVEANVLTSPRSVMEKNNLFPPRRVESNSSAHPWGLVGKSNPKTPQGTVLLHTPATSEGQVTISTMTGSSPAETKAFTAAWSLRNPSPRTSVSAIKTAPAIVWRLAKKPSTAPSTSTTPTVRAKLTMQVHHCVVVKPTPAMLTTPSPSLTTALLPEELSPSPSVLPPSLPDLHPKGEYPPDLFSVEERRQGWVVLHVFGMMYVFVALAIVCDEYFVPALGVITDKLQISEDVAGATFMAAGGSAPELFTSLIGVFISHSNVGIGTIVGSAVFNILFVIGTCSLFSREILNLTWWPLFRDVSFYILDLIMLILFFLDSLIAWWESLLLLLAYAFYVFTMKWNKHIEVWVKEQLSRRPVAKVMALEDLSKPGDGAIAVDELQDNKKLKLPSLLTRGSSSTSLHNSTIRSTIYQLMLHSLDPLREVRLAKEKEEESLNQGARAQPQAKAESKPEEEEPAKLPAVTVTPAPVPDIKGDQKENPGGQEDVAEAESTGEMPGEEGETAGEGETEEKSGGETQPEGEGETETQGKGEECEDENEAEGKGDNEGEDEGEIHAEDGEMKGNEGETESQELSAENHGEAKNDEKGVEDGGGSDGGDSEEEEEEEEEQEEEEEEEEQEEEEEEEEEEEEKGNEEPLSLDWPETRQKQAIYLFLLPIVFPLWLTVPDVRRQESRKFFVFTFLGSIMWIAMFSYLMVWWAHQVGETIGISEEIMGLTILAAGTSIPDLITSVIVARKGLGDMAVSSSVGSNIFDITVGLPVPWLLFSLINGLQPVPVSSNGLFCAIVLLFLMLLFVISSIASCKWRMNKILGFTMFLLYFVFLIISVMLEDRIISCPVSV

SEQ ID NO: 80851 - protein, 1069 aa, Homo sapiens
  Payload ID: 16114
  Gene Symbol: SLC24A1
  Gene Name: solute carrier family 24 (sodium/potassium/calcium exchanger), member 1
  Uniprot ID: O60721
  ENSP ID: ENSP00000341837
MGKLIRMGPQERWLLRTKRLHWSRLLFLLGMLIIGSTYQHLRRPRGLSSLWAAVSSHQPIKLASRDLSSEEMMMMSSSPSKPSSEMGGKMLVPQASVGSDEATLSMTVENIPSMPKRTAKMIPTTTKNNYSPTAAGTERRKEDTPTSSRTLTYYTSTSSRQIVKKYTPTPRGEMKSYSPTQVREKVKYTPSPRGRRVGTYVPSTFMTMETSHAITPRTTVKDSDITATYKILETNSLKRIMEETTPTTLKGMFDSTPTFLTHEVEANVLTSPRSVMEKNNLFPPRRVESNSSAHPWGLVGKSNPKTPQGTVLLHTPATSEGQVTISTMTGSSPAETKAFTAAWSLRNPSPRTSVSAIKTAPAIVWRLAKKPSTAPSTSTTPTVRAKLTMQVHHCVVVKPTPAMLTTPSPSLTTALLPEELSPSPSVLPPSLPDLHPKGEYPPDLFSVEERRQGWVVLHVFGMMYVFVALAIVCDEYFVPALGVITDKLQISEDVAGATFMAAGGSAPELFTSLIGVFISHSNVGIGTIVGSAVFNILFVIGTCSLFSREILNLTWWPLFRDVSFYILDLIMLILFFLDSLIAWWESLLLLLAYAFYVFTMKWNKHIEVWVKEQLSRRPVAKVMALEDLSKPGDGAIAVDELQDNKKLKLPSLLTRGSSSTSLHNSTIRSTIYQLMLHSLDPLREVRLAKEKEEESLNQGARAQPQAKAESKPEEEEPAKLPAVTVTPAPVPDIKGDQKENPGGQEDVAEAESTGEMPGEEGETAGEGETEEKSGGETQPEGEGETETQGKGEECEDENEAEGKGDNEGEDEGEIHAEDGEMKGNEGETESQELSAENHGEAKNDEKGVEDGGGSDGGDSEEEEEEEEEQEEEEEEEEQEEEEEEEEEEEEKGNEEPLSLDWPETRQKQAIYLFLLPIVFPLWLTVPDVRRQVGETIGISEEIMGLTILAAGTSIPDLITSVIVARKGLGDMAVSSSVGSNIFDITVGLPVPWLLFSLINGLQPVPVSSNGLFCAIVLLFLMLLFVISSIASCKWRMNKILGFTMFLLYFVFLIISVMLEDRIISCPVSV

SEQ ID NO: 80852 - protein, 1069 aa, Homo sapiens; identical to SEQ ID NO: 80851
  Payload ID: 16114
  Gene Symbol: SLC24A1
  Gene Name: solute carrier family 24 (sodium/potassium/calcium exchanger), member 1
  Uniprot ID: O60721
  ENSP ID: ENSP00000381991

SEQ ID NO: 80853 - protein, 1081 aa, Homo sapiens
  Payload ID: 16114
  Gene Symbol: SLC24A1
  Gene Name: solute carrier family 24 (sodium/potassium/calcium exchanger), member 1
  Uniprot ID: O60721
  ENSP ID: ENSP00000439190
MGKLIRMGPQERWLLRTKRLHWSRLLFLLGMLIIGSTYQHLRRPRGLSSLWAAVSSHQPIKLASRDLSSEEMMMMSSSPSKPSSEMGGKMLVPQASVGSDEATLSMTVENIPSMPKRTAKMIPTTTKNNYSPTAAGTERRKEDTPTSSRTLTYYTSTSSRQIVKKYTPTPRGEMKSYSPTQVREKVKYTPSPRGRRVGTYVPSTFMTMETSHAITPRTTVKDSDITATYKILETNSLKRIMEETTPTTLKGMFDSTPTFLTHEVEANVLTSPRSVMEKNNLFPPRRVESNSSAHPWGLVGKSNPKTPQGTVLLHTPATSEGQVTISTMTGSSPAETKAFTAAWSLRNPSPRTSVSAIKTAPAIVWRLAKKPSTAPSTSTTPTVRAKLTMQVHHCVVVKPTPAMLTTPSPSLTTALLPEELSPSPSVLPPSLPDLHPKGEYPPDLFSVEERRQGWVVLHVFGMMYVFVALAIVCDEYFVPALGVITDKLQISEDVAGATFMAAGGSAPELFTSLIGVFISHSNVGIGTIVGSAVFNILFVIGTCSLFSREILNLTWWPLFRDVSFYILDLIMLILFFLDSLIAWWESLLLLLAYAFYVFTMKWNKHIEVWVKEQLSRRPVAKVMALEDLSKLPSLLTRGSSSTSLHNSTIRSTIYQLMLHSLDPLREVRLAKEKEEESLNQGARAQPQAKAESKPEEEEPAKLPAVTVTPAPVPDIKGDQKENPGGQEDVAEAESTGEMPGEEGETAGEGETEEKSGGETQPEGEGETETQGKGEECEDENEAEGKGDNEGEDEGEIHAEDGEMKGNEGETESQELSAENHGEAKNDEKGVEDGGGSDGGDSEEEEEEEEEQEEEEEEEEQEEEEEEEEEEEEKGNEEPLSLDWPETRQKQAIYLFLLPIVFPLWLTVPDVRRQESRKFFVFTFLGSIMWIAMFSYLMVWWAHQVGETIGISEEIMGLTILAAGTSIPDLITSVIVARKGLGDMAVSSSVGSNIFDITVGLPVPWLLFSLINGLQPVPVSSNGLFCAIVLLFLMLLFVISSIASCKWRMNKILGFTMFLLYFVFLIISVMLEDRIISCPVSV

SEQ ID NO: 80854 - protein, 1012 aa, Homo sapiens
  Payload ID: 16114
  Gene Symbol: SLC24A1
  Gene Name: solute carrier family 24 (sodium/potassium/calcium exchanger), member 1
  ENSP ID: ENSP00000439693
MGKLIRMGPQERWLLRTKRLHWSRLLFLLGMLIIGSTYQHLRRPRGLSSLWAAVSSHQPIKLASRDLSSEEMMMMSSSPSKPSSEMGGKMLVPQASVGSDEATLSMTVENIPSMPKRTAKMIPTTTKNNYSPTAAGTERRKEDTPTSSRTLTYYTSTSSRQIVKKYTPTPRGEMKSYSPTQVREKVKYTPSPRGRRVGTYVPSTFMTMETSHAITPRTTVKDSDITATYKILETNSLKRIMEETTPTTLKGMFDSTPTFLTHEVEANVLTSPRSVMEKNNLFPPRRVESNSSAHPWGLVGKSNPKTPQGTVLLHTPATSEGQVTISTMTGSSPAETKAFTAAWSLRNPSPRTSVSAIKTAPAIVWRLAKKPSTAPSTSTTPTVRAKLTMQVHHCVVVKPTPAMLTTPSPSLTTALLPEELSPSPSVLPPSLPDLHPKGEYPPDLFSVEERRQGWVVLHVFGMMYVFVALAIVCDEYFVPALGVITDKLQISEDVAGATFMAAGGSAPELFTSLIGVFISHSNVGIGTIVGSAVFNILFVIGTCSLFSREILNLTWWPLFRDVSFYILDLIMLILFFLDSLIAWWESLLLLLAYAFYVFTMKWNKHIEVWVKEQLSRRPVAKVMALEDLSKLPSLLTRGSSSTSLHNSTIRSTIYQLMLHSLDPLREVRLAKEKEEESLNQGARAQPQAKAESKPEEEEPAKLPAVTVTPAPVPDIKGDQKENPGGQEDVAEAESTGEMPGEEGETAGEGETEEKSGGETQPEGEGETETQGKGEECEDENEAEGKGDNEGEDEGEIHAEDGEMKGNEGETESQELSAENHGEAKNDEKGVEDGGGSDGGDSEEEEEEEEEQEEEEEEEEQEEEEEEEEEEEEKGNEEPLSLDWPETRQKQAIYLFLLPIVFPLWLTVPDVRRQESRKFFVFTFLGSIMWIAMFSYLMVWWAHQVGETIGISEEIMGLTILAAGTSIPDLITSVIVARKGLGDMAVSSSVGSNIFDITVGVGSCEMFQHGAIH

SEQ ID NO: 80855 - protein, 985 aa, Homo sapiens
  Payload ID: 16114
  Gene Symbol: SLC24A1
  Gene Name: solute carrier family 24 (sodium/potassium/calcium exchanger), member 1
  ENSP ID: ENSP00000445163
MGKLIRMGPQERWLLRTKRLHWSRLLFLLGMLIIGSTYQHLRRPRGLSSLWAAVSSHQPIKLASRDLSSEEMMMMSSSPSKPSSEMGGKMLVPQASVGSDEATLSMTVENIPSMPKRTAKMIPTTTKNNYSPTAAGTERRKEDTPTSSRTLTYYTSTSSRQIVKKYTPTPRGEMKSYSPTQVREKVKYTPSPRGRRVGTYVPSTFMTMETSHAITPRTTVKDSDITATYKILETNSLKRIMEETTPTTLKGMFDSTPTFLTHEVEANVLTSPRSVMEKNNLFPPRRVESNSSAHPWGLVGKSNPKTPQGTVLLHTPATSEGQVTISTMTGSSPAETKAFTAAWSLRNPSPRTSVSAIKTAPAIVWRLAKKPSTAPSTSTTPTVRAKLTMQVHHCVVVKPTPAMLTTPSPSLTTALLPEELSPSPSVLPPSLPDLHPKGEYPPDLFSVEERRQGWVVLHVFGMMYVFVALAIVCDEYFVPALGVITDKLQISEDVAGATFMAAGGSAPELFTSLIGVFISHSNVGIGTIVGSAVFNILFVIGTCSLFSREILNLTWWPLFRDVSFYILDLIMLILFFLDSLIAWWESLLLLLAYAFYVFTMKWNKHIEVWVKEQLSRRPVAKVMALEDLSKEDVAEAESTGEMPGEEGETAGEGETEEKSGGETQPEGEGETETQGKGEECEDENEAEGKGDNEGEDEGEIHAEDGEMKGNEGETESQELSAENHGEAKNDEKGVEDGGGSDGGDSEEEEEEEEEQEEEEEEEEQEEEEEEEEEEEEKGNEEPLSLDWPETRQKQAIYLFLLPIVFPLWLTVPDVRRQESRKFFVFTFLGSIMWIAMFSYLMVWWAHQVGETIGISEEIMGLTILAAGTSIPDLITSVIVARKGLGDMAVSSSVGSNIFDITVGLPVPWLLFSLINGLQPVPVSSNGLFCAIVLLFLMLLFVISSIASCKWRMNKILGFTMFLLYFVFLIISVMLEDRIISCPVSV

SEQ ID NO: 80856 - protein, 56 aa, Homo sapiens
  Payload ID: 16114
  Gene Symbol: SLC24A1
  Gene Name: solute carrier family 24 (sodium/potassium/calcium exchanger), member 1
  ENSP ID: ENSP00000445577
  MOD_RES (1)..(1): Any amino acid
XRKGLGDMAVSSSVGSNIFDITVGVWLLLPRLVCNGVISAHHNLHLPGSSNSPASA

SEQ ID NO: 80857 - protein, 644 aa, Homo sapiens
  Payload ID: 16115
  Gene Symbol: SLC24A2
  Gene Name: solute carrier family 24 (sodium/potassium/calcium exchanger), member 2
  Uniprot ID: Q9UI40
  ENSP ID: ENSP00000286344
MDLQQSTTITSLEKWCLDESLSGCRRHYSVKKKLKLIRVLGLFMGLVAISTVSFSISAFSETDTQSTGEASVVSGPRVAQGYHQRTLLDLNDKILDYTPQPPLSKEGESENSTDHAQGDYPKDIFSLEERRKGAIILHVIGMIYMFIALAIVCDEFFVPSLTVITEKLGISDDVAGATFMAAGGSAPELFTSLIGVFIAHSNVGIGTIVGSAVFNILFVIGMCALFSREILNLTWWPLFRDVSFYIVDLIMLIIFFLDNVIMWWESLLLLTAYFCYVVFMKFNVQVEKWVKQMINRNKVVKVTAPEAQAKPSAARDKDEPTLPAKPRLQRGGSSASLHNSLMRNSIFQLMIHTLDPLAEGRFREKASILHKIAKKKCHVDENERQNGAANHVEKIELPNSTSTDVEMTPSSDASEPVQNGNLSHNIEGAEAQTADEEEDQPLSLAWPSETRKQVTFLIVFPIVFPLWITLPDVRKPSSRKFFPITFFGSITWIAVFSYLMVWWAHQVGETIGISEEIMGLTILAAGTSIPDLITSVIVARKGLGDMAVSSSVGSNIFDITVGLPLPWLLYTVIHRFQPVAVSSNGLFCAIVLLFIMLLFVILSIALCKWRMNKILGFIMFGLYFVFLVVSVLLEDRILTCPVSI

SEQ ID NO: 80858 - protein, 661 aa, Homo sapiens
  Payload ID: 16115
  Gene Symbol: SLC24A2
  Gene Name: solute carrier family 24 (sodium/potassium/calcium exchanger), member 2
  Uniprot ID: Q9UI40
  ENSP ID: ENSP00000344801
MDLQQSTTITSLEKWCLDESLSGCRRHYSVKKKLKLIRVLGLFMGLVAISTVSFSISAFSETDTQSTGEASVVSGPRVAQGYHQRTLLDLNDKILDYTPQPPLSKEGESENSTDHAQGDYPKDIFSLEERRKGAIILHVIGMIYMFIALAIVCDEFFVPSLTVITEKLGISDDVAGATFMAAGGSAPELFTSLIGVFIAHSNVGIGTIVGSAVFNILFVIGMCALFSREILNLTWWPLFRDVSFYIVDLIMLIIFFLDNVIMWWESLLLLTAYFCYVVFMKFNVQVEKWVKQMINRNKVVKVTAPEAQAKPSAARDKDEPTLPAKPRLQRGGSSASLHNSLMRNSIFQLMIHTLDPLAEELGSYGKLKYYDTMTEEGRFREKASILHKIAKKKCHVDENERQNGAANHVEKIELPNSTSTDVEMTPSSDASEPVQNGNLSHNIEGAEAQTADEEEDQPLSLAWPSETRKQVTFLIVFPIVFPLWITLPDVRKPSSRKFFPITFFGSITWIAVFSYLMVWWAHQVGETIGISEEIMGLTILAAGTSIPDLITSVIVARKGLGDMAVSSSVGSNIFDITVGLPLPWLLYTVIHRFQPVAVSSNGLFCAIVLLFIMLLFVILSIALCKWRMNKILGFIMFGLYFVFLVVSVLLEDRILTCPVSI

SEQ ID NO: 80859 - protein, 644 aa, Homo sapiens
  Payload ID: 16116
  Gene Symbol: SLC24A3
  Gene Name: solute carrier family 24 (sodium/potassium/calcium exchanger), member 3
  Uniprot ID: Q9HC58
  ENSP ID: ENSP00000333519
MRPSGDEDRARRRRRRRRRRDLLLSQLCFLASVALLLWSLSSLREQKELDLMDLVGEDRKWMMARKLMQVNDTLTSEDAGLRNSKNCTEPALHEFPNDIFTNEDRRQGAVVLHVLCAIYMFYALAIVCDDFFVPSLEKICERLHLSEDVAGATFMAAGSSAPELFTSVIGVFITKGDVGVGTIVGSAVFNILCIIGVCGLFAGQVVALSSWCLLRDSIYYTLSVIALIVFIYDEKVSWWESLVLVLMYLIYIVIMKYNACIHQCFERRTKGAGNMVNGLANNAEIDDSSNCDATVVLLKKANFHRKASVIMVDELLSAYPHQLSFSEAGLRIMITSHFPPKTRLSMASRMLINERQRLINSRAYTNGESEVAIKIPIKHTVENGTGPSSAPDRGVNGTRRDDVVAEAGNETENENEDNENDEEEEEDEDDDEGPYTPFDTPSGKLETVKWAFTWPLSFVLYFTVPNCNKPRWEKWFMVTFASSTLWIAAFSYMMVWMVTIIGYTLGIPDVIMGITFLAAGTSVPDCMASLIVARQGMGDMAVSNSIGSNVFDILIGLGLPWALQTLAVDYGSYIRLNSRGLIYSVGLLLASVFVTVFGVHLNKWQLDKKLGCGCLLLYGVFLCFSIMTEFNVFTFVNLPMCGDH

SEQ ID NO: 80860 - protein, 644 aa, Homo sapiens; identical to SEQ ID NO: 80859
  Payload ID: 16116
  Gene Symbol: SLC24A3
  Gene Name: solute carrier family 24 (sodium/potassium/calcium exchanger), member 3
  Uniprot ID: Q9HC58
  ENSP ID: ENSP00000482967

SEQ ID NO: 80861 - protein, 558 aa, Homo sapiens
  Payload ID: 16117
  Gene Symbol: SLC24A4
  Gene Name: solute carrier family 24 (sodium/potassium/calcium exchanger), member 4
  Uniprot ID: Q8NFF2
  ENSP ID: ENSP00000376948
MAPVNGTQTAKNCTDPAIHEFPTDLFSNKERQHGAVLLHILGALYMFYALAIVCDDFFVPSLEKICERLHLSEDVAGATFMAAGSSTPELFASVIGVFITHGDVGVGTIVGSAVFNILCIIGVCGLFAGQVVRLTWWAVCRDSVYYTISVIVLIVFIYDEQIVWWEGLVLIILYVFYILIMKYNVKMQAFFTVKQKSIANGNPVNSELEAGNDFYDGSYDDPSVPLLGQVKEKPQYGKNPVVMVDEIMSSSPPKFTFPEAGLRIMITNKFGPRTRLRMASRIIINERQRLINSANGVSSKPLQNGRHENIENGNVPVENPEDPQQNQEQQPPPQPPPPEPEPVEADFLSPFSVPEARGDKVKWVFTWPLIFLLCVTIPNCSKPRWEKFFMVTFITATLWIAVFSYIMVWLVTIIGYTLGIPDVIMGITFLAAGTSVPDCMASLIVARQGLGDMAVSNTIGSNVFDILVGLGVPWGLQTMVVNYGSTVKINSRGLVYSVVLLLGSVALTVLGIHLNKWRLDRKLGVYVLVLYAIFLCFSIMIEFNVFTFVNLPMCREDD

SEQ ID NO: 80862 - protein, 622 aa, Homo sapiens
  Payload ID: 16117
  Gene Symbol: SLC24A4
  Gene Name: solute carrier family 24 (sodium/potassium/calcium exchanger), member 4
  Uniprot ID: Q8NFF2
  ENSP ID: ENSP00000431840
MALRGTLRPLKVRRRREMLPQQVGFVCAVLALVCCASGLFGSLGHKTASASKRVLPDTWRNRKLMAPVNGTQTAKNCTDPAIHEFPTDLFSNKERQHGAVLLHILGALYMFYALAIVCDDFFVPSLEKICERLHLSEDVAGATFMAAGSSTPELFASVIGVFITHGDVGVGTIVGSAVFNILCIIGVCGLFAGQVVRLTWWAVCRDSVYYTISVIVLIVFIYDEQIVWWEGLVLIILYVFYILIMKYNVKMQAFFTVKQKSIANGNPVNSELEAGNDFYDGSYDDPSVPLLGQVKEKPQYGKNPVVMVDEIMSSSPPKFTFPEAGLRIMITNKFGPRTRLRMASRIIINERQRLINSANGVSSKPLQNGRHENIENGNVPVENPEDPQQNQEQQPPPQPPPPEPEPVEADFLSPFSVPEARGDKVKWVFTWPLIFLLCVTIPNCSKPRWEKFFMVTFITATLWIAVFSYIMVWLVTIIGYTLGIPDVIMGITFLAAGTSVPDCMASLIVARQGLGDMAVSNTIGSNVFDILVGLGVPWGLQTMVVNYGSTVKINSRGLVYSVVLLLGSVALTVLGIHLNKWRLDRKLGVYVLVLYAIFLCFSIMIEFNVFTFVNLPMCREDD

SEQ ID NO: 80863 - protein, 464 aa, Homo sapiens
  Payload ID: 16117
  Gene Symbol: SLC24A4
  Gene Name: solute carrier family 24 (sodium/potassium/calcium exchanger), member 4
  ENSP ID: ENSP00000432464
  MOD_RES (1)..(1): Any amino acid
XVCDDFFVPSLEKICERLHLSEDVAGATFMAAGSSTPELFASVIGVFITHGDVGVGTIVGSAVFNILCIIGVCGLFAGQVVRLTWWAVCRDSVYYTISVIVLIVFIYDEQIVWWEGLVLIILYVFYILIMKYNVKMQAFFTVKQKSIANGNPVNSELEAVKEKPQYGKNPVVMVDEIMSSSPPKFTFPEAGLRIMITNKFGPRTRLRMASRIIINERQRLINSANGVSSKPLQNGRHENIENGNVPVENPEDPQQNQEQQPPPQPPPPEPEPVEADFLSPFSVPEARGDKVKWVFTWPLIFLLCVTIPNCSKPRWEKFFMVTFITATLWIAVFSYIMVWLVTIIGYTLGIPDVIMGITFLAAGTSVPDCMASLIVARQGLGDMAVSNTIGSNVFDILVGLGVPWGLQTMVVNYGSTVKINSRGLVYSVVLLLGSVALTCSSEVPGIQPQEALIEGQGGRQWKER

SEQ ID NO: 80864 - protein, 603 aa, Homo sapiens
  Payload ID: 16117
  Gene Symbol: SLC24A4
  Gene Name: solute carrier family 24 (sodium/potassium/calcium exchanger), member 4
  Uniprot ID: Q8NFF2
  ENSP ID: ENSP00000433302
MALRGTLRPLKVRRRREMLPQQVGFVCAVLALVCCASGLFGSLGHKTASASKRVLPDTWRNRKLMAPVNGTQTAKNCTDPAIHEFPTDLFSNKERQHGAVLLHILGALYMFYALAIVCDDFFVPSLEKICERLHLSEDVAGATFMAAGSSTPELFASVIGVFITHGDVGVGTIVGSAVFNILCIIGVCGLFAGQVVRLTWWAVCRDSVYYTISVIVLIVFIYDEQIVWWEGLVLIILYVFYILIMKYNVKMQAFFTVKQKSIANGNPVNSELEAVKEKPQYGKNPVVMVDEIMSSSPPKFTFPEAGLRIMITNKFGPRTRLRMASRIIINERQRLINSANGVSSKPLQNGRHENIENGNVPVENPEDPQQNQEQQPPPQPPPPEPEPVEADFLSPFSVPEARGDKVKWVFTWPLIFLLCVTIPNCSKPRWEKFFMVTFITATLWIAVFSYIMVWLVTIIGYTLGIPDVIMGITFLAAGTSVPDCMASLIVARQGLGDMAVSNTIGSNVFDILVGLGVPWGLQTMVVNYGSTVKINSRGLVYSVVLLLGSVALTVLGIHLNKWRLDRKLGVYVLVLYAIFLCFSIMIEFNVFTFVNLPMCREDD

SEQ ID NO: 80865 - protein, 64 aa, Homo sapiens
  Payload ID: 16117
  Gene Symbol: SLC24A4
  Gene Name: solute carrier family 24 (sodium/potassium/calcium exchanger), member 4
  ENSP ID: ENSP00000452099
MFYALAIVCDDFFVPSLEKICERLHLSEDVAGATFMAAGSSTPELFASVIGVFITHGDVGVGTI

SEQ ID NO: 80866 - protein, 500 aa, Homo sapiens
  Payload ID: 16118
  Gene Symbol: SLC24A5
  Gene Name: solute carrier family 24 (sodium/potassium/calcium exchanger), member 5
  Uniprot ID: Q71RS6
  ENSP ID: ENSP00000341550
MQTKGGQTWARRALLLGILWATAHLPLSGTSLPQRLPRATGNSTQCVISPSSEFPEGFFTRQERRDGGIIIYFLIIVYMFMAISIVCDEYFLPSLEIISESLGLSQDVAGTTFMAAGSSAPELVTAFLGVFITKGDIGISTILGSAIYNLLGICAACGLLSNTVSTLSCWPLFRDCAAYTISAAAVLGIIYDNQVYWYEGALLLLIYGLYVLVLCFDIKINQYIIKKCSPCCACLAKAMERSEQQPLMGWEDEGQPFIRRQSRTDSGIFYEDSGYSQLSISLHGLSQVSEDPPSVFNMPEADLKRIFWVLSLPIITLLFLTTPDCRKKFWKNYFVITFFMSAIWISAFTYILVWMVTITGETLEIPDTVMGLTLLAAGTSIPDTIASVLVARKGKGDMAMSNIVGSNVFDMLCLGIPWFIKTAFINGSAPAEVNSRGLTYITISLNISIIFLFLAVHFNGWKLDRKLGIVCLLSYLGLATLSVLYELGIIGNNKIRGCGG

SEQ ID NO: 80867 - protein, 440 aa, Homo sapiens
  Payload ID: 16118
  Gene Symbol: SLC24A5
  Gene Name: solute carrier family 24 (sodium/potassium/calcium exchanger), member 5
  Uniprot ID: Q71RS6
  ENSP ID: ENSP00000389966
MQTKGGQTWARRALLLGILWATAHLPLSGTSLPQRLPRATALGLSQDVAGTTFMAAGSSAPELVTAFLGVFITKGDIGISTILGSAIYNLLGICAACGLLSNTVSTLSCWPLFRDCAAYTISAAAVLGIIYDNQVYWYEGALLLLIYGLYVLVLCFDIKINQYIIKKCSPCCACLAKAMERSEQQPLMGWEDEGQPFIRRQSRTDSGIFYEDSGYSQLSISLHGLSQVSEDPPSVFNMPEADLKRIFWVLSLPIITLLFLTTPDCRKKFWKNYFVITFFMSAIWISAFTYILVWMVTITGETLEIPDTVMGLTLLAAGTSIPDTIASVLVARKGKGDMAMSNIVGSNVFDMLCLGIPWFIKTAFINGSAPAEVNSRGLTYITISLNISIIFLFLAVHFNGWKLDRKLGIVCLLSYLGLATLSVLYELGIIGNNKIRGCGG

SEQ ID NO: 80868 - protein, 122 aa, Homo sapiens
  Payload ID: 16118
  Gene Symbol: SLC24A5
  Gene Name: solute carrier family 24 (sodium/potassium/calcium exchanger), member 5
  ENSP ID: ENSP00000453395
MQTKGGQTWARRALLLGILWATAHLPLSGTSLPQRLPRATGNSTQCVISPSSEFPEGFFTRQERRDGGIIIYFLIIVYMFMAISIVCDEYFLPSLEIISECKWLESCPVTFWESVPHRYDCL

SEQ ID NO: 80869 - protein, 87 aa, Homo sapiens
  Payload ID: 16119
  Gene Symbol: SLC25A12
  Gene Name: solute carrier family 25 (aspartate/glutamate carrier), member 12
  ENSP ID: ENSP00000263812
MAVKVQTTKRGDPHELRNIFLQYASTEVDGERYMTPEDFVQRYLGLYNDPNSNPKIVQLLAGVADQTKDGKCQRNFWTDYYSSSYPF

SEQ ID NO: 80870 - protein, 678 aa, Homo sapiens
  Payload ID: 16119
  Gene Symbol: SLC25A12
  Gene Name: solute carrier family 25 (aspartate/glutamate carrier), member 12
  Uniprot ID: O75746
  ENSP ID: ENSP00000388658
MAVKVQTTKRGDPHELRNIFLQYASTEVDGERYMTPEDFVQRYLGLYNDPNSNPKIVQLLAGVADQTKDGLISYQEFLAFESVLCAPDSMFIVAFQLFDKSGNGEVTFENVKEIFGQTIIHHHIPFNWDCEFIRLHFGHNRKKHLNYTEFTQFLQELQLEHARQAFALKDKSKSGMISGLDFSDIMVTIRSHMLTPFVEENLVSAAGGSISHQVSFSYFNAFNSLLNNMELVRKIYSTLAGTRKDVEVTKEEFAQSAIRYGQVTPLEIDILYQLADLYNASGRLTLADIERIAPLAEGALPYNLAELQRQQSPGLGRPIWLQIAESAYRFTLGSVAGAVGATAVYPIDLVKTRMQNQRGSGSVVGELMYKNSFDCFKKVLRYEGFFGLYRGLIPQLIGVAPEKAIKLTVNDFVRDKFTRRDGSVPLPAEVLAGGCAGGSQVIFTNPLEIVKIRLQVAGEITTGPRVSALNVLRDLGIFGLYKGAKACFLRDIPFSAIYFPVYAHCKLLLADENGHVGGLNLLAAGAMAGVPAASLVTPADVIKTRLQVAARAGQTTYSGVIDCFRKILREEGPSAFWKGTAARVFRSSPQFGVTLVTYELLQRWFYIDFGGLKPAGSEPTPKSRIADLPPANPDHIGGYRLATATFAGIENKFGLYLPKFKSPSVAVVQPKAAVAATQ

SEQ ID NO: 80871 - protein, 210 aa, Homo sapiens
  Payload ID: 16119
  Gene Symbol: SLC25A12
  Gene Name: solute carrier family 25 (aspartate/glutamate carrier), member 12
  ENSP ID: ENSP00000413968
MAVKVQTTKRGDPHELRNIFLQYASTEVDGERYMTPEDFVQRYLGLYNDPNSNPKIVQLLAGVADQTKDGLISYQEFLAFESVLCAPDSMFIVAFQLFDKSGNGEVTFGGVLWPHRWYSSSFQAHSWNRHGGSLGEECQPRSEKMSKKFLDRLLFIIISLLTGIVNLSDCILGITGRSILTTQNSRSFSRSCNWNMQDKPLHSKTKAKVA

SEQ ID NO: 80872 - protein, 175 aa, Homo sapiens
  Payload ID: 16119
  Gene Symbol: SLC25A12
  Gene Name: solute carrier family 25 (aspartate/glutamate carrier), member 12
  ENSP ID: ENSP00000437845
VQTTKRGDPHELRNIFLQYASTEVDGERYMTPEDFVQRYLGLYNDPNSNPKIVQLLAGVADQTKDGLISYQEFLAFESVLCAPDSMFIVAFQLFDKSGNGEVTFGFWIWGKGGVLWPHRWYSSSFQAHSWNRHGGSLGEECQPRSEGRNESCIPFQRKDENPISPVTSNAFFQLC

SEQ ID NO: 80873 - protein, 675 aa, Homo sapiens
  Payload ID: 16120
  Gene Symbol: SLC25A13
  Gene Name: solute carrier family 25 (aspartate/glutamate carrier), member 13
  Uniprot ID: Q9UJS0
  ENSP ID: ENSP00000265631
MAAAKVALTKRADPAELRTIFLKYASIEKNGEFFMSPNDFVTRYLNIFGESQPNPKTVELLSGVVDQTKDGLISFQEFVAFESVLCAPDALFMVAFQLFDKAGKGEVTFEDVKQVFGQTTIHQHIPFNWDSEFVQLHFGKERKRHLTYAEFTQFLLEIQLEHAKQAFVQRDNARTGRVTAIDFRDIMVTIRPHVLTPFVEECLVAAAGGTTSHQVSFSYFNGFNSLLNNMELIRKIYSTLAGTRKDVEVTKEEFVLAAQKFGQVTPMEVDILFQLADLYEPRGRMTLADIERIAPLEEGTLPFNLAEAQRQKASGDSARPVLLQVAESAYRFGLGSVAGAVGATAVYPIDLVKTRMQNQRSTGSFVGELMYKNSFDCFKKVLRYEGFFGLYRGLLPQLLGVAPEKAIKLTVNDFVRDKFMHKDGSVPLAAEILAGGCAGGSQVIFTNPLEIVKIRLQVAGEITTGPRVSALSVVRDLGFFGIYKGAKACFLRDIPFSAIYFPCYAHVKASFANEDGQVSPGSLLLAGAIAGMPAASLVTPADVIKTRLQVAARAGQTTYSGVIDCFRKILREEGPKALWKGAGARVFRSSPQFGVTLLTYELLQRWFYIDFGGVKPMGSEPVPKSRINLPAPNPDHVGGYKLAVATFAGIENKFGLYLPLFKPSVSTSKAIGGGP

SEQ ID NO: 80874 - protein, 676 aa, Homo sapiens
  Payload ID: 16120
  Gene Symbol: SLC25A13
  Gene Name: solute carrier family 25 (aspartate/glutamate carrier), member 13
  Uniprot ID: Q9UJS0
  ENSP ID: ENSP00000400101
MAAAKVALTKRADPAELRTIFLKYASIEKNGEFFMSPNDFVTRYLNIFGESQPNPKTVELLSGVVDQTKDGLISFQEFVAFESVLCAPDALFMVAFQLFDKAGKGEVTFEDVKQVFGQTTIHQHIPFNWDSEFVQLHFGKERKRHLTYAEFTQFLLEIQLEHAKQAFVQRDNARTGRVTAIDFRDIMVTIRPHVLTPFVEECLVAAAGGTTSHQVSFSYFNGFNSLLNNMELIRKIYSTLAGTRKDVEVTKEEFVLAAQKFGQVTPMEVDILFQLADLYEPRGRMTLADIERIAPLEEGTLPFNLAEAQRQQKASGDSARPVLLQVAESAYRFGLGSVAGAVGATAVYPIDLVKTRMQNQRSTGSFVGELMYKNSFDCFKKVLRYEGFFGLYRGLLPQLLGVAPEKAIKLTVNDFVRDKFMHKDGSVPLAAEILAGGCAGGSQVIFTNPLEIVKIRLQVAGEITTGPRVSALSVVRDLGFFGIYKGAKACFLRDIPFSAIYFPCYAHVKASFANEDGQVSPGSLLLAGAIAGMPAASLVTPADVIKTRLQVAARAGQTTYSGVIDCFRKILREEGPKALWKGAGARVFRSSPQFGVTLLTYELLQRWFYIDFGGVKPMGSEPVPKSRINLPAPNPDHVGGYKLAVATFAGIENKFGLYLPLFKPSVSTSKAIGGGP

SEQ ID NO: 80875 - protein, 73 aa, Homo sapiens
  Payload ID: 16120
  Gene Symbol: SLC25A13
  Gene Name: solute carrier family 25 (aspartate/glutamate carrier), member 13
  ENSP ID: ENSP00000473505
MAAAKVALTKRADPAELRTIFLKYASIEKNGEFFMSPNDFVTRYLNIFGESQPNPKTVELLSGVVDQTKDGGC

SEQ ID NO: 80876 - protein, 301 aa, Homo sapiens
  Payload ID: 16121
  Gene Symbol: SLC25A20
  Gene Name: solute carrier family 25 (carnitine/acylcarnitine translocase), member 20
  Uniprot ID: O43772
  ENSP ID: ENSP00000326305
MADQPKPISPLKNLLAGGFGGVCLVFVGHPLDTVKVRLQTQPPSLPGQPPMYSGTFDCFRKTLFREGITGLYRGMAAPIIGVTPMFAVCFFGFGLGKKLQQKHPEDVLSYPQLFAAGMLSGVFTTGIMTPGERIKCLLQIQASSGESKYTGTLDCAKKLYQEFGIRGIYKGTVLTLMRDVPASGMYFMTYEWLKNIFTPEGKRVSELSAPRILVAGGIAGIFNWAVAIPPDVLKSRFQTAPPGKYPNGFRDVLRELIRDEGVTSLYKGFNAVMIRAFPANAACFLGFEVAMKFLNWATPNL

SEQ ID NO: 80877 - protein, 76 aa, Homo sapiens
  Payload ID: 16121
  Gene Symbol: SLC25A20
  Gene Name: solute carrier family 25 (carnitine/acylcarnitine translocase), member 20
  ENSP ID: ENSP00000388563
MADQPKPISPLKNLLAGGFGGVCLVFVGHPLDTVKGRLCLTMGDLKDNMRDFGCKGPTADTATEFAWTTSHVLWDL

SEQ ID NO: 80878 - protein, 228 aa, Homo sapiens
  Payload ID: 16121
  Gene Symbol: SLC25A20
  Gene Name: solute carrier family 25 (carnitine/acylcarnitine translocase), member 20
  ENSP ID: ENSP00000388986
MADQPKPISPLKNLLAGGFGGVCLVFVGHPLDTVKVRLQTQPPSLPGQPPMYSGTFDCFRKTLFREIQASSGESKYTGTLDCAKKLYQEFGIRGIYKGTVLTLMRDVPASGMYFMTYEWLKNIFTPEGKRVSELSAPRILVAGGIAGIFNWAVAIPPDVLKSRFQTAPPGKYPNGFRDVLRELIRDEGVTSLYKGFNAVMIRAFPANAACFLGFEVAMKFLNWATPNL

SEQ ID NO: 80879 - protein, 315 aa, Homo sapiens
  Payload ID: 16122
  Gene Symbol: SLC25A18
  Gene Name: solute carrier family 25 (glutamate carrier), member 18
  Uniprot ID: Q9H1K4
  ENSP ID: ENSP00000329033
MTHQDLSITAKLINGGVAGLVGVTCVFPIDLAKTRLQNQHGKAMYKGMIDCLMKTARAEGFFGMYRGAAVNLTLVTPEKAIKLAANDFFRRLLMEDGMQRNLKMEMLAGCGAGMCQVVVTCPMEMLKIQLQDAGRLAVHHQGSASAPSTSRSYTTGSASTHRRPSATLIAWELLRTQGLAGLYRGLGATLLRDIPFSIIYFPLFANLNNLGFNELAGKASFAHSFVSGCVAGSIAAVAVTPLDVLKTRIQTLKKGLGEDMYSGITDCARKLWIQEGPSAFMKGAGCRALVIAPLFGIAQGVYFIGIGERILKCFD

SEQ ID NO: 80880 - protein, 315 aa, Homo sapiens; identical to SEQ ID NO: 80879
  Payload ID: 16122
  Gene Symbol: SLC25A18
  Gene Name: solute carrier family 25 (glutamate carrier), member 18
  Uniprot ID: Q9H1K4
  ENSP ID: ENSP00000382710

SEQ ID NO: 80881 - protein, 303 aa, Homo sapiens
  Payload ID: 16123
  Gene Symbol: SLC25A29
  Gene Name: solute carrier family 25 (mitochondrial carnitine/acylcarnitine carrier), member 29
  Uniprot ID: Q8N8R3
  ENSP ID: ENSP00000352167
MALDFLAGCAGGVAGVLVGHPFDTVKVRLQVQSVEKPQYRGTLHCFKSIIKQESVLGLYKGLGSPLMGLTFINALVFGVQGNTLRALGHDSPLNQFLAGAAAGAIQCVICCPMELAKTRLQLQDAGPARTYKGSLDCLAQIYGHEGLRGVNRGMVSTLLRETPSFGVYFLTYDALTRALGCEPGDRLLVPKLLLAGGTSGIVSWLSTYPVDVVKSRLQADGLRGAPRYRGILDCVHQSYRAEGWRVFTRGLASTLLRAFPVNAATFATVTVVLTYARGEEAGPEGEAVPAAPAGPALAQPSSL

SEQ ID NO: 80882 - protein, 145 aa, Homo sapiens
  Payload ID: 16123
  Gene Symbol: SLC25A29
  Gene Name: solute carrier family 25 (mitochondrial carnitine/acylcarnitine carrier), member 29
  Uniprot ID: Q8N8R3
  ENSP ID: ENSP00000376640
MALDFLAGCAGGTASGPERGEASVPRDVALLQVHHQARERAGPVQGPGLAAHGAHLHQRAGVRGAGQHPPGPGPRLAPQPVPGRCGGGRHPVRHLLPHGAGQDAAAAAGRGPSAHLQGLAGLPRADLRARGSAWRQPGHGVHVAA

SEQ ID NO: 80883 - protein, 237 aa, Homo sapiens
  Payload ID: 16123
  Gene Symbol: SLC25A29
  Gene Name: solute carrier family 25 (mitochondrial carnitine/acylcarnitine carrier), member 29
  Uniprot ID: Q8N8R3
  ENSP ID: ENSP00000450913
MGLTFINALVFGVQGNTLRALGHDSPLNQFLAGAAAGAIQCVICCPMELAKTRLQLQDAGPARTYKGSLDCLAQIYGHEGLRGVNRGMVSTLLRETPSFGVYFLTYDALTRALGCEPGDRLLVPKLLLAGGTSGIVSWLSTYPVDVVKSRLQADGLRGAPRYRGILDCVHQSYRAEGWRVFTRGLASTLLRAFPVNAATFATVTVVLTYARGEEAGPEGEAVPAAPAGPALAQPSSL

SEQ ID NO: 80884 - protein, 35 aa, Homo sapiens
  Payload ID: 16123
  Gene Symbol: SLC25A29
  Gene Name: solute carrier family 25 (mitochondrial carnitine/acylcarnitine carrier), member 29
  ENSP ID: ENSP00000451573
MALDFLAGCAGGVAGVLVGHPFDTVKGLSPSIAKV

SEQ ID NO: 80885 - protein, 138 aa, Homo sapiens
  Payload ID: 16123
  Gene Symbol: SLC25A29
  Gene Name: solute carrier family 25 (mitochondrial carnitine/acylcarnitine carrier), member 29
  ENSP ID: ENSP00000451644
MALDFLAGCAGGTASGPERGEASVPRDVALLQVHHQARERAGPVQGPGLAAHGAHLHQRAGVRGAGQHPPGPGPRLAPQPVPGRCGGGRHPVRHLLPHGAGQDAAAAAGRGPSAHLQGLAGLPRADLRARGSAWRQPG

SEQ ID NO: 80886 - protein, 122 aa, Homo sapiens
  Payload ID: 16123
  Gene Symbol: SLC25A29
  Gene Name: solute carrier family 25 (mitochondrial carnitine/acylcarnitine carrier), member 29
  ENSP ID: ENSP00000451808
MALDFLAGCAGGVAGVLVGHPFDTVKALGTERIQDLDLLYSAQNHSHRPEAHGLHTFLHEGSFLSCFLGHSNNQGAVVLTYDEGVTGHPWAWDGECGWGLAVGAPRLDVMLKFCVALTAFTF

SEQ ID NO: 80887 - protein, 35 aa, Homo sapiens; identical to SEQ ID NO: 80884
  Payload ID: 16123
  Gene Symbol: SLC25A29
  Gene Name: solute carrier family 25 (mitochondrial carnitine/acylcarnitine carrier), member 29
  ENSP ID: ENSP00000451952

SEQ ID NO: 80888 - protein, 237 aa, Homo sapiens; identical to SEQ ID NO: 80883
  Payload ID: 16123
  Gene Symbol: SLC25A29
  Gene Name: solute carrier family 25 (mitochondrial carnitine/acylcarnitine carrier), member 29
  Uniprot ID: Q8N8R3
  ENSP ID: ENSP00000452078

SEQ ID NO: 80889 - protein, 129 aa, Homo sapiens
  Payload ID: 16123
  Gene Symbol: SLC25A29
  Gene Name: solute carrier family 25 (mitochondrial carnitine/acylcarnitine carrier), member 29
  ENSP ID: ENSP00000452324
MGLTFINALVFGVQGNTLRALGHDSPLNQFLAGAAAGAIQCVICCPMELAKTRLQLQDAGPARTYKGSLDCLAQIYGHEGLRGVNRGMVSTLLRETPSFGVYFLTYDALTRALGCEPGDRLLVPKLLLA

SEQ ID NO: 80890 - protein, 237 aa, Homo sapiens; identical to SEQ ID NO: 80883
  Payload ID: 16123
  Gene Symbol: SLC25A29
  Gene Name: solute carrier family 25 (mitochondrial carnitine/acylcarnitine carrier), member 29
  Uniprot ID: Q8N8R3
  ENSP ID: ENSP00000452446

SEQ ID NO: 80891 - protein, 57 aa, Homo sapiens
  Payload ID: 16124
  Gene Symbol: SLC25A16
  Gene Name: solute carrier family 25 (mitochondrial carrier), member 16
  ENSP ID: ENSP00000476283
MAAATAAAALAAADPPPAMPQAAGAGGPTTRRDFYWLRSFLAGEEEEVTSNRTWQLD

SEQ ID NO: 80892 - protein, 92 aa, Homo sapiens
  Payload ID: 16124
  Gene Symbol: SLC25A16
  Gene Name: solute carrier family 25 (mitochondrial carrier), member 16
  ENSP ID: ENSP00000476555
MAAATAAAALAAADPPPAMPQAAGAGGPTTRRDFYWLRSFLAGEEEEFTSNRTWQSDKYLQVSVSVKMFQKKRRLLQTEPGSWINTLKCLSP

SEQ ID NO: 80893 - protein, 65 aa, Homo sapiens
  Payload ID: 16124
  Gene Symbol: SLC25A16
  Gene Name: solute carrier family 25 (mitochondrial carrier), member 16
  ENSP ID: ENSP00000476587
AFEHYKTLITTKLGISGHVHRLMAGSMAGKHILLFVLDCSCKLREEESCYHHYSRYDSSYLYLPS

SEQ ID NO: 80894 - protein, 332 aa, Homo sapiens
  Payload ID: 16124
  Gene Symbol: SLC25A16
  Gene Name: solute carrier family 25 (mitochondrial carrier), member 16
  Uniprot ID: P16260
  ENSP ID: ENSP00000476815
MAAATAAAALAAADPPPAMPQAAGAGGPTTRRDFYWLRSFLAGGIAGCCAKTTVAPLDRVKVLLQAHNHHYKHLGVFSALRAVPQKEGFLGLYKGNGAMMIRIFPYGAIQFMAFEHYKTLITTKLGISGHVHRLMAGSMAGMTAVICTYPLDMVRVRLAFQVKGEHSYTGIIHAFKTIYAKEGGFFGFYRGLMPTILGMAPYAGVSFFTFGTLKSVGLSHAPTLLGRPSSDNPNVLVLKTHVNLLCGGVAGAIAQTISYPFDVTRRRMQLGTVLPEFEKCLTMRDTMKYVYGHHGIRKGLYRGLSLNYIRCIPSQAVAFTTYELMKQFFHLN

SEQ ID NO: 80895 - protein, 65 aa, Homo sapiens
  Payload ID: 16124
  Gene Symbol: SLC25A16
  Gene Name: solute carrier family 25 (mitochondrial carrier), member 16
  ENSP ID: ENSP00000477328
  MOD_RES (1)..(1): Any amino acid
XLSHAPTLLGRPSSDNPNVLVLKTHVNLLCGGVAGAIAQTISYPFDVTRRRMQLGTVLPEFEKCL

SEQ ID NO: 80896 - protein, 325 aa, Homo sapiens
  Payload ID: 16125
  Gene Symbol: SLC25A14
  Gene Name: solute carrier family 25 (mitochondrial carrier, brain), member 14
  Uniprot ID: O95258
  ENSP ID: ENSP00000218197
MGIFPGIILIFLRVKFATAAVIVSGHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDETLLINMICGVVSGVISSTIANPTDVLKIRMQAQGSLFQGSMIGSFIDIYQQEGTRGLWRGVVPTAQRAAIVVGVELPVYDITKKHLILSGMMGDTILTHFVSSFTCGLAGALASNPVDVVRTRMMNQRAIVGHVDLYKGTVDGILKMWKHEGFFALYKGFWPNWLRLGPWNIIFFITYEQLKRLQI

SEQ ID NO: 80897 - protein, 353 aa, Homo sapiens
  Payload ID: 16125
  Gene Symbol: SLC25A14
  Gene Name: solute carrier family 25 (mitochondrial carrier, brain), member 14
  Uniprot ID: O95258
  ENSP ID: ENSP00000342797
MGIFPGIILIFLRVKFATAAVIHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDETLLINMICGVVSGVISSTIANPTDVLKIRMQAQGSLFQGSMIGSFIDIYQQEGTRGLWRCLCSKAVTGCVLWLMPVIPALWEANAGGSLEGVVPTAQRAAIVVGVELPVYDITKKHLILSGMMGDTILTHFVSSFTCGLAGALASNPVDVVRTRMMNQRAIVGHVDLYKGTVDGILKMWKHEGFFALYKGFWPNWLRLGPWNIIFFITYEQLKRLQI

SEQ ID NO: 80898 - protein, 322 aa, Homo sapiens
  Payload ID: 16125
  Gene Symbol: SLC25A14
  Gene Name: solute carrier family 25 (mitochondrial carrier, brain), member 14
  Uniprot ID: O95258
  ENSP ID: ENSP00000354455
MGIFPGIILIFLRVKFATAAVIHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDETLLINMICGVVSGVISSTIANPTDVLKIRMQAQGSLFQGSMIGSFIDIYQQEGTRGLWRGVVPTAQRAAIVVGVELPVYDITKKHLILSGMMGDTILTHFVSSFTCGLAGALASNPVDVVRTRMMNQRAIVGHVDLYKGTVDGILKMWKHEGFFALYKGFWPNWLRLGPWNIIFFITYEQLKRLQI

SEQ ID NO: 80899 - protein, 198 aa, Homo sapiens
  Payload ID: 16125
  Gene Symbol: SLC25A14
  Gene Name: solute carrier family 25 (mitochondrial carrier, brain), member 14
  ENSP ID: ENSP00000402578
MGIFPGIILIFLRVKFATAAVIVSGHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDETLLINMICGVVSGVISSTIANPTDVLKIRMQAQGSLFQGSMIGSFIDIYQQEGTRGLWR

SEQ ID NO: 80900 - protein, 325 aa, Homo sapiens; identical to SEQ ID NO: 80896
  Payload ID: 16125
  Gene Symbol: SLC25A14
  Gene Name: solute carrier family 25 (mitochondrial carrier, brain), member 14
  Uniprot ID: O95258
  ENSP ID: ENSP00000444642

SEQ ID NO: 80901 - protein, 290 aa, Homo sapiens
  Payload ID: 16125
  Gene Symbol: SLC25A14
  Gene Name: solute carrier family 25 (mitochondrial carrier, brain), member 14
  ENSP ID: ENSP00000445225
MSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDETLLINMICGVVSGVISSTIANPTDVLKIRMQAQGSLFQGSMIGSFIDIYQQEGTRGLWRGVVPTAQRAAIVVGVELPVYDITKKHLILSGMMGDTILTHFVSSFTCGLAGALASNPVDVVRTRMMNQRAIVGHVDLYKGTVDGILKMWKHEGFFALYKGFWPNWLRLGPWNIIFFITYEQLKRLQI

SEQ ID NO: 80902 - protein, 353 aa, Homo sapiens; identical to SEQ ID NO: 80897
  Payload ID: 16125
  Gene Symbol: SLC25A14
  Gene Name: solute carrier family 25 (mitochondrial carrier, brain), member 14
  Uniprot ID: O95258
  ENSP ID: ENSP00000477981

SEQ ID NO: 80903 - protein, 323 aa, Homo sapiens
  Payload ID: 16126
  Gene Symbol: SLC25A22
  Gene Name: solute carrier family 25 (mitochondrial carrier: glutamate), member 22
  Uniprot ID: Q9H936
  ENSP ID: ENSP00000322020
MADKQISLPAKLINGGIAGLIGVTCVFPIDLAKTRLQNQQNGQRVYTSMSDCLIKTVRSEGYFGMYRGAAVNLTLVTPEKAIKLAANDFFRHQLSKDGQKLTLLKEMLAGCGAGTCQVIVTTPMEMLKIQLQDAGRIAAQRKILAAQGQLSAQGGAQPSVEAPAAPRPTATQLTRDLLRSRGIAGLYKGLGATLLRDVPFSVVYFPLFANLNQLGRPASEEKSPFYVSFLAGCVAGSAAAVAVNPCDVVKTRLQSLQRGVNEDTYSGILDCARKILRHEGPSAFLKGAYCRALVIAPLFGIAQVVYFLGIAESLLGLLQDPQA

SEQ ID NO: 80904 - protein, 114 aa, Homo sapiens
  Payload ID: 16126
  Gene Symbol: SLC25A22
  Gene Name: solute carrier family 25 (mitochondrial carrier: glutamate), member 22
  ENSP ID: ENSP00000392749
MADKQISLPAKLINGGIAGLIGVTCVFPIDLAKTRLQNQQNGQRVYTSMSDCLIKTVRSEGYFGMYRGAAVNLTLVTPEKAIKLAANDFFRHQLSKDGQKLTLLKEMLAGCGAG

SEQ ID NO: 80905 - protein, 190 aa, Homo sapiens
  Payload ID: 16126
  Gene Symbol: SLC25A22
  Gene Name: solute carrier family 25 (mitochondrial carrier: glutamate), member 22
  ENSP ID: ENSP00000431466
MADKQISLPAKLINGGIAGLIGVTCVFPIDLAKTRLQNQQNGQRVYTSMSDCLIKTVRSEGYFGMYRGAAVNLTLVTPEKAIKLAANDFFRHQLSKDGQKLTLLKEMLAGCGAGTCQVIVTTPMEMLKIQLQDAGRIAAQRKILAAQGQLSAQGGAQPSVEAPAAPRPTATQLTRDLLRSRGIAGLYKGL

SEQ ID NO: 80906 - protein, 313 aa, Homo sapiens
  Payload ID: 16126
  Gene Symbol: SLC25A22
  Gene Name: solute carrier family 25 (mitochondrial carrier: glutamate), member 22
  ENSP ID: ENSP00000431829
MADKQISLPAKLINGGIAGLIGVTCVFPIDLAKTRLQNQQNGQRVYTSIPRQSRDPGLRLAPAGPGSPCPLGHRSDCLIKTVRSEGYFGMYRGAAVNLTLVTPEKAIKLAANDFFRHQLSKDGQKLTLLKEMLAGCGAGTCQVIVTTPMEMLKIQLQDAGRIAAQRKILAAQGQLSAQGGAQPSVEAPAAPRPTATQLTRDLLRSRGIAGLYKGLGATLLRDVPFSVVYFPLFANLNQLGRPASEEKSPFYVSFLAGCVAGSAAAVAVNPCDVVKTRLQSLQRGVNEDTYSGILDCARKILRHEGPSAFLKGA

SEQ ID NO: 80907 - protein, 72 aa, Homo sapiens
  Payload ID: 16126
  Gene Symbol: SLC25A22
  Gene Name: solute carrier family 25 (mitochondrial carrier: glutamate), member 22
  ENSP ID: ENSP00000432222
MADKQISLPAKLINGGIAGLIGVTCVFPIDLAKTRLQNQQNGQRVYTSMSDCLIKTVRSEGYFGMYRGEELL

SEQ ID NO: 80908 - protein, 103 aa, Homo sapiens
  Payload ID: 16126
  Gene Symbol: SLC25A22
  Gene Name: solute carrier family 25 (mitochondrial carrier: glutamate), member 22
  ENSP ID: ENSP00000432817
MADKQISLPAKLINGGIAGLIGVTCVFPIDLAKTRLQNQQNGQRVYTSMSDCLIKTVRSEGYFGMYRGAAVNLTLVTPEKAIKLAANDFFRHQLSKDGQKLTL

SEQ ID NO: 80909 - protein, 78 aa, Homo sapiens
  Payload ID: 16126
  Gene Symbol: SLC25A22
  Gene Name: solute carrier family 25 (mitochondrial carrier: glutamate), member 22
  ENSP ID: ENSP00000433028
MADKQISLPAKLINGGIAGLIGVTCVFPIDLAKTRLQNQQNGQRVYTSMSDCLIKTVRSEGYFGMYRGAAVNLTLVTP

SEQ ID NO: 80910 - protein, 72 aa, Homo sapiens; identical to SEQ ID NO: 80907
  Payload ID: 16126
  Gene Symbol: SLC25A22
  Gene Name: solute carrier family 25 (mitochondrial carrier: glutamate), member 22
  ENSP ID: ENSP00000433655

SEQ ID NO: 80911 - protein, 72 aa, Homo sapiens; identical to SEQ ID NO: 80907
  Payload ID: 16126
  Gene Symbol: SLC25A22
  Gene Name: solute carrier family 25 (mitochondrial carrier: glutamate), member 22
  ENSP ID: ENSP00000433780

SEQ ID NO: 80912 - protein, 161 aa, Homo sapiens
  Payload ID: 16126
  Gene Symbol: SLC25A22
  Gene Name: solute carrier family 25 (mitochondrial carrier: glutamate), member 22
  ENSP ID: ENSP00000434287
MADKQISLPAKLINGGIAGLIGVTCVFPIDLAKTRLQNQQNGQRVYTSMSDCLIKTVRSEGYFGMYRGAAVNLTLVTPEKAIKLAANDFFRHQLSKDGQKLTLLKEMLAGCGAGTCQVIVTTPMEMLKIQLQDAGRIAAQRKILAAQGQLSAQGGAQPSVE

SEQ ID NO: 80913 - protein, 134 aa, Homo sapiens
  Payload ID: 16126
  Gene Symbol: SLC25A22
  Gene Name: solute carrier family 25 (mitochondrial carrier: glutamate), member 22
  ENSP ID: ENSP00000434479
MADKQISLPAKLINGGIAGLIGVTCVFPIDLAKTRLQNQQNGQRVYTSMSDCLIKTVRSEGYFGMYRGAAVNLTLVTPEKAIKLAANDFFRHQLSKDGQKLTLLKEMLAGCGAGTCQVIVTTPMEMLKIQLQDA

SEQ ID NO: 80914 - protein, 65 aa, Homo sapiens
  Payload ID: 16126
  Gene Symbol: SLC25A22
  Gene Name: solute carrier family 25 (mitochondrial carrier: glutamate), member 22
  ENSP ID: ENSP00000434850
MADKQISLPAKLINGGIAGLIGVTCVFPIDLAKTRLQNQQNGQRVYTSMSDCLIKTVRSEGYFGM

SEQ ID NO: 80915 - protein, 156 aa, Homo sapiens
  Payload ID: 16126
  Gene Symbol: SLC25A22
  Gene Name: solute carrier family 25 (mitochondrial carrier: glutamate), member 22
  ENSP ID: ENSP00000435402
MADKQISLPAKLINGGIAGLIGVTCVFPIDLAKTRLQNQQNGQRVYTSMSDCLIKTVRSEGYFGMYRGAAVNLTLVTPEKAIKLAANDFFRHQLSKDGQKLTLLKEMLAGCGAGTCQVIVTTPMEMLKIQLQDAGRIAAQRKILAAQGQLSAQGGA

SEQ ID NO: 80916 - protein, 196 aa, Homo sapiens
  Payload ID: 16126
  Gene Symbol: SLC25A22
  Gene Name: solute carrier family 25 (mitochondrial carrier: glutamate), member 22
  ENSP ID: ENSP00000435862
MADKQISLPAKLINGGIAGLIGVTCVFPIDLAKTRLQNQQNGQRVYTSMSDCLIKTVRSEGYFGAAVNLTLVTPEKAIKLAANDFFRHQLSKDGQKLTLLKEMLAGCGAGTCQVIVTTPMEMLKIQLQDAGRIAAQRKILAAQGQLSAQGGAQPSVEAPAAPRPTATQLTRDLLRSRGIAGLYKGLGATLLRDVPF

SEQ ID NO: 80917 - protein, 127 aa, Homo sapiens
  Payload ID: 16126
  Gene Symbol: SLC25A22
  Gene Name: solute carrier family 25 (mitochondrial carrier: glutamate), member 22
  ENSP ID: ENSP00000436745
MADKQISLPAKLINGGIAGLIGVTCVFPIDLAKTRLQNQQNGQRVYTSMSDCLIKTVRSEGYFGMYRGAAVNLTLVTPEKAIKLAANDFFRHQLSKDGQKLTLLKEMLAGCGAGTCQVIVTTPMEML

SEQ ID NO: 80918 - protein, 177 aa, Homo sapiens
  Payload ID: 16126
  Gene Symbol: SLC25A22
  Gene Name: solute carrier family 25 (mitochondrial carrier: glutamate), member 22
  ENSP ID: ENSP00000437045
MADKQISLPAKLINGGIAGLIGVTCVFPIDLAKTRLQNQQNGQRVYTSMSDCLIKTVRSEGYFGMYRGAAVNLTLVTPEKAIKLAANDFFRHQLSKDGQKLTLLKEMLAGCGAGTCQVIVTTPMEMLKIQLQDAGRIAAQRKILAAQGQLSAQGGAQPSVEAPAAPRPTATQLTRDL

SEQ ID NO: 80919 - protein, 323 aa, Homo sapiens; identical to SEQ ID NO: 80903
  Payload ID: 16126
  Gene Symbol: SLC25A22
  Gene Name: solute carrier family 25 (mitochondrial carrier: glutamate), member 22
  Uniprot ID: Q9H936
  ENSP ID: ENSP00000437236

SEQ ID NO: 80920 - protein, 197 aa, Homo sapiens
  Payload ID: 16126
  Gene Symbol: SLC25A22
  Gene Name: solute carrier family 25 (mitochondrial carrier: glutamate), member 22
  ENSP ID: ENSP00000485719
MADKQISLPAKLINGGIAGLIGVTCVFPIDLAKTRLQNQQNGQRVYTSMSDCLIKTVRSEGYFGMYRGAAVNLTLVTPEKAIKLAANDFFRHQLSKDGQKLTLLKEMLAGCGAGTCQVIVTTPMEMLKIQLQDAGRIAAQRKILAAQGQLSAQGGAQPSVEAPAAPRPTATQLTRDLLRSRGIAGLYKGLGATLLRD

SEQ ID NO: 80921 - protein, 323 aa, Homo sapiens; identical to SEQ ID NO: 80903
  Payload ID: 16126
  Gene Symbol: SLC25A22
  Gene Name: solute carrier family 25 (mitochondrial carrier: glutamate), member 22
  Uniprot ID: Q9H936
  ENSP ID: ENSP00000486058

SEQ ID NO: 80922 - protein, 97 aa, Homo sapiens
  Payload ID: 16126
  Gene Symbol: SLC25A22
  Gene Name: solute carrier family 25 (mitochondrial carrier: glutamate), member 22
  ENSP ID: ENSP00000486434
MADKQISLPAKLINGGIAGLIGVTCVFPIDLAKTRLQNQQNGQRVYTSMSDCLIKTVRSEGYFGMYRGAAVNLTLVTPEKAIKLAANDFFRHQLSKD

SEQ ID NO: 80923 - protein, 247 aa, Homo sapiens
  Payload ID: 16126
  Gene Symbol: SLC25A22
  Gene Name: solute carrier family 25 (mitochondrial carrier: glutamate), member 22
  ENSP ID: ENSP00000486512
MADKQISLPAKLINGGIAGLIGVTCVFPIDLAKTRLQNQQNGQRVYTSMSDCLIKTVRSEGYFGMYRGAAVNLTLVTPEKAIKLAANDFFRHQLSKDGQKLTLLKEMLAGCGAGTCQVIVTTPMEMLKIQLQDAGRIAAQRKILAAQGQLSAQGGAQPSVEAPAAPRPTATQLTRDLLRSRGIAGLYKGLGATLLRDVPFSVVYFPLFANLNQLGRPASEEKSPFYVSFLAGCVAGSAAAVAVNPCD

SEQ ID NO: 80924 - protein, 117 aa, Homo sapiens
  Payload ID: 16126
  Gene Symbol: SLC25A22
  Gene Name: solute carrier family 25 (mitochondrial carrier: glutamate), member 22
  ENSP ID: ENSP00000487237
MADKQISLPAKLINGGIAGLIGVTCVFPIDLAKTRLQNQQNGQRVYTSMSDCLIKTVRSEGYFGMYRGAAVNLTLVTPEKAIKLAANDFFRHQLSKDGQKLTLLKEMLAGCGAGTCQ

SEQ ID NO: 80925 - protein, 315 aa, Homo sapiens
  Payload ID: 16127
  Gene Symbol: SLC25A31
  Gene Name: solute carrier family 25 (mitochondrial carrier
  adenine nucleotide translocator), member 31
  Uniprot ID: Q9H0C2
  ENSP ID: ENSP00000281154
MHREPAKKKAEKRLFDASSFGKDLLAGGVAAAVSKTAVAPIERVKLLLQVQASSKQISPEARYKGMVDCLVRIPREQGFFSFWRGNLANVIRYFPTQALNFAFKDKYKQLFMSGVNKEKQFWRWFLANLASGGAAGATSLCVVYPLDFARTRLGVDIGKGPEERQFKGLGDCIMKIAKSDGIAGLYQGFGVSVQGIIVYRASYFGAYDTVKGLLPKPKKTPFLVSFFIAQVVTTCSGILSYPFDTVRRRMMMQSGEAKRQYKGTLDCFVKIYQHEGISSFFRGAFSNVLRGTGGALVLVLYDKIKEFFHIDIGGR

SEQ ID NO: 80926 - protein, 298 aa, Homo sapiens
  Payload ID: 16128
  Gene Symbol: SLC25A4
  Gene Name: solute carrier family 25 (mitochondrial carrier
  adenine nucleotide translocator), member 4
  Uniprot ID: P12235
  ENSP ID: ENSP00000281456
MGDHAWSFLKDFLAGGVAAAVSKTAVAPIERVKLLLQVQHASKQISAEKQYKGIIDCVVRIPKEQGFLSFWRGNLANVIRYFPTQALNFAFKDKYKQLFLGGVDRHKQFWRYFAGNLASGGAAGATSLCFVYPLDFARTRLAADVGKGAAQREFHGLGDCIIKIFKSDGLRGLYQGFNVSVQGIIIYRAAYFGVYDTAKGMLPDPKNVHIFVSWMIAQSVTAVAGLVSYPFDTVRRRMMMQSGRKGADIMYTGTVDCWRKIAKDEGAKAFFKGAWSNVLRGMGGAFVLVLYDEIKKYV

SEQ ID NO: 80927 - protein, 208 aa, Homo sapiens
  Payload ID: 16128
  Gene Symbol: SLC25A4
  Gene Name: solute carrier family 25 (mitochondrial carrier
  adenine nucleotide translocator), member 4
  ENSP ID: ENSP00000476711
MGDHAWSFLKDFLAGGVAAAVSKTAVAPIERVKLLLQVQHASKQISAEKQYKGIIDCVVRIPKEQGFLSFWRGNLANVIRYFPTQALNFAFKDKYKQLFLGGVDRHKQFWRYFAGNLASGGAAGATSLCFVYPLDFARTRLAADVGKGAAQREFHGLGDCIIKIFKSDGLRGLYQGFNVSVQGIIIYRAAYFGVYDTAKVSGIIEASE

SEQ ID NO: 80928 - protein, 298 aa, Homo sapiens
  Payload ID: 16129
  Gene Symbol: SLC25A5
  Gene Name: solute carrier family 25 (mitochondrial carrier
  adenine nucleotide translocator), member 5
  Uniprot ID: P05141
  ENSP ID: ENSP00000360671
MTDAAVSFAKDFLAGGVAAAISKTAVAPIERVKLLLQVQHASKQITADKQYKGIIDCVVRIPKEQGVLSFWRGNLANVIRYFPTQALNFAFKDKYKQIFLGGVDKRTQFWLYFAGNLASGGAAGATSLCFVYPLDFARTRLAADVGKAGAEREFRGLGDCLVKIYKSDGIKGLYQGFNVSVQGIIIYRAAYFGIYDTAKGMLPDPKNTHIVISWMIAQTVTAVAGLTSYPFDTVRRRMMMQSGRKGTDIMYTGTLDCWRKIARDEGGKAFFKGAWSNVLRGMGGAFVLVLYDEIKKYT

SEQ ID NO: 80929 - protein, 298 aa, Homo sapiens
  Payload ID: 16130
  Gene Symbol: SLC25A6
  Gene Name: solute carrier family 25 (mitochondrial carrier
  adenine nucleotide translocator), member 6
  Uniprot ID: P12236
  ENSP ID: ENSP00000370808
MTEQAISFAKDFLAGGIAAAISKTAVAPIERVKLLLQVQHASKQIAADKQYKGIVDCIVRIPKEQGVLSFWRGNLANVIRYFPTQALNFAFKDKYKQIFLGGVDKHTQFWRYFAGNLASGGAAGATSLCFVYPLDFARTRLAADVGKSGTEREFRGLGDCLVKITKSDGIRGLYQGFSVSVQGIIIYRAAYFGVYDTAKGMLPDPKNTHIVVSWMIAQTVTAVAGVVSYPFDTVRRRMMMQSGRKGADIMYTGTVDCWRKIFRDEGGKAFFKGAWSNVLRGMGGAFVLVLYDELKKVI

SEQ ID NO: 80930 - protein, 311 aa, Homo sapiens
  Payload ID: 16131
  Gene Symbol: SLC25A1
  Gene Name: solute carrier family 25 (mitochondrial carrier
  citrate transporter), member 1
  Uniprot ID: P53007
  ENSP ID: ENSP00000215882
MPAPRAPRALAAAAPASGKAKLTHPGKAILAGGLAGGIEICITFPTEYVKTQLQLDERSHPPRYRGIGDCVRQTVRSHGVLGLYRGLSSLLYGSIPKAAVRFGMFEFLSNHMRDAQGRLDSTRGLLCGLGAGVAEAVVVVCPMETIKVKFIHDQTSPNPKYRGFFHGVREIVREQGLKGTYQGLTATVLKQGSNQAIRFFVMTSLRNWYRGDNPNKPMNPLITGVFGAIAGAASVFGNTPLDVIKTRMQGLEAHKYRNTWDCGLQILKKEGLKAFYKGTVPRLGRVCLDVAIVFVIYDEVVKLLNKVWKTD

SEQ ID NO: 80931 - protein, 208 aa, Homo sapiens
  Payload ID: 16131
  Gene Symbol: SLC25A1
  Gene Name: solute carrier family 25 (mitochondrial carrier
  citrate transporter), member 1
  ENSP ID: ENSP00000401480
MFEFLSNHMRDAQGRLDSTRGLLCGLGAGVAEAVVVVCPMETIKVKFIHDQTSPNPKYRGFFHGVREIVREQGLKGTYQGLTATVLKQGSNQAIRFFVMTSLRNWYRGDNPNKPMNPLITGVFGAIAGAASVFGNTPLDVIKTRMQGLEAHKYRNTWDCGLQILKKEGLKAFYKGTVPRLGRVCLDVAIVFVIYDEVVKLLNKVWKTD

SEQ ID NO: 80932 - protein, 296 aa, Homo sapiens
  Payload ID: 16132
  Gene Symbol: SLC25A10
  Gene Name: solute carrier family 25 (mitochondrial carrier
  dicarboxylate transporter), member 10
  Uniprot ID: Q9UBX3
  ENSP ID: ENSP00000328403
MAAEARVSRWYFGGLASCGAACCTHPLDLLKVHLQTQQEVKLRMTGMALRVVRTDGILALYSGLSASLCRQMTYSLTRFAIYETVRDRVAKGSQGPLPFHEKVLLGSVSGLAGGFVGTPADLVNVRMQNDVKLPQGQRRNYAHALDGLYRVAREEGLRRLFSGATMASSRGALVTVGQLSCYDQAKQLVLSTGYLSDNIFTHFVASFIAAAGDEPPPQGGCATFLCQPLDVLKTRLMNSKGEYQGVFHCAVETAKLGPLAFYKGLVPAGIRLIPHTVLTFVFLEQLRKNFGIKVPS

SEQ ID NO: 80933 - protein, 287 aa, Homo sapiens
  Payload ID: 16132
  Gene Symbol: SLC25A10
  Gene Name: solute carrier family 25 (mitochondrial carrier
  dicarboxylate transporter), member 10
  Uniprot ID: Q9UBX3
  ENSP ID: ENSP00000345580
MAAEARVSRWYFGGLASCGAACCTHPLDLLKVHLQTQQEVKLRMTGMALRVVRTDGILALYSGLSASLCRQMTYSLTRFAIYETVRDRVAKGSQGPLPFHEKVLLGSVSGLAGGFVGTPADLVNVRMQNDVKLPQGQRRNYAHALDGLYRVAREEGLRRLFSGATMASSRGALVTVGQLSCYDQAKQLVLSTGYLSDNIFTHFVASFIAGGCATFLCQPLDVLKTRLMNSKGEYQGVFHCAVETAKLGPLAFYKGLVPAGIRLIPHTVLTFVFLEQLRKNFGIKVPS

SEQ ID NO: 80934 - protein, 406 aa, Homo sapiens
  Payload ID: 16132
  Gene Symbol: SLC25A10
  Gene Name: solute carrier family 25 (mitochondrial carrier
  dicarboxylate transporter), member 10
  ENSP ID: ENSP00000446242
MAAEARVSRWYFGGLASCGAACCTHPLDLLKVHLQTQQEVKLRMTGMALRVVRTDGILALYSGLSASLCRQMTYSLTRFAIYETVRDRVAKGSQGPLPFHEKVLLGSVSGLAGGFVGTPADLVNVRMQNDVKLPQGQRRNYAHALDGLYRVAREEGLRRLFSGATMASSRGALVTVGQLYCRWMCHVPVPAPGCAEDSPDELQGGVSGRFPLRRGDSEARASGLLQGPRPSWHPPHPPHRAHFCVSGTATQKLWHQSAILTSRGNGWAARPDTLGSSKESQAQHLLLGPRPPWPWPPVLRSRPLLSPHLLAELLLASSPLSCSCTTPALATRLSRLGTAWPCPSPAGSSSGEQGLPEADFSPLLGQGRGIIPASCPRCPKQHLPALSIEDLGGRVWVQPGCCSPKC

SEQ ID NO: 80935 - protein, 113 aa, Homo sapiens
  Payload ID: 16132
  Gene Symbol: SLC25A10
  Gene Name: solute carrier family 25 (mitochondrial carrier
  dicarboxylate transporter), member 10
  ENSP ID: ENSP00000458785
  MOD_RES (1)..(1): Any amino acid
XQTQQEVKLRMTGMALRVVRTDGILALYSGLSASLCRQMTYSLTRFAIYETVRDRVAKGSQGPLPFHEKVLLGSVSGLAGGFVGTPADLVNVRMQNDVKLPQGQRRKERSSGP

SEQ ID NO: 80936 - protein, 39 aa, Homo sapiens
  Payload ID: 16132
  Gene Symbol: SLC25A10
  Gene Name: solute carrier family 25 (mitochondrial carrier
  dicarboxylate transporter), member 10
  ENSP ID: ENSP00000460597
MAAEARVSRWYFGGLASCGAACCTHPLDLLKGQPRGVVF

SEQ ID NO: 80937 - protein, 301 aa, Homo sapiens
  Payload ID: 16133
  Gene Symbol: SLC25A15
  Gene Name: solute carrier family 25 (mitochondrial carrier
  ornithine transporter) member 15
  Uniprot ID: Q9Y619
  ENSP ID: ENSP00000342267
MKSNPAIQAAIDLTAGAAGGTACVLTGQPFDTMKVKMQTFPDLYRGLTDCCLKTYSQVGFRGFYKGTSPALIANIAENSVLFMCYGFCQQVVRKVAGLDKQAKLSDLQNAAAGSFASAFAALVLCPTELVKCRLQTMYEMETSGKIAKSQNTVWSVIKSILRKDGPLGFYHGLSSTLLREVPGYFFFFGGYELSRSFFASGRSKDELGPVPLMLSGGVGGICLWLAVYPVDCIKSRIQVLSMSGKQAGFIRTFINVVKNEGITALYSGLKPTMIRAFPANGALFLAYEYSRKLMMNQLEAY

SEQ ID NO: 80938 - protein, 133 aa, Homo sapiens
  Payload ID: 16133
  Gene Symbol: SLC25A15
  Gene Name: solute carrier family 25 (mitochondrial carrier
  ornithine transporter) member 15
  ENSP ID: ENSP00000415826
MKSNPAIQAAIDLTAGAAGGTACVLTGQPFDTMKVKMQTFPDLYRGLTDCCLKTYSQVGFRGFYKGTSPALIANIAENSVLFMCYGFCQQVVRKVAGLDKQAKLSTVWSVIKSILRKDGPLGFYHGLSSTLLR

SEQ ID NO: 80939 - protein, 57 aa, Homo sapiens
  Payload ID: 16133
  Gene Symbol: SLC25A15
  Gene Name: solute carrier family 25 (mitochondrial carrier
  ornithine transporter) member 15
  ENSP ID: ENSP00000431429
MKSNPAIQAAIDLTAGAAGGTACVLTGQPFDTMKVKMQTFPDLYRGLTDCCLKTYSQ

SEQ ID NO: 80940 - protein, 301 aa, Homo sapiens
  Payload ID: 16134
  Gene Symbol: SLC25A2
  Gene Name: solute carrier family 25 (mitochondrial carrier
  ornithine transporter) member 2
  Uniprot ID: Q9BXI2
  ENSP ID: ENSP00000239451
MKSGPGIQAAIDLTAGAAGGTACVLTGQPFDTIKVKMQTFPDLYKGLTDCFLKTYAQVGLRGFYKGTGPALMAYVAENSVLFMCYGFCQQFVRKVAGMDKQAKLSDLQTAAAGSFASAFAALALCPTELVKCRLQTMYEMEMSGKIAKSHNTIWSVVKGILKKDGPLGFYHGLSSTLLQEVPGYFFFFGGYELSRSFFASGRSKDELGPVHLMLSGGVAGICLWLVVFPVDCIKSRIQVLSMYGKQAGFIGTLLSVVRNEGIVALYSGLKATMIRAIPANGALFVAYEYSRKMMMKQLEAY

SEQ ID NO: 80941 - protein, 314 aa, Homo sapiens
  Payload ID: 16135
  Gene Symbol: SLC25A11
  Gene Name: solute carrier family 25 (mitochondrial carrier
  oxoglutarate carrier), member 11
  Uniprot ID: Q02978
  ENSP ID: ENSP00000225665
MAATASAGAGGIDGKPRTSPKSVKFLFGGLAGMGATVFVQPLDLVKNRMQLSGEGAKTREYKTSFHALTSILKAEGLRGIYTGLSAGLLRQATYTTTRLGIYTVLFERLTGADGTPPGFLLKAVIGMTAGATGAFVGTPAEVALIRMTADGRLPADQRRGYKNVFNALIRITREEGVLTLWRGCIPTMARAVVVNAAQLASYSQSKQFLLDSGYFSDNILCHFCASMISGLVTTAASMPVDIAKTRIQNMRMIDGKPEYKNGLDVLFKVVRYEGFFSLWKGFTPYYARLGPHTVLTFIFLEQMNKAYKRLFLSG

SEQ ID NO: 80942 - protein, 263 aa, Homo sapiens
  Payload ID: 16135
  Gene Symbol: SLC25A11
  Gene Name: solute carrier family 25 (mitochondrial carrier
  oxoglutarate carrier), member 11
  Uniprot ID: Q02978
  ENSP ID: ENSP00000440804
MAATASAGAGGIDGKPRTSPKSVKFLFGGLAGLSAGLLRQATYTTTRLGIYTVLFERLTGADGTPPGFLLKAVIGMTAGATGAFVGTPAEVALIRMTADGRLPADQRRGYKNVFNALIRITREEGVLTLWRGCIPTMARAVVVNAAQLASYSQSKQFLLDSGYFSDNILCHFCASMISGLVTTAASMPVDIAKTRIQNMRMIDGKPEYKNGLDVLFKVVRYEGFFSLWKGFTPYYARLGPHTVLTFIFLEQMNKAYKRLFLSG

SEQ ID NO: 80943 - protein, 296 aa, Homo sapiens
  Payload ID: 16135
  Gene Symbol: SLC25A11
  Gene Name: solute carrier family 25 (mitochondrial carrier
  oxoglutarate carrier), member 11
  ENSP ID: ENSP00000458993
MAATASAGAGGIDGKPRTSPKMGATVFVQPLDLVKNRMQLSGEGAKTREYKTSFHALTSILKAEGLRGIYTGLSAGLLRQATYTTTRLGIYTVLFERLTGADGTPPGFLLKAVIGMTAGATGAFVGTPAEVALIRMTADGRLPADQRRGYKNVFNALIRITREEGVLTLWRGCIPTMARAVVVNAAQLASYSQSKQFLLDSGYFSDNILCHFCASMISGLVTTAASMPVDIAKTRIQNMRMIDGKPEYKNGLDVLFKVVRYEGFFSLWKGFTPYYARLGPHTVLTFIFLEQMNKAY

SEQ ID NO: 80944 - protein, 63 aa, Homo sapiens
  Payload ID: 16136
  Gene Symbol: SLC25A17
  Gene Name: solute carrier family 25 (mitochondrial carrier
  peroxisomal membrane protein, 34kDa), member 17
  ENSP ID: ENSP00000263255
MASVLSYESLVHAVAGAVGSVTAMTVFFPLDTARLRLQVDEKRKSKTTHMVLLEIIKEEGLSG

SEQ ID NO: 80945 - protein, 225 aa, Homo sapiens
  Payload ID: 16136
  Gene Symbol: SLC25A17
  Gene Name: solute carrier family 25 (mitochondrial carrier
  peroxisomal membrane protein, 34kDa), member 17
  ENSP ID: ENSP00000385303
MEYWYVALKQQSLKADILPSLFLSIFLVKGVVNVLLTTPLWVVNTRLKLQGAKFRNEDIVPTNYKGIIDAFHQIIRDEGISALWNGTFPSLLLVFNPAIQFMFYEGLKRQLLKKRMKLSSLDVFIIGAVAKAIATTVTYPLQTVQSILRFGRHRLNPENRTLGSLRNILYLLHQRVRRFGIMGLYKGLEAKLLQTVLTAALMFLVYEKLTAATFTVMGLKRAHQH

SEQ ID NO: 80946 - protein, 45 aa, Homo sapiens
  Payload ID: 16136
  Gene Symbol: SLC25A17
  Gene Name: solute carrier family 25 (mitochondrial carrier
  peroxisomal membrane protein, 34kDa), member 17
  ENSP ID: ENSP00000387478
MASVLSYESLVHAVAGAVGSVTAMTVFFPLDTARLRLQDLFKLKL

SEQ ID NO: 80947 - protein, 148 aa, Homo sapiens
  Payload ID: 16136
  Gene Symbol: SLC25A17
  Gene Name: solute carrier family 25 (mitochondrial carrier
  peroxisomal membrane protein, 34kDa), member 17
  ENSP ID: ENSP00000388966
MASVLSYESLVHAVAGAVGSVTAMTVFFPLDTARLRLQVDEKRKSKTTHMVLLEIIKEEGLLAPYRGWFPVISSLCCSNFVYFYTFNSLKALWVKGQHSTTGKDLVVGFVADGGLSVLPRLVSNPWPQEILLPRPSKVLGLQEWLMCC

SEQ ID NO: 80948 - protein, 43 aa, Homo sapiens
  Payload ID: 16136
  Gene Symbol: SLC25A17
  Gene Name: solute carrier family 25 (mitochondrial carrier
  peroxisomal membrane protein, 34kDa), member 17
  ENSP ID: ENSP00000390502
MASVLSYESLVHAVAGAVPGTISRVVSSDFQSLLLQFCLFLHF

SEQ ID NO: 80949 - protein, 307 aa, Homo sapiens
  Payload ID: 16136
  Gene Symbol: SLC25A17
  Gene Name: solute carrier family 25 (mitochondrial carrier
  peroxisomal membrane protein, 34kDa), member 17
  Uniprot ID: O43808
  ENSP ID: ENSP00000390722
MASVLSYESLVHAVAGAVGSVTAMTVFFPLDTARLRLQVDEKRKSKTTHMVLLEIIKEEGLLAPYRGWFPVISSLCCSNFVYFYTFNSLKALWVKGQHSTTGKDLVVGFVAGVVNVLLTTPLWVVNTRLKLQGAKFRNEDIVPTNYKGIIDAFHQIIRDEGISALWNGTFPSLLLVFNPAIQFMFYEGLKRQLLKKRMKLSSLDVFIIGAVAKAIATTVTYPLQTVQSILRFGRHRLNPENRTLGSLRNILYLLHQRVRRFGIMGLYKGLEAKLLQTVLTAALMFLVYEKLTAATFTVMGLKRAHQH

SEQ ID NO: 80950 - protein, 239 aa, Homo sapiens
  Payload ID: 16136
  Gene Symbol: SLC25A17
  Gene Name: solute carrier family 25 (mitochondrial carrier
  peroxisomal membrane protein, 34kDa), member 17
  ENSP ID: ENSP00000394539
MASVLSYESLVHAVAGAVGSVTAMTVFFPLDTARLRLQVDEKRKSKTTHMVLLEIIKEEGLLAPYRGWFPVISSLCCSNFVYFYTFNSLKALWVKGQHSTTGKDLVVGFVAGVVNVLLTTPLWVVNTRLKLQGAKFRNEDIVPTNYKGIIDAFHQIIRDEGISALWNGTFPSLLLVFNPAIQFMFYEGLKRQLLKKRMKLSSLDVFIIGAVAKAIATTVTYPLQTVQSILRLFIHSNIY

SEQ ID NO: 80951 - protein, 48 aa, Homo sapiens
  Payload ID: 16136
  Gene Symbol: SLC25A17
  Gene Name: solute carrier family 25 (mitochondrial carrier
  peroxisomal membrane protein, 34kDa), member 17
  ENSP ID: ENSP00000400053
MASVLSYESLVHAVAGAVGSVTAMTVFFPLDTARLRLQAWHHIEGGFQ

SEQ ID NO: 80952 - protein, 92 aa, Homo sapiens
  Payload ID: 16136
  Gene Symbol: SLC25A17
  Gene Name: solute carrier family 25 (mitochondrial carrier
  peroxisomal membrane protein, 34kDa), member 17
  ENSP ID: ENSP00000404200
MGSVTAMTVFFPLDTARLRLQVDEKRKSKTTHMVLLEIIKEEGLLAPYRGWFPVISSLCCSNFVYFYTFNSLKALWVKGQHSTTGKDLVVGF

SEQ ID NO: 80953 - protein, 49 aa, Homo sapiens
  Payload ID: 16136
  Gene Symbol: SLC25A17
  Gene Name: solute carrier family 25 (mitochondrial carrier
  peroxisomal membrane protein, 34kDa), member 17
  ENSP ID: ENSP00000407096
MASVLSYESLVHAVAGAVLDFDFRPGTISRVVSSDFQSLLLQFCLFLHF

SEQ ID NO: 80954 - protein, 45 aa, Homo sapiens; identical to SEQ ID NO: 80946
  Payload ID: 16136
  Gene Symbol: SLC25A17
  Gene Name: solute carrier family 25 (mitochondrial carrier
  peroxisomal membrane protein, 34kDa), member 17
  ENSP ID: ENSP00000409781

SEQ ID NO: 80955 - protein, 45 aa, Homo sapiens; identical to SEQ ID NO: 80946
  Payload ID: 16136
  Gene Symbol: SLC25A17
  Gene Name: solute carrier family 25 (mitochondrial carrier
  peroxisomal membrane protein, 34kDa), member 17
  ENSP ID: ENSP00000410565

SEQ ID NO: 80956 - protein, 45 aa, Homo sapiens; identical to SEQ ID NO: 80946
  Payload ID: 16136
  Gene Symbol: SLC25A17
  Gene Name: solute carrier family 25 (mitochondrial carrier
  peroxisomal membrane protein, 34kDa), member 17
  ENSP ID: ENSP00000414908

SEQ ID NO: 80957 - protein, 56 aa, Homo sapiens
  Payload ID: 16136
  Gene Symbol: SLC25A17
  Gene Name: solute carrier family 25 (mitochondrial carrier
  peroxisomal membrane protein, 34kDa), member 17
  ENSP ID: ENSP00000416618
MASVLSYESLVHAVAGAVLDFDFRLMRKENPKLHTWCSWRSLKKKDSWHHIEGGFQ

SEQ ID NO: 80958 - protein, 234 aa, Homo sapiens
  Payload ID: 16136
  Gene Symbol: SLC25A17
  Gene Name: solute carrier family 25 (mitochondrial carrier
  peroxisomal membrane protein, 34kDa), member 17
  ENSP ID: ENSP00000438355
MASVLSYESLVHAVAGAVGSVTAMTVFFPLDTARLRLQGVVNVLLTTPLWVVNTRLKLQGAKFRNEDIVPTNYKGIIDAFHQIIRDEGISALWNGTFPSLLLVFNPAIQFMFYEGLKRQLLKKRMKLSSLDVFIIGAVAKAIATTVTYPLQTVQSILRFGRHRLNPENRTLGSLRNILYLLHQRVRRFGIMGLYKGLEAKLLQTVLTAALMFLVYEKLTAATFTVMGLKRAHQH

SEQ ID NO: 80959 - protein, 482 aa, Homo sapiens
  Payload ID: 16137
  Gene Symbol: SLC25A23
  Gene Name: solute carrier family 25 (mitochondrial carrier
  phosphate carrier), member 23
  Uniprot ID: Q9BV35
  ENSP ID: ENSP00000264088
MRGSPGDAERRQRWGRLFEELDSNKDGRVDVHELRQGLARLGGGNPDPGAQQGISSEGDADPDGGLDLEEFSRYLQEREQRLLLMFHSLDRNQDGHIDVSEIQQSFRALGISISLEQAEKILHSMDRDGTMTIDWQEWRDHFLLHSLENVEDVLYFWKHSTLSSAGFSAWIKDSTAEQNRSKTTVLARRSGSHLKSQHFGRPKWADHEVLDIGECLTVPDEFSKQEKLTGMWWKQLVAGAVAGAVSRTGTAPLDRLKVFMQVHASKTNRLNILGGLRSMVLEGGIRSLWRGNGINVLKIAPESAIKFMAYEQIKRAILGQQETLHVQERFVAGSLAGATAQTIIYPMEVLKTRLTLRRTGQYKGLLDCARRILEREGPRAFYRGYLPNVLGIIPYAGIDLAVYETLKNWWLQQYSHDSADPGILVLLACGTISSTCGQIASYPLALVRTRMQAQGWSTVARFQITATSAFQVQAILLPQPPE

SEQ ID NO: 80960 - protein, 468 aa, Homo sapiens
  Payload ID: 16137
  Gene Symbol: SLC25A23
  Gene Name: solute carrier family 25 (mitochondrial carrier
  phosphate carrier), member 23
  Uniprot ID: Q9BV35
  ENSP ID: ENSP00000301454
MRGSPGDAERRQRWGRLFEELDSNKDGRVDVHELRQGLARLGGGNPDPGAQQGISSEGDADPDGGLDLEEFSRYLQEREQRLLLMFHSLDRNQDGHIDVSEIQQSFRALGISISLEQAEKILHSMDRDGTMTIDWQEWRDHFLLHSLENVEDVLYFWKHSTVLDIGECLTVPDEFSKQEKLTGMWWKQLVAGAVAGAVSRTGTAPLDRLKVFMQVHASKTNRLNILGGLRSMVLEGGIRSLWRGNGINVLKIAPESAIKFMAYEQIKRAILGQQETLHVQERFVAGSLAGATAQTIIYPMEVLKTRLTLRRTGQYKGLLDCARRILEREGPRAFYRGYLPNVLGIIPYAGIDLAVYETLKNWWLQQYSHDSADPGILVLLACGTISSTCGQIASYPLALVRTRMQAQASIEGGPQLSMLGLLRHILSQEGMRGLYRGIAPNFMKVIPAVSISYVVYENMKQALGVTSR

SEQ ID NO: 80961 - protein, 438 aa, Homo sapiens
  Payload ID: 16137
  Gene Symbol: SLC25A23
  Gene Name: solute carrier family 25 (mitochondrial carrier
  phosphate carrier), member 23
  Uniprot ID: Q9BV35
  ENSP ID: ENSP00000334537
MRGSPGDAERRQRWGRLFEELDSNKDGRVDVHELRQGLARLGGGNPDPGAQQGISSEGDADPDGGLDLEEFSRYLQEREQRLLLMFHSLDRNQDGHIDVSEIQQSFRALGISISLEQAEKILHSMDRDGTMTIDWQEWRDHFLLHSLENVEDVLYFWKHSTVLDIGECLTVPDEFSKQEKLTGMWWKQLVAGAVAGAVSRTGTAPLDRLKVFMQVHASKTNRLNILGGLRSMVLEGGIRSLWRGNGINVLKIAPESAIKFMAYEQIKRAILGQQETLHVQERFVAGSLAGATAQTIIYPMEVLKTRLTLRRTGQYKGLLDCARRILEREGPRAFYRGYLPNVLGIIPYAGIDLAVYETLKNWWLQQYSHDSADPGILVLLACGTISSTCGQIASYPLALVRTRMQAQDVSVYKTDTVPTLIELTGRRGRKMLNKSFWN

SEQ ID NO: 80962 - protein, 236 aa, Homo sapiens
  Payload ID: 16137
  Gene Symbol: SLC25A23
  Gene Name: solute carrier family 25 (mitochondrial carrier
  phosphate carrier), member 23
  ENSP ID: ENSP00000470589
  MOD_RES (1)..(1): Any amino acid
XQEKLTGMWWKQLVAGAVAGAVSRTGTAPLDRLKVFMQVHASKTNRLNILGGLRSMVLEGGIRSLWRGNGINVLKIAPESAIKFMAYEQIKRAILGQQETLHVQERFVAGSLAGATAQTIIYPMETLKNWWLQQYSHDSADPGILVLLACGTISSTCGQIASYPLALVRTRMQAQASIEGGPQLSMLGLLRHILSQEGMRGLYRGIAPNFMKVIPAVSISYVVYENMKQALGVTSR

SEQ ID NO: 80963 - protein, 99 aa, Homo sapiens
  Payload ID: 16137
  Gene Symbol: SLC25A23
  Gene Name: solute carrier family 25 (mitochondrial carrier
  phosphate carrier), member 23
  ENSP ID: ENSP00000470688
NVLKIAPESAIKFMAYEQTLKNWWLQQYSHDSADPGILVLLACGTISSTCGQIASYPLALVRTRMQAQGSSDSPASASRVAGITAGGHAMSSLMERTMW

SEQ ID NO: 80964 - protein, 278 aa, Homo sapiens
  Payload ID: 16137
  Gene Symbol: SLC25A23
  Gene Name: solute carrier family 25 (mitochondrial carrier
  phosphate carrier), member 23
  ENSP ID: ENSP00000470757
  MOD_RES (1)..(1): Any amino acid
XRSLWRGNGINVLKIAPESAIKFMAYEQIKRAILGQQETLHVQERFVAGSLAGATAQTIIYPMEVLKTRLTLRRTGQYKGLLDCARRILEREGPRAFYRGYLPNVLGIIPYAGIDLAVYETLKNWWLQQYSHDSADPGILVLLACGTISSTCGQIASYPLALVRTRMQAQASIEGGPQLSMLGLLRHILSQEGMRGLYRGIAPNFMKVIPAVSISYVVYENMKQALGVTSRSTDSLYLNTQTLPPSGTRSSVLVKRWILDPQPQIPMPRALDLQAQLL

SEQ ID NO: 80965 - protein, 216 aa, Homo sapiens
  Payload ID: 16137
  Gene Symbol: SLC25A23
  Gene Name: solute carrier family 25 (mitochondrial carrier
  phosphate carrier), member 23
  ENSP ID: ENSP00000472153
  MOD_RES (1)..(1): Any amino acid
XQEKLTGMWWKQLVAGAVAGAVSRTGTAPLDRLKVFMQVHASKTNRLNILGGLRSMVLEGGIRSLWRGNGINVLKIAPESAIKFMAYEQTLKNWWLQQYSHDSADPGILVLLACGTISSTCGQIASYPLALVRTRMQAQGFHHVAQAHLELVGSRNSPAFSLPTCWDYSRWSCHEQPYGEDHVVRNSANSHVTELGRGSCCPGQHLTAILSVEFPG

SEQ ID NO: 80966 - protein, 77 aa, Homo sapiens
  Payload ID: 16137
  Gene Symbol: SLC25A23
  Gene Name: solute carrier family 25 (mitochondrial carrier
  phosphate carrier), member 23
  ENSP ID: ENSP00000472177
MFHSLDRNQDGHIDVSEIQQSFRALGISISLEQAEKILHSMDRDGTMTIDWQEWRDHFLLHSLENVEDVLYFWKHST

SEQ ID NO: 80967 - protein, 90 aa, Homo sapiens
  Payload ID: 16137
  Gene Symbol: SLC25A23
  Gene Name: solute carrier family 25 (mitochondrial carrier
  phosphate carrier), member 23
  ENSP ID: ENSP00000472517
  MOD_RES (1)..(1): Any amino acid
XAFYRGYLPNVLGIIPYAGIDLAVYETLKNWWLQQYSHDSADPGILVLLACGTISSTCGQIASYPLALVRTRMQAQDAVSLCFPGWSAMT

SEQ ID NO: 80968 - protein, 131 aa, Homo sapiens
  Payload ID: 16137
  Gene Symbol: SLC25A23
  Gene Name: solute carrier family 25 (mitochondrial carrier
  phosphate carrier), member 23
  ENSP ID: ENSP00000472590
  MOD_RES (1)..(1): Any amino acid
XAQTIIYPMEVLKTRLTLRRTGQYKGLLDCARRILEREGPRAFYRGYLPNVLGIIPYAGIDLAVYETLKNWWLQQYSHDSADPGILVLLACGTISSTCGQIASYPLALVRTRMQAQAGGHAMSSLMERTMW

SEQ ID NO: 80969 - protein, 110 aa, Homo sapiens
  Payload ID: 16138
  Gene Symbol: SLC25A24
  Gene Name: solute carrier family 25 (mitochondrial carrier
  phosphate carrier), member 24
  ENSP ID: ENSP00000264128
MLRWLRDFVLPTAACQDAEQPTRYETLFQALDRNGDGVVDIGELQEGLRNLGIPLGQDAEEKIFTTGDVNKDGKLDFEEFMKYLKDHEKKMKLAFKSLDKNNDALMLMGQ

SEQ ID NO: 80970 - protein, 458 aa, Homo sapiens
  Payload ID: 16138
  Gene Symbol: SLC25A24
  Gene Name: solute carrier family 25 (mitochondrial carrier
  phosphate carrier), member 24
  Uniprot ID: Q6NUK1
  ENSP ID: ENSP00000359058
MDSLYGDLFWYLDYNKDGTLDIFELQEGLEDVGAIQSLEEAKKIFTTGDVNKDGKLDFEEFMKYLKDHEKKMKLAFKSLDKNNDGKIEASEIVQSLQTLGLTISEQQAELILQSIDVDGTMTVDWNEWRDYFLFNPVTDIEEIIRFWKHSTGIDIGDSLTIPDEFTEDEKKSGQWWRQLLAGGIAGAVSRTSTAPLDRLKIMMQVHGSKSDKMNIFGGFRQMVKEGGIRSLWRGNGTNVIKIAPETAVKFWAYEQYKKLLTEEGQKIGTFERFISGSMAGATAQTFIYPMEVMKTRLAVGKTGQYSGIYDCAKKILKHEGLGAFYKGYVPNLLGIIPYAGIDLAVYELLKSYWLDNFAKDSVNPGVMVLLGCGALSSTCGQLASYPLALVRTRMQAQAMLEGSPQLNMVGLFRRIISKEGIPGLYRGITPNFMKVLPAVGISYVVYENMKQTLGVTQK

SEQ ID NO: 80971 - protein, 69 aa, Homo sapiens
  Payload ID: 16138
  Gene Symbol: SLC25A24
  Gene Name: solute carrier family 25 (mitochondrial carrier
  phosphate carrier), member 24
  ENSP ID: ENSP00000454393
MLRWLRDFVLPTAACQDAEQPTRYETLFQALDRNGDGVVDIGELQEGLRNLGIPLGQDAEEVGRRRGAA

SEQ ID NO: 80972 - protein, 477 aa, Homo sapiens
  Payload ID: 16138
  Gene Symbol: SLC25A24
  Gene Name: solute carrier family 25 (mitochondrial carrier
  phosphate carrier), member 24
  Uniprot ID: Q6NUK1
  ENSP ID: ENSP00000457733
MLRWLRDFVLPTAACQDAEQPTRYETLFQALDRNGDGVVDIGELQEGLRNLGIPLGQDAEEKIFTTGDVNKDGKLDFEEFMKYLKDHEKKMKLAFKSLDKNNDGKIEASEIVQSLQTLGLTISEQQAELILQSIDVDGTMTVDWNEWRDYFLFNPVTDIEEIIRFWKHSTGIDIGDSLTIPDEFTEDEKKSGQWWRQLLAGGIAGAVSRTSTAPLDRLKIMMQVHGSKSDKMNIFGGFRQMVKEGGIRSLWRGNGTNVIKIAPETAVKFWAYEQYKKLLTEEGQKIGTFERFISGSMAGATAQTFIYPMEVMKTRLAVGKTGQYSGIYDCAKKILKHEGLGAFYKGYVPNLLGIIPYAGIDLAVYELLKSYWLDNFAKDSVNPGVMVLLGCGALSSTCGQLASYPLALVRTRMQAQAMLEGSPQLNMVGLFRRIISKEGIPGLYRGITPNFMKVLPAVGISYVVYENMKQTLGVTQK

SEQ ID NO: 80973 - protein, 469 aa, Homo sapiens
  Payload ID: 16139
  Gene Symbol: SLC25A25
  Gene Name: solute carrier family 25 (mitochondrial carrier
  phosphate carrier), member 25
  Uniprot ID: Q6KCM7
  ENSP ID: ENSP00000362155
MLCLCLYVPVIGEAQTEFQYFESKGLPAELKSIFKLSVFIPSQEFSTYRQWKQKIVQAGDKDLDGQLDFEEFVHYLQDHEKKLRLVFKSLDKKNDGRIDAQEIMQSLRDLGVKISEQQAEKILKSMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 80974 - protein, 501 aa, Homo sapiens
  Payload ID: 16139
  Gene Symbol: SLC25A25
  Gene Name: solute carrier family 25 (mitochondrial carrier
  phosphate carrier), member 25
  Uniprot ID: Q6KCM7
  ENSP ID: ENSP00000362157
MLQMLWHFLASFFPRAGCHGSREGDDREVRGTPAPAWRDQMASFLGKQDGRAEATEKRPTILLVVGPAEQFPKKIVQAGDKDLDGQLDFEEFVHYLQDHEKKLRLVFKSLDKKNDGRIDAQEIMQSLRDLGVKISEQQAEKILKRIRTGHFWGPVTYMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 80975 - protein, 503 aa, Homo sapiens
  Payload ID: 16139
  Gene Symbol: SLC25A25
  Gene Name: solute carrier family 25 (mitochondrial carrier
  phosphate carrier), member 25
  Uniprot ID: Q6KCM7
  ENSP ID: ENSP00000362159
MVSSVLCRCVASPPPDAAATAASSSASSPASVGDPCGGAICGGPDHRLRLWRLFQTLDVNRDGGLCVNDLAVGLRRLGLHRTEGELQKIVQAGDKDLDGQLDFEEFVHYLQDHEKKLRLVFKSLDKKNDGRIDAQEIMQSLRDLGVKISEQQAEKILKSMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 80976 - protein, 515 aa, Homo sapiens
  Payload ID: 16139
  Gene Symbol: SLC25A25
  Gene Name: solute carrier family 25 (mitochondrial carrier
  phosphate carrier), member 25
  Uniprot ID: Q6KCM7
  ENSP ID: ENSP00000362160
MVSSVLCRCVASPPPDAAATAASSSASSPASVGDPCGGAICGGPDHRLRLWRLFQTLDVNRDGGLCVNDLAVGLRRLGLHRTEGELQKIVQAGDKDLDGQLDFEEFVHYLQDHEKKLRLVFKSLDKKNDGRIDAQEIMQSLRDLGVKISEQQAEKILKRIRTGHFWGPVTYMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 80977 - protein, 489 aa, Homo sapiens
  Payload ID: 16139
  Gene Symbol: SLC25A25
  Gene Name: solute carrier family 25 (mitochondrial carrier
  phosphate carrier), member 25
  Uniprot ID: Q6KCM7
  ENSP ID: ENSP00000410053
MLQMLWHFLASFFPRAGCHGSREGDDREVRGTPAPAWRDQMASFLGKQDGRAEATEKRPTILLVVGPAEQFPKKIVQAGDKDLDGQLDFEEFVHYLQDHEKKLRLVFKSLDKKNDGRIDAQEIMQSLRDLGVKISEQQAEKILKSMDKNGTMTIDWNEWRDYHLLHPVENIPEIILYWKHSTIFDVGENLTVPDEFTVEERQTGMWWRHLVAGGGAGAVSRTCTAPLDRLKVLMQVHASRSNNMGIVGGFTQMIREGGARSLWRGNGINVLKIAPESAIKFMAYEQIKRLVGSDQETLRIHERLVAGSLAGAIAQSSIYPMEVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQASIEGAPEVTMSSLFKHILRTEGAFGLYRGLAPNFMKVIPAVSISYVVYENLKITLGVQSR

SEQ ID NO: 80978 - protein, 165 aa, Homo sapiens
  Payload ID: 16139
  Gene Symbol: SLC25A25
  Gene Name: solute carrier family 25 (mitochondrial carrier
  phosphate carrier), member 25
  ENSP ID: ENSP00000418600
  MOD_RES (1)..(1): Any amino acid
XTVEERQTGMWWRHLVAGGGAGAVSRTCTAPLDRLKVLMQVLKTRMALRKTGQYSGMLDCARRILAREGVAAFYKGYVPNMLGIIPYAGIDLAVYETLKNAWLQHYAVNSADPGVFVLLACGTMSSTCGQLASYPLALVRTRMQAQGKAGPGQSPGRSGGADRSI

SEQ ID NO: 80979 - protein, 75 aa, Homo sapiens
  Payload ID: 16139
  Gene Symbol: SLC25A25
  Gene Name: solute carrier family 25 (mitochondrial carrier
  phosphate carrier), member 25
  ENSP ID: ENSP00000419685
MLCLCLYVPVIGEAQTEFQYFESKGLPAELKSIFKLSVFIPSQEFSTYRQWKQCPLCTKGDLQIQGRRQKEAQAL

SEQ ID NO: 80980 - protein, 361 aa, Homo sapiens
  Payload ID: 16140
  Gene Symbol: SLC25A3
  Gene Name: solute carrier family 25 (mitochondrial carrier
  phosphate carrier), member 3
  Uniprot ID: Q00325
  ENSP ID: ENSP00000188376
MFSSVAHLARANPFNTPHLQLVHDGLGDLRSSSPGPTGQPRRPRNLAAAAVEEYSCEFGSAKYYALCGFGGVLSCGLTHTAVVPLDLVKCRMQVDPQKYKGIFNGFSVTLKEDGVRGLAKGWAPTFLGYSMQGLCKFGFYEVFKVLYSNMLGEENTYLWRTSLYLAASASAEFFADIALAPMEAAKVRIQTQPGYANTLRDAAPKMYKEEGLKAFYKGVAPLWMRQIPYTMMKFACFERTVEALYKFVVPKPRSECSKPEQLVVTFVAGYIAGVFCAIVSHPADSVVSVLNKEKGSSASLVLKRLGFKGVWKGLFARIIMIGTLTALQWFIYDSVKVYFRLPRPPPPEMPESLKKKLGLTQ

SEQ ID NO: 80981 - protein, 362 aa, Homo sapiens
  Payload ID: 16140
  Gene Symbol: SLC25A3
  Gene Name: solute carrier family 25 (mitochondrial carrier
  phosphate carrier), member 3
  Uniprot ID: Q00325
  ENSP ID: ENSP00000228318
MFSSVAHLARANPFNTPHLQLVHDGLGDLRSSSPGPTGQPRRPRNLAAAAVEEQYSCDYGSGRFFILCGLGGIISCGTTHTALVPLDLVKCRMQVDPQKYKGIFNGFSVTLKEDGVRGLAKGWAPTFLGYSMQGLCKFGFYEVFKVLYSNMLGEENTYLWRTSLYLAASASAEFFADIALAPMEAAKVRIQTQPGYANTLRDAAPKMYKEEGLKAFYKGVAPLWMRQIPYTMMKFACFERTVEALYKFVVPKPRSECSKPEQLVVTFVAGYIAGVFCAIVSHPADSVVSVLNKEKGSSASLVLKRLGFKGVWKGLFARIIMIGTLTALQWFIYDSVKVYFRLPRPPPPEMPESLKKKLGLTQ

SEQ ID NO: 80982 - protein, 361 aa, Homo sapiens; identical to SEQ ID NO: 80980
  Payload ID: 16140
  Gene Symbol: SLC25A3
  Gene Name: solute carrier family 25 (mitochondrial carrier
  phosphate carrier), member 3
  Uniprot ID: Q00325
  ENSP ID: ENSP00000383898

SEQ ID NO: 80983 - protein, 362 aa, Homo sapiens; identical to SEQ ID NO: 80981
  Payload ID: 16140
  Gene Symbol: SLC25A3
  Gene Name: solute carrier family 25 (mitochondrial carrier
  phosphate carrier), member 3
  Uniprot ID: Q00325
  ENSP ID: ENSP00000447310

SEQ ID NO: 80984 - protein, 153 aa, Homo sapiens
  Payload ID: 16140
  Gene Symbol: SLC25A3
  Gene Name: solute carrier family 25 (mitochondrial carrier
  phosphate carrier), member 3
  ENSP ID: ENSP00000447339
MFSSVAHLARANPFNTPHLQLVHDGLGDLRSSSPGPTGQPRRPRNLAAAAVEEQYSCDYGSGRFFILCGLGGIISCGTTHTALVPLDLVKCRMQVDPQKYKGIFNGFSVTLKEDGVRGLAKGWAPTFLGYSMQGLCKFGFYEVFKVLYSNMLG

SEQ ID NO: 80985 - protein, 361 aa, Homo sapiens; identical to SEQ ID NO: 80980
  Payload ID: 16140
  Gene Symbol: SLC25A3
  Gene Name: solute carrier family 25 (mitochondrial carrier
  phosphate carrier), member 3
  Uniprot ID: Q00325
  ENSP ID: ENSP00000447740

SEQ ID NO: 80986 - protein, 361 aa, Homo sapiens; identical to SEQ ID NO: 80980
  Payload ID: 16140
  Gene Symbol: SLC25A3
  Gene Name: solute carrier family 25 (mitochondrial carrier
  phosphate carrier), member 3
  Uniprot ID: Q00325
  ENSP ID: ENSP00000448708

SEQ ID NO: 80987 - protein, 122 aa, Homo sapiens
  Payload ID: 16140
  Gene Symbol: SLC25A3
  Gene Name: solute carrier family 25 (mitochondrial carrier
  phosphate carrier), member 3
  ENSP ID: ENSP00000448969
MFSSVAHLARANPFNTPHLQLVHDGLGDLRSSSPGPTGQPRRPRNLAAAAVEGEIRPCPIQSCGLLVGRPAFEAWTRLGGQGRTSPARCTVGRRPVACPGVSAFSTIGGCQILGLPSRAWKR

SEQ ID NO: 80988 - protein, 104 aa, Homo sapiens
  Payload ID: 16140
  Gene Symbol: SLC25A3
  Gene Name: solute carrier family 25 (mitochondrial carrier
  phosphate carrier), member 3
  ENSP ID: ENSP00000449009
MFSSVAHLARANPFNTPHLQLVHDGLGDLRSSSPGPTGQPRRPRNLAAAAVEEQYSCDYGSGRFFILCGLGGIISCGTTHTALVPLDLVKCRMQVCFACWTRAY

SEQ ID NO: 80989 - protein, 324 aa, Homo sapiens
  Payload ID: 16140
  Gene Symbol: SLC25A3
  Gene Name: solute carrier family 25 (mitochondrial carrier
  phosphate carrier), member 3
  ENSP ID: ENSP00000449166
MFSSVAHLARANPFNTPHLQLVHDGLGDLRSSSPGPTGQPRRPRNLAAAAVEEYSCEFGSAKYYALCGFGGVLSCGLTHTAVVPLDLVKCRMQVDPQKYKGIFNGFSVTLKEDGVRGLAKGWAPTFLGYSMQGLCKFGFYEVFKVLYSNMLGEENTYLWRTSLYLAASASAEFFADIALAPMEAAKVRIQTQPGYANTLRDAAPKMYKEEGLKAFYKGVAPLWMRQIPYTMMKFACFERTVEALYKFVVPKPRSECSKPEQLVVTFVAGYIGVWKGLFARIIMIGTLTALQWFIYDSVKVYFRLPRPPPPEMPESLKKKLGLTQ

SEQ ID NO: 80990 - protein, 154 aa, Homo sapiens
  Payload ID: 16140
  Gene Symbol: SLC25A3
  Gene Name: solute carrier family 25 (mitochondrial carrier
  phosphate carrier), member 3
  ENSP ID: ENSP00000449479
MFSSVAHLARANPFNTPHLQLVHDGLGDLRSSSPGPTGQPRRPRNLAAAAVEEQYSCDYGSGRFFILCGLGGIISCGTTHTALVPLDLVKCRMQVDPQKYKGIFNGFSVTLKEDGVRGLAKGWAPTFLGYSMQGLCKFGFYEVFKVLYSNMLGE

SEQ ID NO: 80991 - protein, 156 aa, Homo sapiens
  Payload ID: 16140
  Gene Symbol: SLC25A3
  Gene Name: solute carrier family 25 (mitochondrial carrier
  phosphate carrier), member 3
  ENSP ID: ENSP00000449793
MFSSVAHLARANPFNTPHLQLVHDGLGDLRSSSPGPTGQPRRPRNLAAAAVEEYSCEFGSAKYYALCGFGGVLSCGLTHTAVVPLDLVKCRMQVDPQKYKGIFNGFSVTLKEDGVRGLAKGWAPTFLGYSMQGLCKFGFYEVFKVLYSNMLGEVCN

SEQ ID NO: 80992 - protein, 315 aa, Homo sapiens
  Payload ID: 16141
  Gene Symbol: SLC25A32
  Gene Name: solute carrier family 25 (mitochondrial folate carrier), member 32
  Uniprot ID: Q9H2D1
  ENSP ID: ENSP00000297578
MTGQGQSASGSSAWSTVFRHVRYENLIAGVSGGVLSNLALHPLDLVKIRFAVSDGLELRPKYNGILHCLTTIWKLDGLRGLYQGVTPNIWGAGLSWGLYFFFYNAIKSYKTEGRAERLEATEYLVSAAEAGAMTLCITNPLWVTKTRLMLQYDAVVNSPHRQYKGMFDTLVKIYKYEGVRGLYKGFVPGLFGTSHGALQFMAYELLKLKYNQHINRLPEAQLSTVEYISVAALSKIFAVAATYPYQVVRARLQDQHMFYSGVIDVITKTWRKEGVGGFYKGIAPNLIRVTPACCITFVVYENVSHFLLDLREKRK

SEQ ID NO: 80993 - protein, 123 aa, Homo sapiens
  Payload ID: 16141
  Gene Symbol: SLC25A32
  Gene Name: solute carrier family 25 (mitochondrial folate carrier), member 32
  ENSP ID: ENSP00000427737
MTGQGQSASGSSAWSTVFRHVRYENLIAGVSGGVLSNLALHPLDLVKIRFAVSDGLELRPKYNGILHCLTTIWKLDGLRGLYQGVTPNIWGAGLSWGLYFFLDLFLGCLEHRMVPFSLWHMNC

SEQ ID NO: 80994 - protein, 123 aa, Homo sapiens
  Payload ID: 16141
  Gene Symbol: SLC25A32
  Gene Name: solute carrier family 25 (mitochondrial folate carrier), member 32
  ENSP ID: ENSP00000430371
MTGQGQSASGSSAWSTVFRHVRYENLIAGVSGGVLSNLALHPLDLVKIRFAVSDGLELRPKYNGILHCLTTIWKLDGLRGLYQGVTPNIWGAGLSWGLYFFLSHDPLHYKPIMGNKNSPYVTV

SEQ ID NO: 80995 - protein, 149 aa, Homo sapiens
  Payload ID: 16141
  Gene Symbol: SLC25A32
  Gene Name: solute carrier family 25 (mitochondrial folate carrier), member 32
  ENSP ID: ENSP00000430989
MTGQGQSASGSSAWSTVFRHVRYENLIAGVSGGVLSNLALHPLDLVKIRFAVSDGLELRPKYNGILHCLTTIWKLDGLRGLYQGVTPNIWGAGLSWGLYFFFYNAIKSYKTEGRAERLEATEYLVSAAEAGICSWAVWNIAWCPSVYGI

SEQ ID NO: 80996 - protein, 364 aa, Homo sapiens
  Payload ID: 16142
  Gene Symbol: SLC25A28
  Gene Name: solute carrier family 25 (mitochondrial iron transporter), member 28
  Uniprot ID: Q96A46
  ENSP ID: ENSP00000359526
MELEGRGAGGVAGGPAAGPGRSPGESALLDGWLQRGVGRGAGGGEAGACRPPVRQDPDSGPDYEALPAGATVTTHMVAGAVAGILEHCVMYPIDCVKTRMQSLQPDPAARYRNVLEALWRIIRTEGLWRPMRGLNVTATGAGPAHALYFACYEKLKKTLSDVIHPGGNSHIANGAAGCVATLLHDAAMNPAEVVKQRMQMYNSPYHRVTDCVRAVWQNEGAGAFYRSYTTQLTMNVPFQAIHFMTYEFLQEHFNPQRRYNPSSHVLSGACAGAVAAAATTPLDVCKTLLNTQESLALNSHITGHITGMASAFRTVYQVGGVTAYFRGVQARVIYQIPSTAIAWSVYEFFKYLITKRQEEWRAGK

SEQ ID NO: 80997 - protein, 225 aa, Homo sapiens
  Payload ID: 16142
  Gene Symbol: SLC25A28
  Gene Name: solute carrier family 25 (mitochondrial iron transporter), member 28
  ENSP ID: ENSP00000399102
RGAAGWSHCHHAHGGRRRGRDPGALRDVPHRLRQGAAGCVATLLHDAAMNPAEVVKQRMQMYNSPYHRVTDCVRAVWQNEGAGAFYRSYTTQLTMNVPFQAIHFMTYEFLQEHFNPQRRYNPSSHVLSGACAGAVAAAATTPLDVCKTLLNTQESLALNSHITGHITGMASAFRTVYQVGGVTAYFRGVQARVIYQIPSTAIAWSVYEFFKYLITKRQEEWRAGK

SEQ ID NO: 80998 - protein, 155 aa, Homo sapiens
  Payload ID: 16143
  Gene Symbol: SLC25A37
  Gene Name: solute carrier family 25 (mitochondrial iron transporter), member 37
  Uniprot ID: Q9NYZ2
  ENSP ID: ENSP00000290075
MELRSGSVGSQAVARRMDGDSRDGGGGKDATGSEDYENLPTSASVSTHMTAGAMAGILEHSVMYPVDSVKTRMQSLSPDPKAQYTSIYGALKKIMRTEGFWRPLRGVNVMIMGAGPAHAMYFACYENMKRTLNDVFHHQGNSHLANGILKAFVWS

SEQ ID NO: 80999 - protein, 159 aa, Homo sapiens
  Payload ID: 16143
  Gene Symbol: SLC25A37
  Gene Name: solute carrier family 25 (mitochondrial iron transporter), member 37
  ENSP ID: ENSP00000402782
MELRSGSVGSQAVARRMDGDSRDGGGGKDATGSEDYENLPTSASVSTHMTAGAMAGILEHSVMYPVDSVKTRMQSLSPDPKAQYTSIYGALKKIMRTEGFWRPLRGVNVMIMGAGPAHAMYFACYENMKRTLNDVFHHQGNSHLANGSRNFLRTPDRRG

SEQ ID NO: 81000 - protein, 153 aa, Homo sapiens
  Payload ID: 16143
  Gene Symbol: SLC25A37
  Gene Name: solute carrier family 25 (mitochondrial iron transporter), member 37
  ENSP ID: ENSP00000428066
DSRDGGGGKDATGSEDYENLPTSASVSTHMTAGAMAGILEHSVMYPVDSVKTRMQSLSPDPKAQYTSIYGALKKIMRTEGFWRPLRGVNVMIMGAGPAHAMYFACYENMKRTLNDVFHHQGNSHLANGIAGSMATLLHDAVMNPAEVHPLHHL

SEQ ID NO: 81001 - protein, 338 aa, Homo sapiens
  Payload ID: 16143
  Gene Symbol: SLC25A37
  Gene Name: solute carrier family 25 (mitochondrial iron transporter), member 37
  Uniprot ID: Q9NYZ2
  ENSP ID: ENSP00000429200
MELRSGSVGSQAVARRMDGDSRDGGGGKDATGSEDYENLPTSASVSTHMTAGAMAGILEHSVMYPVDSVKTRMQSLSPDPKAQYTSIYGALKKIMRTEGFWRPLRGVNVMIMGAGPAHAMYFACYENMKRTLNDVFHHQGNSHLANGIAGSMATLLHDAVMNPAEVVKQRLQMYNSQHRSAISCIRTVWRTEGLGAFYRSYTTQLTMNIPFQSIHFITYEFLQEQVNPHRTYNPQSHIISGGLAGALAAAATTPLDVCKTLLNTQENVALSLANISGRLSGMANAFRTVYQLNGLAGYFKGIQARVIYQMPSTAISWSVYEFFKYFLTKRQLENRAPY

SEQ ID NO: 81002 - protein, 299 aa, Homo sapiens
  Payload ID: 16144
  Gene Symbol: SLC25A21
  Gene Name: solute carrier family 25 (mitochondrial oxoadipate carrier), member 21
  Uniprot ID: Q9BQT8
  ENSP ID: ENSP00000329452
MSAKPEVSLVREASRQIVAGGSAGLVEICLMHPLDVVKTRFQIQRCATDPNSYKSLVDSFRMIFQMEGLFGFYKGILPPILAETPKRAVKFFTFEQYKKLLGYVSLSPALTFAIAGLGSGLTEAIVVNPFEVVKVGLQANRNTFAEQPSTVGYARQIIKKEGWGLQGLNKGLTATLGRHGVFNMVYFGFYYNVKNMIPVNKDPILEFWRKFGIGLLSGTIASVINIPFDVAKSRIQGPQPVPGEIKYRTCFKTMATVYQEEGILALYKGLLPKIMRLGPGGAVMLLVYEYTYSWLQENW

SEQ ID NO: 81003 - protein, 298 aa, Homo sapiens
  Payload ID: 16144
  Gene Symbol: SLC25A21
  Gene Name: solute carrier family 25 (mitochondrial oxoadipate carrier), member 21
  Uniprot ID: Q9BQT8
  ENSP ID: ENSP00000451873
MSAKPEVSLVREASRQIVAGGSAGLVEICLMHPLDVVKTRFQIQRCATDPNSYKSLVDSFRMIFQMEGLFGFYKGILPPILAETPKRAVKFFTFEQYKKLLGYVSLSPALTFAIAGLGSGLTEAIVVNPFEVVKVGLQANRNTFAEQPSTVGYARQIIKKEGWGLQGLNKGLTATLGRHGVFNMVYFGFYYNVKNMIPVNKDPILEFWRKFGIGLLSGTIASVINIPFDVAKSRIQGPQPVPGEIKYRTCFKTMATVYQEEGILALYKGLLPKIMRLGPGGAVMLLVYEYTYSWLQEN

SEQ ID NO: 81004 - protein, 234 aa, Homo sapiens
  Payload ID: 16144
  Gene Symbol: SLC25A21
  Gene Name: solute carrier family 25 (mitochondrial oxoadipate carrier), member 21
  ENSP ID: ENSP00000481445
MEGLFGFYKGILPPILAETPKRAVKFFTFEQYKKLLGYVSLSPALTFAIAGLGSGLTEAIVVNPFEVVKVGLQANRNTFAEQPSTVGYARQIIKKEGWGLQGLNKGLTATLGRHGVFNMVYFGFYYNVKNMIPVNKDPILEFWRKFGIGLLSGTIASVINIPFDVAKSRIQGPQPVPGEIKYRTCFKTMATVYQEEGILALYKGLLPKIMRLGPGGAVMLLVYEYTYSWLQENW

SEQ ID NO: 81005 - protein, 320 aa, Homo sapiens
  Payload ID: 16145
  Gene Symbol: SLC25A19
  Gene Name: solute carrier family 25 (mitochondrial thiamine pyrophosphate carrier), member 19
  Uniprot ID: Q9HC21
  ENSP ID: ENSP00000319574
MVGYDPKPDGRNNTKFQVAVAGSVSGLVTRALISPFDVIKIRFQLQHERLSRSDPSAKYHGILQASRQILQEEGPTAFWKGHVPAQILSIGYGAVQFLSFEMLTELVHRGSVYDAREFSVHFVCGGLAACMATLTVHPVDVLRTRFAAQGEPKVYNTLRHAVGTMYRSEGPQVFYKGLAPTLIAIFPYAGLQFSCYSSLKHLYKWAIPAEGKKNENLQNLLCGSGAGVISKTLTYPLDLFKKRLQVGGFEHARAAFGQVRRYKGLMDCAKQVLQKEGALGFFKGLSPSLLKAALSTGFMFFSYEFFCNVFHCMNRTASQR

SEQ ID NO: 81006 - protein, 263 aa, Homo sapiens
  Payload ID: 16145
  Gene Symbol: SLC25A19
  Gene Name: solute carrier family 25 (mitochondrial thiamine pyrophosphate carrier), member 19
  Uniprot ID: Q9HC21
  ENSP ID: ENSP00000364410
MVGYDPKPDGRNNTKFQVAVAGSVSGLVTRALISPFDVIKIRFQLQHERLSRSDPSAKYHGILQASRQILQEEGPTAFWKGHVPAQILSIGYGAVQVYNTLRHAVGTMYRSEGPQVFYKGLAPTLIAIFPYAGLQFSCYSSLKHLYKWAIPAEGKKNENLQNLLCGSGAGVISKTLTYPLDLFKKRLQVGGFEHARAAFGQVRRYKGLMDCAKQVLQKEGALGFFKGLSPSLLKAALSTGFMFFSYEFFCNVFHCMNRTASQR

SEQ ID NO: 81007 - protein, 320 aa, Homo sapiens; identical to SEQ ID NO: 81005
  Payload ID: 16145
  Gene Symbol: SLC25A19
  Gene Name: solute carrier family 25 (mitochondrial thiamine pyrophosphate carrier), member 19
  Uniprot ID: Q9HC21
  ENSP ID: ENSP00000385312

SEQ ID NO: 81008 - protein, 320 aa, Homo sapiens; identical to SEQ ID NO: 81005
  Payload ID: 16145
  Gene Symbol: SLC25A19
  Gene Name: solute carrier family 25 (mitochondrial thiamine pyrophosphate carrier), member 19
  Uniprot ID: Q9HC21
  ENSP ID: ENSP00000397818

SEQ ID NO: 81009 - protein, 320 aa, Homo sapiens; identical to SEQ ID NO: 81005
  Payload ID: 16145
  Gene Symbol: SLC25A19
  Gene Name: solute carrier family 25 (mitochondrial thiamine pyrophosphate carrier), member 19
  Uniprot ID: Q9HC21
  ENSP ID: ENSP00000402202

SEQ ID NO: 81010 - protein, 182 aa, Homo sapiens
  Payload ID: 16145
  Gene Symbol: SLC25A19
  Gene Name: solute carrier family 25 (mitochondrial thiamine pyrophosphate carrier), member 19
  ENSP ID: ENSP00000462214
MVGYDPKPDGRNNTKFQVAVAGSVSGLVTRALISPFDVIKIRFQLQHERLSRSDPSAKYHGILQASRQILQEEGPTAFWKGHVPAQILSIGYGAVQFLSFEMLTELVHRGSVYDAREFSVHFVCGGLAACMATLTVHPVDVLRTRFAAQGEPKVRRYKGLMDCAKQVLQKEGALGFFKGLSP

SEQ ID NO: 81011 - protein, 151 aa, Homo sapiens
  Payload ID: 16145
  Gene Symbol: SLC25A19
  Gene Name: solute carrier family 25 (mitochondrial thiamine pyrophosphate carrier), member 19
  ENSP ID: ENSP00000462299
MVGYDPKPDGRNNTKFQVAVAGSVSGLVTRALISPFDVIKIRFQLQHERLSRSDPSAKYHGILQASRQILQEEGPTAFWKGHVPAQILSIGYGAVQFLSFEMLTELVHRGSVYDAREFSVHFVCGGLAACMATLTVHPVDVLRTRFAAQGE

SEQ ID NO: 81012 - protein, 67 aa, Homo sapiens
  Payload ID: 16145
  Gene Symbol: SLC25A19
  Gene Name: solute carrier family 25 (mitochondrial thiamine pyrophosphate carrier), member 19
  ENSP ID: ENSP00000462401
  MOD_RES (1)..(1): Any amino acid
XKFQVAVAGSVSGLVTRALISPFDVIKIRFQLQHERLSRSDPSAKYHGILQGSPHERIRGNAGRGLW

SEQ ID NO: 81013 - protein, 85 aa, Homo sapiens
  Payload ID: 16145
  Gene Symbol: SLC25A19
  Gene Name: solute carrier family 25 (mitochondrial thiamine pyrophosphate carrier), member 19
  ENSP ID: ENSP00000462504
MVGYDPKPDGRNNTKFQVAVAGSVSGLVTRALISPFDVIKIRFQLQHERLSRSDPSAKYHGILQASRQILQEEGPTAFWKGHVPA

SEQ ID NO: 81014 - protein, 84 aa, Homo sapiens
  Payload ID: 16145
  Gene Symbol: SLC25A19
  Gene Name: solute carrier family 25 (mitochondrial thiamine pyrophosphate carrier), member 19
  ENSP ID: ENSP00000463039
MLTELVHRGSVYDAREFSVHFVCGGLAACMATLTVHPVDVLRTRFAAQGEPKVYNTLRHAVGTMYRSEGPQVFYKGLAPTLIAI

SEQ ID NO: 81015 - protein, 105 aa, Homo sapiens
  Payload ID: 16145
  Gene Symbol: SLC25A19
  Gene Name: solute carrier family 25 (mitochondrial thiamine pyrophosphate carrier), member 19
  ENSP ID: ENSP00000463428
MVGYDPKPDGRNNTKFQVAVAGSVSGLVTRALISPFDVIKIRFQLQHERLSRSDPSAKYHGILQASRQILQEEGPTAFWKGHVPAQILSIGYGAVQFLSFEMLTE

SEQ ID NO: 81016 - protein, 153 aa, Homo sapiens
  Payload ID: 16145
  Gene Symbol: SLC25A19
  Gene Name: solute carrier family 25 (mitochondrial thiamine pyrophosphate carrier), member 19
  ENSP ID: ENSP00000463720
MVGYDPKPDGRNNTKFQVAVAGSVSGLVTRALISPFDVIKIRFQLQHERLSRSDPSAKYHGILQASRQILQEEGPTAFWKGHVPAQILSIGYGAVQFLSFEMLTELVHRGSVYDAREFSVHFVCGGLAACMATLTVHPVDVLRTRFAAQGEPK

SEQ ID NO: 81017 - protein, 320 aa, Homo sapiens; identical to SEQ ID NO: 81005
  Payload ID: 16145
  Gene Symbol: SLC25A19
  Gene Name: solute carrier family 25 (mitochondrial thiamine pyrophosphate carrier), member 19
  Uniprot ID: Q9HC21
  ENSP ID: ENSP00000463795

SEQ ID NO: 81018 - protein, 39 aa, Homo sapiens
  Payload ID: 16145
  Gene Symbol: SLC25A19
  Gene Name: solute carrier family 25 (mitochondrial thiamine pyrophosphate carrier), member 19
  ENSP ID: ENSP00000464457
MVGYDPKPDGRNNTKFQVAVAGSVSGLVTRALISPFDVI

SEQ ID NO: 81019 - protein, 321 aa, Homo sapiens
  Payload ID: 16146
  Gene Symbol: SLC25A33
  Gene Name: solute carrier family 25 (pyrimidine nucleotide carrier), member 33
  Uniprot ID: Q9BSK2
  ENSP ID: ENSP00000306328
MATGGQQKENTLLHLFAGGCGGTVGAIFTCPLEVIKTRLQSSRLALRTVYYPQVHLGTISGAGMVRPTSVTPGLFQVLKSILEKEGPKSLFRGLGPNLVGVAPSRAVYFACYSKAKEQFNGIFVPNSNIVHIFSAGSAAFITNSLMNPIWMVKTRMQLEQKVRGSKQMNTLQCARYVYQTEGIRGFYRGLTASYAGISETIICFAIYESLKKYLKEAPLASSANGTEKNSTSFFGLMAAAALSKGCASCIAYPHEVIRTRLREEGTKYKSFVQTARLVFREEGYLAFYRGLFAQLIRQIPNTAIVLSTYELIVYLLEDRTQ

SEQ ID NO: 81020 - protein, 311 aa, Homo sapiens
  Payload ID: 16147
  Gene Symbol: SLC25A36
  Gene Name: solute carrier family 25 (pyrimidine nucleotide carrier), member 36
  Uniprot ID: Q96CQ1
  ENSP ID: ENSP00000320688
MSQRDTLVHLFAGGCGGTVGAILTCPLEVVKTRLQSSSVTLYISEVQLNTMAGASVNRVVSPGPLHCLKVILEKEGPRSLFRGLGPNLVGVAPSRAIYFAAYSNCKEKLNDVFDPDSTQVHMISAAMAGFTAITATNPIWLIKTRLQLDARNRGERRMGAFECVRKVYQTDGLKGFYRGMSASYAGISETVIHFVIYESIKQKLLEYKTASTMENDEESVKEASDFVGMMLAAATSKTCATTIAYPHEVVRTRLREEGTKYRSFFQTLSLLVQEEGYGSLYRGLTTHLVRQIPNTAIMMATYELVVYLLNG

SEQ ID NO: 81021 - protein, 285 aa, Homo sapiens
  Payload ID: 16147
  Gene Symbol: SLC25A36
  Gene Name: solute carrier family 25 (pyrimidine nucleotide carrier), member 36
  ENSP ID: ENSP00000391521
MSQRDTLVHLFAGGCGGTVGAILTCPLEVVKTRLQSSSVTLYISEVQLNTMAGASVNRVVSPGPLHCLKAIYFAAYSNCKEKLNDVFDPDSTQVHMISAAMAGFTAITATNPIWLIKTRLQLDARNRGERRMGAFECVRKVYQTDGLKGFYRGMSASYAGISETVIHFVIYESIKQKLLEYKTASTMENDEESVKEASDFVGMMLAAATSKTCATTIAYPHEVVRTRLREEGTKYRSFFQTLSLLVQEEGYGSLYRGLTTHLVRQIPNTAIMMATYELVVYLLNG

SEQ ID NO: 81022 - protein, 310 aa, Homo sapiens
  Payload ID: 16147
  Gene Symbol: SLC25A36
  Gene Name: solute carrier family 25 (pyrimidine nucleotide carrier), member 36
  Uniprot ID: Q96CQ1
  ENSP ID: ENSP00000401938
MSQRDTLVHLFAGGCGGTVGAILTCPLEVVKTRLQSSSVTLYISEVQLNTMAGASVNRVVSPGPLHCLKVILEKEGPRSLFRGLGPNLVGVAPSRAIYFAAYSNCKEKLNDVFDPDSTQVHMISAAMAGFTAITATNPIWLIKTRLQLDARNRGERRMGAFECVRKVYQTDGLKGFYRGMSASYAGISETVIHFVIYESIKQKLLEYKTASTMENDEESVKEASDFVGMMLAAATSKTCATTIAYPHVVRTRLREEGTKYRSFFQTLSLLVQEEGYGSLYRGLTTHLVRQIPNTAIMMATYELVVYLLNG

SEQ ID NO: 81023 - protein, 132 aa, Homo sapiens
  Payload ID: 16147
  Gene Symbol: SLC25A36
  Gene Name: solute carrier family 25 (pyrimidine nucleotide carrier), member 36
  ENSP ID: ENSP00000421470
MSQRDTLVHLFAGGCGGTVGAILTCPLEVVKTRLQSSSVTLYISEVQLNTMAGASVNRVVSPGPLHCLKVILEKEGPRSLFRGLGPNLVGVAPSRAIYFAAYSNCKEKLNDVFDPDSTQVHMISAAMAGMNV

SEQ ID NO: 81024 - protein, 67 aa, Homo sapiens
  Payload ID: 16147
  Gene Symbol: SLC25A36
  Gene Name: solute carrier family 25 (pyrimidine nucleotide carrier), member 36
  ENSP ID: ENSP00000422265
MAGASVNRVVSPGPLHCLKAIYFAAYSNCKEKLNDVFDPDSTQVHMISAAMAGFTAITATNPIWLIK

SEQ ID NO: 81025 - protein, 132 aa, Homo sapiens
  Payload ID: 16147
  Gene Symbol: SLC25A36
  Gene Name: solute carrier family 25 (pyrimidine nucleotide carrier), member 36
  Uniprot ID: Q96CQ1
  ENSP ID: ENSP00000423319
MSQRDTLVHLFAGGCGGTVGAILTCPLEVVKTRLQSSSVTLYISEVQLNTMAGASVNRVVSPGPLHCLKVILEKEGPRSLFRGLGPNLVGVAPSRAIYFAAYSNCKEKLNDVFDPDSTQVHMISAAMAGHFL

SEQ ID NO: 81026 - protein, 89 aa, Homo sapiens
  Payload ID: 16147
  Gene Symbol: SLC25A36
  Gene Name: solute carrier family 25 (pyrimidine nucleotide carrier), member 36
  ENSP ID: ENSP00000423711
MAGASVNRVVSPGPLHCLKVILEKEGPRSLFRGLGPNLVGVAPSRAIYFAAYSNCKEKLNDVFDPDSTQVHMISAAMAGIYCTFLPRKE

SEQ ID NO: 81027 - protein, 86 aa, Homo sapiens
  Payload ID: 16147
  Gene Symbol: SLC25A36
  Gene Name: solute carrier family 25 (pyrimidine nucleotide carrier), member 36
  ENSP ID: ENSP00000424505
MAGASVNRVVSPGPLHCLKVILEKEGPRSLFRGLGPNLVGVAPSRAIYFAAYSNCKEKLNDVFDPDSTQVHMISAAMAEHKKLNTK

SEQ ID NO: 81028 - protein, 132 aa, Homo sapiens; identical to SEQ ID NO: 81025
  Payload ID: 16147
  Gene Symbol: SLC25A36
  Gene Name: solute carrier family 25 (pyrimidine nucleotide carrier), member 36
  Uniprot ID: Q96CQ1
  ENSP ID: ENSP00000487839

SEQ ID NO: 81029 - protein, 186 aa, Homo sapiens
  Payload ID: 16148
  Gene Symbol: SLC25A26
  Gene Name: solute carrier family 25 (S-adenosylmethionine carrier), member 26
  Uniprot ID: Q70HW3
  ENSP ID: ENSP00000336801
MKHMLAASAGEVVACLIRVPSEVVKQRAQVSASTRTFQIFSNILYEEGIQGLYRGYKSTVLREIPFSLVQFPLWESLKALWSWRQDHVVDSWQSAVCGAFAGGFAAAVTTPLDVAKTRITLAKAGSSTADGNVLSVLHGVWRSQGLAGLFAGVFPRMAAISLGGFIFLGAYDRTHSLLLEVGRKSP

SEQ ID NO: 81030 - protein, 274 aa, Homo sapiens
  Payload ID: 16148
  Gene Symbol: SLC25A26
  Gene Name: solute carrier family 25 (S-adenosylmethionine carrier), member 26
  ENSP ID: ENSP00000346955
MDRPGFVAALVAGGVAGVSVDLILFPLDTIKTRLQSPQGFSKAGGFHGIYAGVPSAAIGSFPNAAAFFITYEYVKWFLHADSSSYLTPMKHMLAASAGEVVACLIRVPSEVVKQRAQVSASTRTFQIFSNILYEEGIQGLYRGYKSTVLREIPFSLVQFPLWESLKALWSWRQDHVVDSWQSAVCGAFAGGFAAAVTTPLDVAKTRITLAKAGSSTADGNVLSVLHGVWRSQGLAGLFAGVFPRMAAISLGGFIFLGAYDRTHSLLLEVGRKSP

SEQ ID NO: 81031 - protein, 210 aa, Homo sapiens
  Payload ID: 16148
  Gene Symbol: SLC25A26
  Gene Name: solute carrier family 25 (S-adenosylmethionine carrier), member 26
  ENSP ID: ENSP00000415304
MKHMLAASAGEVVACLIRVPSEVVKQRAQVSASTRTFQIFSNILYEEGIQGLYRGYKSTVLREIPFSLVQFPLWESLKALWSWRQDHVVDSWQSAVCGAFAGGFAAAVTTPLDVAKTRITLAKAGSSTADGNVLSVLHGVWRSQGLAGDHIPGIFLQEQSSGLPLQRVGRQLPGLRASQLAVPPPHPDAELDHLCDCSFCVPLAVLISAI

SEQ ID NO: 81032 - protein, 86 aa, Homo sapiens
  Payload ID: 16148
  Gene Symbol: SLC25A26
  Gene Name: solute carrier family 25 (S-adenosylmethionine carrier), member 26
  ENSP ID: ENSP00000432574
MKHMLAASAGEVVACLIRVPSEVVKQRAQVSASTRTFQIFSNILYEEGIQGLYRGYKSTVLREIPFSLVQFPLWESLKGWKPYNCF

SEQ ID NO: 81033 - protein, 91 aa, Homo sapiens
  Payload ID: 16148
  Gene Symbol: SLC25A26
  Gene Name: solute carrier family 25 (S-adenosylmethionine carrier), member 26
  ENSP ID: ENSP00000437217
  MOD_RES (1)..(1): Any amino acid
XAAFFITYEYVKWFLHADSSSYLTPMKHMLAASAGEVVACLIRVPSEVVKQRAQVSASTRTFQIFSNILYEEGIQGLYRGYKSTVLREEED

SEQ ID NO: 81034 - protein, 86 aa, Homo sapiens; identical to SEQ ID NO: 81032
  Payload ID: 16148
  Gene Symbol: SLC25A26
  Gene Name: Solute carrier family 25 (S-adenosylmethionine carrier), member 26
  ENSP ID: ENSP00000487656

SEQ ID NO: 81035 - protein, 91 aa, Homo sapiens; identical to SEQ ID NO: 81033
  Payload ID: 16148
  Gene Symbol: SLC25A26
  Gene Name: Solute carrier family 25 (S-adenosylmethionine carrier), member 26
  ENSP ID: ENSP00000487788
  MOD_RES (1)..(1): Any amino acid

SEQ ID NO: 81036 - protein, 210 aa, Homo sapiens; identical to SEQ ID NO: 81031
  Payload ID: 16148
  Gene Symbol: SLC25A26
  Gene Name: Solute carrier family 25 (S-adenosylmethionine carrier), member 26
  ENSP ID: ENSP00000487996

SEQ ID NO: 81037 - protein, 274 aa, Homo sapiens; identical to SEQ ID NO: 81030
  Payload ID: 16148
  Gene Symbol: SLC25A26
  Gene Name: Solute carrier family 25 (S-adenosylmethionine carrier), member 26
  ENSP ID: ENSP00000488659

SEQ ID NO: 81038 - protein, 186 aa, Homo sapiens; identical to SEQ ID NO: 81029
  Payload ID: 16148
  Gene Symbol: SLC25A26
  Gene Name: Solute carrier family 25 (S-adenosylmethionine carrier), member 26
  ENSP ID: ENSP00000488865

SEQ ID NO: 81039 - protein, 323 aa, Homo sapiens
  Payload ID: 16149
  Gene Symbol: SLC25A27
  Gene Name: solute carrier family 25, member 27
  Uniprot ID: O95847
  ENSP ID: ENSP00000360398
MSVPEEEERLLPLTQRWPRASKFLLSGCAATVAELATFPLDLTKTRLQMQGEAALARLGDGARESAPYRGMVRTALGIIEEEGFLKLWQGVTPAIYRHVVYSGGRMVTYEHLREVVFGKSEDEHYPLWKSVIGGMMAGVIGQFLANPTDLVKVQMQMEGKRKLEGKPLRFRGVHHAFAKILAEGGIRGLWAGWVPNIQRAALVNMGDLTTYDTVKHYLVLNTPLEDNIMTHGLSSLCSGLVASILGTPADVIKSRIMNQPRDKQGRGLLYKSSTDCLIQAVQGEGFMSLYKGFLPSWLRMTPWSMVFWLTYEKIREMSGVSPF

SEQ ID NO: 81040 - protein, 245 aa, Homo sapiens
  Payload ID: 16149
  Gene Symbol: SLC25A27
  Gene Name: solute carrier family 25, member 27
  Uniprot ID: O95847
  ENSP ID: ENSP00000412024
MSVPEEEERLLPLTQRWPRASKFLLSGCAATVAELATFPLDLTKTRLQMQGEAALARLGDGARESAPYRGMVRTALGIIEEEGFLKLWQGVTPAIYRHVVYSGGRMVTYEHLREVVFGKSEDEHYPLWKSVIGGMMAGVIGQFLANPTDLVKVQMQMEGKRKLEGKPLRFRGVHHAFAKILAEGGIRGLWAGWVPNIQRAALVNMGDLTTYDTVKHYLVLNTPLEDNIMTHGLSSDLVGSHKAIQ

SEQ ID NO: 81041 - protein, 98 aa, Homo sapiens
  Payload ID: 16149
  Gene Symbol: SLC25A27
  Gene Name: solute carrier family 25, member 27
  ENSP ID: ENSP00000473804
  MOD_RES (1)..(1): Any amino acid
XNMGDLTTYDTVKHYLVLNTPLEDNIMTHGLSSLCSGLVASILGTPADVIKSRIMNQPRDKQGRGLLYKSSTDCLIQAVQGEGFMSLYKGFLPSWLRM

SEQ ID NO: 81042 - protein, 145 aa, Homo sapiens
  Payload ID: 16149
  Gene Symbol: SLC25A27
  Gene Name: solute carrier family 25, member 27
  ENSP ID: ENSP00000474429
  MOD_RES (1)..(1): Any amino acid
XMEGKRKLEGKPLRFRGVHHAFAKILAEGGIRGLWAGWVPNIQRAALVNMGDLTTYDTVKHYLVLNTPLEDNIMTHGLSSLCSGLVASILGTPADVIKSRIMNQPRDKQGRGLLYKSSTDCLIQAVQGEGFMSLYKGFLPSWLRM

SEQ ID NO: 81043 - protein, 149 aa, Homo sapiens
  Payload ID: 16149
  Gene Symbol: SLC25A27
  Gene Name: solute carrier family 25, member 27
  ENSP ID: ENSP00000474781
MSECPLILYIHKHIDTYSQSYLFNDLFYPVYSGGRMVTYEHLREVVFGKSEDEHYPLWKSVIGGMMAGVIGQFLANPTDLVKVQMQMEGKRKLEGKPLRFRGVHHAFAKILAEGGIRGLWAGWVPNIQRAALVNMGDLTTYDTVKHYLV

SEQ ID NO: 81044 - protein, 145 aa, Homo sapiens; identical to SEQ ID NO: 81042
  Payload ID: 16149
  Gene Symbol: SLC25A27
  Gene Name: solute carrier family 25, member 27
  ENSP ID: ENSP00000474828
  MOD_RES (1)..(1): Any amino acid

SEQ ID NO: 81045 - protein, 37 aa, Homo sapiens
  Payload ID: 16150
  Gene Symbol: SLC25A30
  Gene Name: solute carrier family 25, member 30
  ENSP ID: ENSP00000311856
MSALNWKPFVYGGLASITAECGLPPRCYARHPMAPSR

SEQ ID NO: 81046 - protein, 37 aa, Homo sapiens; identical to SEQ ID NO: 81045
  Payload ID: 16150
  Gene Symbol: SLC25A30
  Gene Name: solute carrier family 25, member 30
  ENSP ID: ENSP00000425603

SEQ ID NO: 81047 - protein, 291 aa, Homo sapiens
  Payload ID: 16150
  Gene Symbol: SLC25A30
  Gene Name: solute carrier family 25, member 30
  Uniprot ID: Q5SVS4
  ENSP ID: ENSP00000429168
MSALNWKPFVYGGLASITAECGTFPIDLTKTRLQIQGQTNDAKFKEIRYRGMLHALVRIGREEGLKALYSGIAPAMLRQASYGTIKIGTYQSLKRLFIERPEDETLPINVICGILSGVISSTIANPTDVLKIRMQAQSNTIQGGMIGNFMNIYQQEGTRGLWKGVSLTAQRAAIVVGVELPVYDITKKHLILSGLMGDTVYTHFLSSFTCGLAGALASNPVDVVRTRMMNQRVLRDGRCSGYTGTLDCLLQTWKNEGFFALYKGFWPNWLRLGPWNIIFFVTYEQLKKLDL

SEQ ID NO: 81048 - protein, 137 aa, Homo sapiens
  Payload ID: 16150
  Gene Symbol: SLC25A30
  Gene Name: solute carrier family 25, member 30
  ENSP ID: ENSP00000429308
MLHALVRIGREEGLKALYSGIAPAMLRQASYGTIKIGTYQSLKRLFIERPEDETLPINVICGILSGVISSTIANPTDVLKIRMQAQSNTIQGGMIGNFMNIYQQEGTRGLWKGVSLTAQRAAIVVGVELPVYDITKK

SEQ ID NO: 81049 - protein, 94 aa, Homo sapiens
  Payload ID: 16150
  Gene Symbol: SLC25A30
  Gene Name: solute carrier family 25, member 30
  ENSP ID: ENSP00000430687
MLRQASYGTIKIGTYQSLKRLFIERPEDETLPINVICGILSGVISSTIANPTDVLKIRMQAQSNTIQGGMIGNFMNIYQQEGTRGLWKGVSLTA

SEQ ID NO: 81050 - protein, 240 aa, Homo sapiens
  Payload ID: 16150
  Gene Symbol: SLC25A30
  Gene Name: solute carrier family 25, member 30
  Uniprot ID: Q5SVS4
  ENSP ID: ENSP00000443542
MLHALVRIGREEGLKALYSGIAPAMLRQASYGTIKIGTYQSLKRLFIERPEDETLPINVICGILSGVISSTIANPTDVLKIRMQAQSNTIQGGMIGNFMNIYQQEGTRGLWKGVSLTAQRAAIVVGVELPVYDITKKHLILSGLMGDTVYTHFLSSFTCGLAGALASNPVDVVRTRMMNQRVLRDGRCSGYTGTLDCLLQTWKNEGFFALYKGFWPNWLRLGPWNIIFFVTYEQLKKLDL

SEQ ID NO: 81051 - protein, 119 aa, Homo sapiens
  Payload ID: 16150
  Gene Symbol: SLC25A30
  Gene Name: solute carrier family 25, member 30
  ENSP ID: ENSP00000480455
  MOD_RES (1)..(1): Any amino acid
XQSNTIQGGMIGNFMNIYQQEGTRGLWKGVSLTAQRAAIVVGVELPVYDITKKHLILSGLMGDTVYTHFLSSFTCGLAGALASNPVDVVRTRMMNQRVLRDGRCSGYTGTLDCLLQVLP

SEQ ID NO: 81052 - protein, 304 aa, Homo sapiens
  Payload ID: 16151
  Gene Symbol: SLC25A34
  Gene Name: solute carrier family 25, member 34
  Uniprot ID: Q6PIV7
  ENSP ID: ENSP00000294454
METVPPAVDLVLGASACCLACVFTNPLEVVKTRLQLQGELQARGTYPRPYHGFIASVAAVARADGLWGLQKGLAAGLLYQGLMNGVRFYCYSLACQAGLTQQPGGTVVAGAVAGALGAFVGSPAYLIKTQLQAQTVAAVAVGHQHNHQTVLGALETIWRQQGLLGLWQGVGGAVPRVMVGSAAQLATFASAKAWVQKQQWLPEDSWLVALAGGMISSIAVVVVMTPFDVVSTRLYNQPVDTAGRGQLYGGLTDCMVKIWRQEGPLALYKGLGPAYLRLGPHTILSMLFWDELRKLAGRAQHKGT

SEQ ID NO: 81053 - protein, 295 aa, Homo sapiens
  Payload ID: 16152
  Gene Symbol: SLC25A35
  Gene Name: solute carrier family 25, member 35
  Uniprot ID: Q3KQZ1
  ENSP ID: ENSP00000369407
MDFLMSGLAACGACVFTNPLEVVKTRMQLQGELQAPGTYQRHYRNVFHAFITIGKVDGLAALQKGLAPALLYQFLMNGIRLGTYGLAEAGGYLHTAEGTHSPARSAAAGAMAGVMGAYLGSPIYMVKTHLQAQAASEIAVGHQYKHQGMFQALTEIGQKHGLVGLWRGALGGLPRVIVGSSTQLCTFSSTKDLLSQWEIFPPQSWKLALVAAMMSGIAVVLAMAPFDVACTRLYNQPTDAQGKNRVPKFSATSCSASAPLLGTKDVRIVKGQTGHQLFKVTQAPGCSPILLGTQS

SEQ ID NO: 81054 - protein, 295 aa, Homo sapiens; identical to SEQ ID NO: 81053
  Payload ID: 16152
  Gene Symbol: SLC25A35
  Gene Name: solute carrier family 25, member 35
  Uniprot ID: Q3KQZ1
  ENSP ID: ENSP00000462395

SEQ ID NO: 81055 - protein, 295 aa, Homo sapiens; identical to SEQ ID NO: 81053
  Payload ID: 16152
  Gene Symbol: SLC25A35
  Gene Name: solute carrier family 25, member 35
  Uniprot ID: Q3KQZ1
  ENSP ID: ENSP00000464071

SEQ ID NO: 81056 - protein, 291 aa, Homo sapiens
  Payload ID: 16152
  Gene Symbol: SLC25A35
  Gene Name: solute carrier family 25, member 35
  Uniprot ID: Q3KQZ1
  ENSP ID: ENSP00000464191
MDFLMSGLAACGACVFTNPLEVVKTRMQLQGELQAPGTYQRHYRNVFHAFITIGKVDGLAALQKGLAPALLYQFLMNGIRLGTYGLAEAGGYLHTAEGTHSPARSAAAGAMAGVMGAYLGSPIYMVKTHLQAQAASEIAVGHQYKHQGMFQALTEIGQKHGLVGLWRGALGGLPRVIVGSSTQLCTFSSTKDLLSQWEIFPPQSWKLALVAAMMSGIAVVLAMAPFDVACTRLYNQPTDAQGKGLMYRGILDALLQTARTEGIFGMYKEPSPQVLSNIMQCFSAFTGDQRC

SEQ ID NO: 81057 - protein, 300 aa, Homo sapiens
  Payload ID: 16152
  Gene Symbol: SLC25A35
  Gene Name: solute carrier family 25, member 35
  Uniprot ID: Q3KQZ1
  ENSP ID: ENSP00000464231
MDFLMSGLAACGACVFTNPLEVVKTRMQLQGELQAPGTYQRHYRNVFHAFITIGKVDGLAALQKGLAPALLYQFLMNGIRLGTYGLAEAGGYLHTAEGTHSPARSAAAGAMAGVMGAYLGSPIYMVKTHLQAQAASEIAVGHQYKHQGMFQALTEIGQKHGLVGLWRGALGGLPRVIVGSSTQLCTFSSTKDLLSQWEIFPPQSWKLALVAAMMSGIAVVLAMAPFDVACTRLYNQPTDAQGKGLMYRGILDALLQTARTEGIFGMYKGIGASYFRLGPHTILSLFFWDQLRSLYYTDTK

SEQ ID NO: 81058 - protein, 287 aa, Homo sapiens
  Payload ID: 16152
  Gene Symbol: SLC25A35
  Gene Name: solute carrier family 25, member 35
  Uniprot ID: Q3KQZ1
  ENSP ID: ENSP00000464307
MDFLMSGLAACGACVFTNPLEVVKTRMQLQGELQAPGTYQRHYRNVFHAFITIGKVDGLAALQKGLAPALLYQFLMNGIRLGTYGLAEAGGYLHTAEGTHSPARSAAAGAMAGVMGAYLGSPIYMVKTHLQAQAASEIAVGHQYKHQGMFQALTEIGQKHGLVGLWRGALGGLPRVIVGSSTQLCTFSSTKDLLSQWEIFPPQSWKLALVAAMMSGIAVVLAMAPFDVACTRLYNQPTDAQGKGLMYRGILDALLQTARTEGIFEPSPQVLSNIMQCFSAFTGDQRC

SEQ ID NO: 81059 - protein, 304 aa, Homo sapiens
  Payload ID: 16153
  Gene Symbol: SLC25A38
  Gene Name: solute carrier family 25, member 38
  Uniprot ID: Q96DW6
  ENSP ID: ENSP00000273158
MIQNSRPSLLQPQDVGDTVETLMLHPVIKAFLCGSISGTCSTLLFQPLDLLKTRLQTLQPSDHGSRRVGMLAVLLKVVRTESLLGLWKGMSPSIVRCVPGVGIYFGTLYSLKQYFLRGHPPTALESVMLGVGSRSVAGVCMSPITVIKTRYESGKYGYESIYAALRSIYHSEGHRGLFSGLTATLLRDAPFSGIYLMFYNQTKNIVPHDQVDATLIPITNFSCGIFAGILASLVTQPADVIKTHMQLYPLKFQWIGQAVTLIFKDYGLRGFFQGGIPRALRRTLMAAMAWTVYEEMMAKMGLKS

SEQ ID NO: 81060 - protein, 148 aa, Homo sapiens
  Payload ID: 16153
  Gene Symbol: SLC25A38
  Gene Name: solute carrier family 25, member 38
  ENSP ID: ENSP00000394244
MSETRWKRLWYEENMRHHQLHPVIKAFLCGSISGTCSTLLFQPLDLLKTRLQTLQPSDHGSRRVGMLAVLLKVVRTESLLGLWKGMSPSIVRCVPGVGIYFGTLYSLKQYFLRGHPPTALESVMLGVGSRSVAGVCMSPITVIKTRYE

SEQ ID NO: 81061 - protein, 351 aa, Homo sapiens
  Payload ID: 16154
  Gene Symbol: SLC25A39
  Gene Name: solute carrier family 25, member 39
  Uniprot ID: Q9BZJ4
  ENSP ID: ENSP00000225308
MADQDPAGISPLQQMVASGTGAVVTSLFMTPLDVVKVRLQSQRPSMASELMPSSRLWSLSYTKWKCLLYCNGVLEPLYLCPNGARCATWFQDPTRFTGTMDAFVKIVRHEGTRTLWSGLPATLVMTVPATAIYFTAYDQLKAFLCGRALTSDLYAPMVAGALARLGTVTVISPLELMRTKLQAQHVSYRELGACVRTAVAQGGWRSLWLGWGPTALRDVPFSALYWFNYELVKSWLNGFRPKDQTSVGMSFVAGGISGTVAAVLTLPFDVVKTQRQVALGAMEAVRVNPLHVDSTWLLLRRIRAESGTKGLFAGFLPRIIKAAPSCAIMISTYEFGKSFFQRLNQDRLLGG

SEQ ID NO: 81062 - protein, 359 aa, Homo sapiens
  Payload ID: 16154
  Gene Symbol: SLC25A39
  Gene Name: solute carrier family 25, member 39
  Uniprot ID: Q9BZJ4
  ENSP ID: ENSP00000366299
MADQDPAGISPLQQMVASGTGAVVTSLFMTPLDVVKVRLQSQRPSMASELMPSSRLWSLSYTKLPSSLQSTGKCLLYCNGVLEPLYLCPNGARCATWFQDPTRFTGTMDAFVKIVRHEGTRTLWSGLPATLVMTVPATAIYFTAYDQLKAFLCGRALTSDLYAPMVAGALARLGTVTVISPLELMRTKLQAQHVSYRELGACVRTAVAQGGWRSLWLGWGPTALRDVPFSALYWFNYELVKSWLNGFRPKDQTSVGMSFVAGGISGTVAAVLTLPFDVVKTQRQVALGAMEAVRVNPLHVDSTWLLLRRIRAESGTKGLFAGFLPRIIKAAPSCAIMISTYEFGKSFFQRLNQDRLLGG

SEQ ID NO: 81063 - protein, 336 aa, Homo sapiens
  Payload ID: 16154
  Gene Symbol: SLC25A39
  Gene Name: solute carrier family 25, member 39
  ENSP ID: ENSP00000444540
MADQDPAGISPLQQMVASGTGAVVTSLFMTPLDVVKVRLQSQRPSMASGKCLLYCNGVLEPLYLCPNGARCATWFQDPTRFTGTMDAFVKIVRHEGTRTLWSGLPATLVMTVPATAIYFTAYDQLKAFLCGRALTSDLYAPMVAGALARLGTVTVISPLELMRTKLQAQHVSYRELGACVRTAVAQGGWRSLWLGWGPTALRDVPFSALYWFNYELVKSWLNGFRPKDQTSVGMSFVAGGISGTVAAVLTLPFDVVKTQRQVALGAMEAVRVNPLHVDSTWLLLRRIRAESGTKGLFAGFLPRIIKAAPSCAIMISTYEFGKSFFQRLNQDRLLGG

SEQ ID NO: 81064 - protein, 164 aa, Homo sapiens
  Payload ID: 16154
  Gene Symbol: SLC25A39
  Gene Name: solute carrier family 25, member 39
  ENSP ID: ENSP00000465182
MADQDPAGISPLQQMVASGTGAVVTSLFMTPLDVVKVRLQSQRPSMASELMPSSRLWSLSYTKWKCLLYCNGVLEPLYLCPNGARCATWFQDPTRFTGTMDAFVKIVRHEGTRTLWSGLPATLVMTVPATAIYFTAYDQLKAFLCGRALTSDLYAPMVAGALAR

SEQ ID NO: 81065 - protein, 143 aa, Homo sapiens
  Payload ID: 16154
  Gene Symbol: SLC25A39
  Gene Name: solute carrier family 25, member 39
  ENSP ID: ENSP00000465554
MADQDPAGISPLQQMVASGTGAVVTSLFMTPLDVVKVRLQSQRPSMASVPSSLQSTGKCLLYCNGVLEPLYLCPNGARCATWFQDPTRFTGTMDAFVKIVRHEGTRTLWSGLPATLVMTVPATAIYFTAYDQLKAFLCGRALT

SEQ ID NO: 81066 - protein, 99 aa, Homo sapiens
  Payload ID: 16154
  Gene Symbol: SLC25A39
  Gene Name: solute carrier family 25, member 39
  ENSP ID: ENSP00000465594
MADQDPAGISPLQQMVASGTGAVVTSLFMTPLDVVKVRLQSQRPSMASELMPSSRLWSLSYTKWKCLLYCNGVLEPLYLCPNGARCATWFQDPTRFTGT

SEQ ID NO: 81067 - protein, 72 aa, Homo sapiens
  Payload ID: 16154
  Gene Symbol: SLC25A39
  Gene Name: solute carrier family 25, member 39
  ENSP ID: ENSP00000466144
MADQDPAGISPLQQMVASGTGAVVTSLFMTPLDVVKVRLQSQRPSMASELMPSSRLWSLSYTKLPSSLQSTG

SEQ ID NO: 81068 - protein, 266 aa, Homo sapiens
  Payload ID: 16154
  Gene Symbol: SLC25A39
  Gene Name: solute carrier family 25, member 39
  ENSP ID: ENSP00000466615
DPTRFTGTMDAFVKIVRHEGTRTLWSGLPATLVMTVPATAIYFTAYDQLKAFLCGRALTSDLYAPMVAGALARLGTVTVISPLELMRTKLQAQHVSYRELGACVRTAVAQGGWRSLWLGWGPTALRDVPFSVHPPPQALYWFNYELVKSWLNGFRPKDQTSVGMSFVAGGISGTVAAVLTLPFDVVKTQRQVALGAMEAVRVNPLHVDSTWLLLRRIRAESGTKGLFAGFLPRIIKAAPSCAIMISTYEFGKSFFQRLNQDRLLGG

SEQ ID NO: 81069 - protein, 227 aa, Homo sapiens
  Payload ID: 16154
  Gene Symbol: SLC25A39
  Gene Name: solute carrier family 25, member 39
  ENSP ID: ENSP00000466676
MTVPATAIYFTAYDQLKAFLCGRALTSDLYAPMVAGALARLGTVTVISPLELMRTKLQAQHVSYRELGACVRTAVAQGGWRSLWLGWGPTALRDVPFSALYWFNYELVKSWLNGFRPKDQTSVGMSFVAGGISGTVAAVLTLPFDVVKTQRQVALGAMEAVRVNPLHVDSTWLLLRRIRAESGTKGLFAGFLPRIIKAAPSCAIMISTYEFGKSFFQRLNQDRLLGG

SEQ ID NO: 81070 - protein, 351 aa, Homo sapiens; identical to SEQ ID NO: 81061
  Payload ID: 16154
  Gene Symbol: SLC25A39
  Gene Name: solute carrier family 25, member 39
  Uniprot ID: Q9BZJ4
  ENSP ID: ENSP00000467681

SEQ ID NO: 81071 - protein, 93 aa, Homo sapiens
  Payload ID: 16154
  Gene Symbol: SLC25A39
  Gene Name: solute carrier family 25, member 39
  ENSP ID: ENSP00000467956
MADQDPAGISPLQQMVASGTGAVVTSLFMTPLDVVKVRLQSQRPSMASELMPSSRLWSLSYTKWKCLLYCNGVLEPLYLCPNGARCATWFQDP

SEQ ID NO: 81072 - protein, 61 aa, Homo sapiens
  Payload ID: 16154
  Gene Symbol: SLC25A39
  Gene Name: solute carrier family 25, member 39
  ENSP ID: ENSP00000467964
TAYDQLKAFLCGRALTSDLYAPMVAGALARREHSLGPLTSLCPHLGPNPVSPSSQPQPLPA

SEQ ID NO: 81073 - protein, 338 aa, Homo sapiens
  Payload ID: 16155
  Gene Symbol: SLC25A40
  Gene Name: solute carrier family 25, member 40
  Uniprot ID: Q8TBP6
  ENSP ID: ENSP00000344831
MDPETRGQEIIKVTPLQQMLASCTGAILTSVIVTPLDVVKIRLQAQNNPLPKGKCFVYSNGLMDHLCVCEEGGNKLWYKKPGNFQGTLDAFFKIIRNEGIKSLWSGLPPTLVMAVPATVIYFTCYDQLSALLRSKLGENETCIPIVAGIVARFGAVTVISPLELIRTKMQSKKFSYVELHRFVSKKVSEDGWISLWRGWAPTVLRDVPFSAMYWYNYEILKKWLCEKSGLYEPTFMINFTSGALSGSFAAVATLPFDVVKTQKQTQLWTYESHKISMPLHMSTWIIMKNIVAKNGFSGLFSGLIPRLIKIAPACAIMISTYEFGKAFFQKQNVRRQQY

SEQ ID NO: 81074 - protein, 37 aa, Homo sapiens
  Payload ID: 16155
  Gene Symbol: SLC25A40
  Gene Name: solute carrier family 25, member 40
  ENSP ID: ENSP00000401473
MYWYNYEILKKWLCEKSGLYEPTFMINFTSGALSGSE

SEQ ID NO: 81075 - protein, 36 aa, Homo sapiens
  Payload ID: 16155
  Gene Symbol: SLC25A40
  Gene Name: solute carrier family 25, member 40
  ENSP ID: ENSP00000405566
MDPETRGQEIIKVTPLQQMLASCTGAILTSVIDTTR

SEQ ID NO: 81076 - protein, 36 aa, Homo sapiens; identical to SEQ ID NO: 81075
  Payload ID: 16155
  Gene Symbol: SLC25A40
  Gene Name: solute carrier family 25, member 40
  ENSP ID: ENSP00000407780

SEQ ID NO: 81077 - protein, 370 aa, Homo sapiens
  Payload ID: 16156
  Gene Symbol: SLC25A41
  Gene Name: solute carrier family 25, member 41
  Uniprot ID: Q8N5S1
  ENSP ID: ENSP00000322649
MGAQPGEPQNTCSRIQTLFRRVKTLLIKAPPPPQPPPPPPSWNPGCTHVYGYAFGHMHDNNLEHLPSQQVLDTGEQLMVPVEVLEVDNKEALWKFLLSGAMAGAVSRTGTAPLDRAKVYMQVYSSKTNFTNLLGGLQSMVQEGGFRSLWRGNGINVLKIAPEYAIKFSVFEQCKNYFCGIQGSPPFQERLLAGSLAVAISQTLINPMEVLKTRLTLRRTGQYKGLLDCARQILQREGTRALYRGYLPNMLGIIPYACTDLAVYEMLQCFWVKSGRDMGDPSGLVSLSSVTLSTTCGQMASYPLTLVRTRMQAQDTVEGSNPTMRGVLQRILAQQGWLGLYRGMTPTLLKVLPAGGISYVVYEAMKKTLGI

SEQ ID NO: 81078 - protein, 242 aa, Homo sapiens
  Payload ID: 16156
  Gene Symbol: SLC25A41
  Gene Name: solute carrier family 25, member 41
  Uniprot ID: Q8N5S1
  ENSP ID: ENSP00000405411
MGAQPGEPQNTCSRIQTLFRRVKTLLIKAPPPPQPPPPPPSWNPGCTHVYGYAFGHMHDNNLEHLPSQQVLDTGEQLMVPVEVLEVDNKEALWKFLLSGAMAGAVSRTGTAPLDRAKVYMQLLGRLRQENRLNLGGGGCSEPRSPDRTPAWATESTPPRRTSPTCWGGYRAWSRRAASAPCGGATASTCSRLLLSMPSSSPYSSSARITSVEYKGPRPSRSVSLLAPWLWPSPRPSSTPWRC

SEQ ID NO: 81079 - protein, 370 aa, Homo sapiens; identical to SEQ ID NO: 81077
  Payload ID: 16156
  Gene Symbol: SLC25A41
  Gene Name: solute carrier family 25, member 41
  Uniprot ID: Q8N5S1
  ENSP ID: ENSP00000471238

SEQ ID NO: 81080 - protein, 318 aa, Homo sapiens
  Payload ID: 16157
  Gene Symbol: SLC25A42
  Gene Name: solute carrier family 25, member 42
  Uniprot ID: Q86VD7
  ENSP ID: ENSP00000326693
MGNGVKEGPVRLHEDAEAVLSSSVSSKRDHRQVLSSLLSGALAGALAKTAVAPLDRTKIIFQVSSKRFSAKEAFRVLYYTYLNEGFLSLWRGNSATMVRVVPYAAIQFSAHEEYKRILGSYYGFRGEALPPWPRLFAGALAGTTAASLTYPLDLVRARMAVTPKEMYSNIFHVFIRISREEGLKTLYHGFMPTVLGVIPYAGLSFFTYETLKSLHREYSGRRQPYPFERMIFGACAGLIGQSASYPLDVVRRRMQTAGVTGYPRASIARTLRTIVREEGAVRGLYKGLSMNWVKGPIAVGISFTTFDLMQILLRHLQS

SEQ ID NO: 81081 - protein, 341 aa, Homo sapiens
  Payload ID: 16158
  Gene Symbol: SLC25A43
  Gene Name: solute carrier family 25, member 43
  Uniprot ID: Q8WUT9
  ENSP ID: ENSP00000217909
MATWRRDGRLTGGQRLLCAGLAGTLSLSLTAPLELATVLAQVGVVRGHARGPWATGHRVWRAEGLRALWKGNAVACLRLFPCSAVQLAAYRKFVVLFTDDLGHISQWSSIMAGSLAGMVSTIVTYPTDLIKTRLIMQNILEPSYRGLLHAFSTIYQQEGFLALYRGVSLTVVGALPFSAGSLLVYMNLEKIWNGPRDQFSLPQNFANVCLAAAVTQTLSFPFETVKRKMQAQSPYLPHSGGVDVHFSGAVDCFRQIVKAQGVLGLWNGLTANLLKIVPYFGIMFSTFEFCKRICLYQNGYILSPLSYKLTPGVDQSLQPQELRELKKFFKTRKPKPKKPTL

SEQ ID NO: 81082 - protein, 314 aa, Homo sapiens
  Payload ID: 16159
  Gene Symbol: SLC25A44
  Gene Name: solute carrier family 25, member 44
  Uniprot ID: Q96H78
  ENSP ID: ENSP00000352497
MEDKRNIQIIEWEHLDKKKFYVFGVAMTMMIRVSVYPFTLIRTRLQVQKGKSLYHGTFDAFIKILRADGITGLYRGFLVNTFTLISGQCYVTTYELTRKFVADYSQSNTVKSLVAGGSASLVAQSITVPIDVVSQHLMMQRKGEKMGRFQVRGNPEGQGVVAFGQTKDIIRQILQADGLRGFYRGYVASLLTYIPNSAVWWPFYHFYAEQLSYLCPKECPHIVFQAVSGPLAAATASILTNPMDVIRTRVQVEGKNSIILTFRQLMAEEGPWGLMKGLSARIISATPSTIVIVVGYESLKKLSLRPELVDSRHW

SEQ ID NO: 81083 - protein, 322 aa, Homo sapiens
  Payload ID: 16159
  Gene Symbol: SLC25A44
  Gene Name: solute carrier family 25, member 44
  ENSP ID: ENSP00000407560
MEDKRNIQIIEWEHLDKKKFYVFGVAMTMMIRVSVYPFTLIRTRLQVQKGKSLYHGTFDAFIKILRADGITGLYRGFLVNTFTLISGQCYVTTYELTRKFVADYSQSNTVKSLVAGGSASLVAQSITVPIDVVSQHLMMQRKGEKMGRFQVRGNPEGQGVVAFGQTKDIIRQILQADGLRGFYRGYVASLLTYIPNSAVWWPFYHFYAAIVFPWIPEQLSYLCPKECPHIVFQAVSGPLAAATASILTNPMDVIRTRVQVEGKNSIILTFRQLMAEEGPWGLMKGLSARIISATPSTIVIVVGYESLKKLSLRPELVDSRHW

SEQ ID NO: 81084 - protein, 246 aa, Homo sapiens
  Payload ID: 16160
  Gene Symbol: SLC25A45
  Gene Name: solute carrier family 25, member 45
  Uniprot ID: Q8N413
  ENSP ID: ENSP00000294187
MVKIYRHESLLGFFKGMSFPIASIAVVNSVLFGVYSNTLLVLTATSHQERRAQPPSYMHIFLAGCTGGFLQAYCLAPFDLIKVRLQNQTEPRAQPGSPPPRYQGPVHCAASIFREEGPRGLFRGAWALTLRDTPTVGIYFITYEGLCRQYTPEGQNPSSATVLVAGGFAGIASWVAATPLDMIKSRMQMDGLRRRVYQGMLDCMVSSIRQEGLGVFFRGVTINSARAFPVNAVTFLSYEYLLRWWG

SEQ ID NO: 81085 - protein, 288 aa, Homo sapiens
  Payload ID: 16160
  Gene Symbol: SLC25A45
  Gene Name: solute carrier family 25, member 45
  Uniprot ID: Q8N413
  ENSP ID: ENSP00000381782
MPVEEFVAGWISGALGLVLGHPFDTVKVRLQTQTTYRGIVDCMVKIYRHESLLGFFKGMSFPIASIAVVNSVLFGVYSNTLLVLTATSHQERRAQPPSYMHIFLAGCTGGFLQAYCLAPFDLIKVRLQNQTEPRAQPGSPPPRYQGPVHCAASIFREEGPRGLFRGAWALTLRDTPTVGIYFITYEGLCRQYTPEGQNPSSATVLVAGGFAGIASWVAATPLDMIKSRMQMDGLRRRVYQGMLDCMVSSIRQEGLGVFFRGVTINSARAFPVNAVTFLSYEYLLRWWG

SEQ ID NO: 81086 - protein, 118 aa, Homo sapiens
  Payload ID: 16160
  Gene Symbol: SLC25A45
  Gene Name: solute carrier family 25, member 45
  ENSP ID: ENSP00000431642
MPVEEFVAGWISGALGLVLGHPFDTVKVRLQTQTTYRGIVDCMVKIYRHESLLGFFKGMSFPIASIAVVNSVLFGVYSNTLLVLTATSHQERRAQPPSYMHIFLAGCTGGFLQAYCLA

SEQ ID NO: 81087 - protein, 264 aa, Homo sapiens
  Payload ID: 16160
  Gene Symbol: SLC25A45
  Gene Name: solute carrier family 25, member 45
  Uniprot ID: Q8N413
  ENSP ID: ENSP00000431769
MPVEEFVAGWISGALGLVLGHPFDTVKLLGFFKGMSFPIASIAVVNSVLFGVYSNTLLVLTATSHQERRAQPPSYMHIFLAGCTGGFLQAYCLAPFDLIKVRLQNQTEPRAQPGSPPPRYQGPVHCAASIFREEGPRGLFRGAWALTLRDTPTVGIYFITYEGLCRQYTPEGQNPSSATVLVAGGFAGIASWVAATPLDMIKSRMQMDGLRRRVYQGMLDCMVSSIRQEGLGVFFRGVTINSARAFPVNAVTFLSYEYLLRWWG

SEQ ID NO: 81088 - protein, 36 aa, Homo sapiens
  Payload ID: 16160
  Gene Symbol: SLC25A45
  Gene Name: solute carrier family 25, member 45
  ENSP ID: ENSP00000431891
MPVEEFVAGWISGETFFFLLSHHTQWRSGLGPGTPV

SEQ ID NO: 81089 - protein, 47 aa, Homo sapiens
  Payload ID: 16160
  Gene Symbol: SLC25A45
  Gene Name: solute carrier family 25, member 45
  ENSP ID: ENSP00000433693
MPVEEFVAGWISGETFFFLLSHHTQWALQFCVASWQQGLLWIPATTL

SEQ ID NO: 81090 - protein, 36 aa, Homo sapiens; identical to SEQ ID NO: 81088
  Payload ID: 16160
  Gene Symbol: SLC25A45
  Gene Name: solute carrier family 25, member 45
  ENSP ID: ENSP00000433729

SEQ ID NO: 81091 - protein, 47 aa, Homo sapiens; identical to SEQ ID NO: 81089
  Payload ID: 16160
  Gene Symbol: SLC25A45
  Gene Name: solute carrier family 25, member 45
  ENSP ID: ENSP00000434582

SEQ ID NO: 81092 - protein, 50 aa, Homo sapiens
  Payload ID: 16160
  Gene Symbol: SLC25A45
  Gene Name: solute carrier family 25, member 45
  ENSP ID: ENSP00000435000
MPVEEFVAGWISGETFFFLLSHHTQCSAWPAGSRACSGSRRRHYELKKEE

SEQ ID NO: 81093 - protein, 288 aa, Homo sapiens; identical to SEQ ID NO: 81085
  Payload ID: 16160
  Gene Symbol: SLC25A45
  Gene Name: solute carrier family 25, member 45
  Uniprot ID: Q8N413
  ENSP ID: ENSP00000435489

SEQ ID NO: 81094 - protein, 226 aa, Homo sapiens
  Payload ID: 16160
  Gene Symbol: SLC25A45
  Gene Name: solute carrier family 25, member 45
  ENSP ID: ENSP00000435547
MPVEEFVAGWISGALGLVLGHPFDTVKVRLQTQTTYRGIVDCMVKIYRHESAYCLAPFDLIKVRLQNQTEPRAQPGSPPPRYQGPVHCAASIFREEGPRGLFRGAWALTLRDTPTVGIYFITYEGLCRQYTPEGQNPSSATVLVAGGFAGIASWVAATPLDMIKSRMQMDGLRRRVYQGMLDCMVSSIRQEGLGVFFRGVTINSARAFPVNAVTFLSYEYLLRWWG

SEQ ID NO: 81095 - protein, 418 aa, Homo sapiens
  Payload ID: 16161
  Gene Symbol: SLC25A46
  Gene Name: solute carrier family 25, member 46
  Uniprot ID: Q96AG3
  ENSP ID: ENSP00000348211
MHPRRPDGFDGLGYRGGARDEQGFGGAFPARSFSTGSDLGHWVTTPPDIPGSRNLHWGEKSPPYGVPTTSTPYEGPTEEPFSSGGGGSVQGQSSEQLNRFAGFGIGLASLFTENVLAHPCIVLRRQCQVNYHAQHYHLTPFTVINIMYSFNKTQGPRALWKGMGSTFIVQGVTLGAEGIISEFTPLPREVLHKWSPKQIGEHLLLKSLTYVVAMPFYSASLIETVQSEIIRDNTGILECVKEGIGRVIGMGVPHSKRLLPLLSLIFPTVLHGVLHYIISSVIQKFVLLILKRKTYNSHLAESTSPVQSMLDAYFPELIANFAASLCSDVILYPLETVLHRLHIQGTRTIIDNTDLGYEVLPINTQYEGMRDCINTIRQEEGVFGFYKGFGAVIIQYTLHAAVLQITKIIYSTLLQNNI

SEQ ID NO: 81096 - protein, 337 aa, Homo sapiens
  Payload ID: 16161
  Gene Symbol: SLC25A46
  Gene Name: solute carrier family 25, member 46
  Uniprot ID: Q96AG3
  ENSP ID: ENSP00000399717
MHPRRPDGFDGLGYRGGARDEQGFGGAFPARSFSTGSDLGHWVTTPPDIPGSRNLHWGEKSPPYGVPTTSTPYEGPTEEPFSSGGGGSVQGQSSEQLNRFAGFGIGLASLFTENVLAHPCIVLRRQCQVNYHAQHYHLTPFTVINIMYSFNKTQGPRALWKGMGSTFIVQGVTLGAEGIISEFTPLPREVLHKWSPKQIGEHLLLKSLTYVVAMPFYSASLIETVQSMLDAYFPELIANFAASLCSDVILYPLETVLHRLHIQGTRTIIDNTDLGYEVLPINTQYEGMRDCINTIRQEEGVFGFYKGFGAVIIQYTLHAAVLQITKIIYSTLLQNNI

SEQ ID NO: 81097 - protein, 256 aa, Homo sapiens
  Payload ID: 16161
  Gene Symbol: SLC25A46
  Gene Name: solute carrier family 25, member 46
  ENSP ID: ENSP00000421134
MGSTFIVQGVTLGAEGIISEFTPLPREVLHKWSPKQIGEHLLLKSLTYVVAMPFYSASLIETVQSEIIRDNTGILECVKEGIGRVIGMGVPHSKRLLPLLSLIFPTVLHGVLHYIISSVIQKFVLLILKRKTYNSHLAESTSPVQSMLDAYFPELIANFAASLCSDVILYPLETVLHRLHIQGTRTIIDNTDLGYEVLPINTQYEGMRDCINTIRQEEGVFGFYKGFGAVIIQYTLHAAVLQITKIIYSTLLQNNI

SEQ ID NO: 81098 - protein, 272 aa, Homo sapiens
  Payload ID: 16161
  Gene Symbol: SLC25A46
  Gene Name: solute carrier family 25, member 46
  Uniprot ID: Q96AG3
  ENSP ID: ENSP00000425708
MYSFNKTQGPRALWKGMGSTFIVQGVTLGAEGIISEFTPLPREVLHKWSPKQIGEHLLLKSLTYVVAMPFYSASLIETVQSEIIRDNTGILECVKEGIGRVIGMGVPHSKRLLPLLSLIFPTVLHGVLHYIISSVIQKFVLLILKRKTYNSHLAESTSPVQSMLDAYFPELIANFAASLCSDVILYPLETVLHRLHIQGTRTIIDNTDLGYEVLPINTQYEGMRDCINTIRQEEGVFGFYKGFGAVIIQYTLHAAVLQITKIIYSTLLQNNI

SEQ ID NO: 81099 - protein, 205 aa, Homo sapiens
  Payload ID: 16161
  Gene Symbol: SLC25A46
  Gene Name: solute carrier family 25, member 46
  ENSP ID: ENSP00000426604
MPFYSASLIETVQSEIIRDNTGILECVKEGIGRVIGMGVPHSKRLLPLLSLIFPTVLHGVLHYIISSVIQKFVLLILKRKTYNSHLAESTSPVQSMLDAYFPELIANFAASLCSDVILYPLETVLHRLHIQGTRTIIDNTDLGYEVLPINTQYEGMRDCINTIRQEEGVFGFYKGFGAVIIQYTLHAAVLQITKIIYSTLLQNNI

SEQ ID NO: 81100 - protein, 308 aa, Homo sapiens
  Payload ID: 16162
  Gene Symbol: SLC25A47
  Gene Name: solute carrier family 25, member 47
  Uniprot ID: Q6Q0C1
  ENSP ID: ENSP00000354886
MDFVAGAIGGVCGVAVGYPLDTVKVRIQTEPKYTGIWHCVRDTYHRERVWGFYRGLSLPVCTVSLVSSVSFGTYRHCLAHICRLRYGNPDAKPTKADITLSGCASGLVRVFLTSPTEVAKVRLQTQTQAQKQQRRLSASGPLAVPPMCPVPPACPEPKYRGPLHCLATVAREEGLCGLYKGSSALVLRDGHSFATYFLSYAVLCEWLSPAGHSRPDVPGVLVAGGCAGVLAWAVATPMDVIKSRLQADGQGQRRYRGLLHCMVTSVREEGPRVLFKGLVLNCCRAFPVNMVVFVAYEAVLRLARGLLT

SEQ ID NO: 81101 - protein, 162 aa, Homo sapiens
  Payload ID: 16162
  Gene Symbol: SLC25A47
  Gene Name: solute carrier family 25, member 47
  ENSP ID: ENSP00000451078
MCPVPPACPEPKYRGPLHCLATVAREEGLCGLYKGSSALVLRDGHSFATYFLSYAVLCEWLSPAGHSRPDVPGVLVAGGCAGVLAWAVATPMDVIKSRLQADGQGQRRYRGLLHCMVTSVREEGPRVLFKGLVLNCCRAFPVNMVVFVAYEAVLRLARGLLT

SEQ ID NO: 81102 - protein, 291 aa, Homo sapiens
  Payload ID: 16163
  Gene Symbol: SLC25A48
  Gene Name: solute carrier family 25, member 48
  Uniprot ID: Q6ZT89
  ENSP ID: ENSP00000274513
MGSFQLEDFAAGWIGGAASVIVGHPLDTVKTRLQAGVGYGNTLSCIRVVYRRESMFGFFKGMSFPLASIAVYNSVVFGVFSNTQRFLSQHRCGEPEASPPRTLSDLLLASMVAGVVSVGLGGPVDLIKIRLQMQTQPFRDANLGLKSRAVAPAEQPAYQGPVHCITTIVRNEGLAGLYRGASAMLLRDVPGYCLYFIPYVFLSEWITPEACTGPSPCAVWLAGGMAGKGSSSWSRTPVQATAVGQLGNCHALLSPGGGQDTFRYSPNNSLLGTYSVPGPLPPQSHPFPMQL

SEQ ID NO: 81103 - protein, 257 aa, Homo sapiens
  Payload ID: 16163
  Gene Symbol: SLC25A48
  Gene Name: solute carrier family 25, member 48
  ENSP ID: ENSP00000399834
MFGFFKGMSFPLASIAVYNSVVFGVFSNTQRFLSQHRCGEPEASPPRTLSDLLLASMVAGVVSVGLGGPVDLIKIRLQMQTQPFRDANLGLKSRAVAPAEQPAYQGPVHCITTIVRNEGLAGLYRGASAMLLRDVPGYCLYFIPYVFLSEWITPEACTGPSPCAVWLAGGMAGAISWGTATPMDVVKSRLQADGVYLNKYKGVLDCISQSYQKEGLKVFFRGITVNAVRGFPMSAAMFLGYELSLQAIRGDHAVTSP

SEQ ID NO: 81104 - protein, 71 aa, Homo sapiens
  Payload ID: 16163
  Gene Symbol: SLC25A48
  Gene Name: solute carrier family 25, member 48
  ENSP ID: ENSP00000408750
MGSFQLEDFAAGWIGGAASVIVGHPLDTVKTRLQAGVGYGNTLSCIRVEAASNTFPWAVSPLFFLQLKSLT

SEQ ID NO: 81105 - protein, 157 aa, Homo sapiens
  Payload ID: 16163
  Gene Symbol: SLC25A48
  Gene Name: solute carrier family 25, member 48
  Uniprot ID: Q6ZT89
  ENSP ID: ENSP00000413049
MGSFQLEDFAAGWIGGAASVIVGHPLDTVKTRLQAGVGYGNTLSCIRVVYRRESMFGFFKGMSFPLASIAVYNSVVFGVFSNTQRFLSQHRCGEPEASPPRTLSDLLLASMVAGVVSVGLGGPVDLIKIRLQMQTQPFRDGGEHRMTTVFPGPHLCM

SEQ ID NO: 81106 - protein, 67 aa, Homo sapiens
  Payload ID: 16163
  Gene Symbol: SLC25A48
  Gene Name: solute carrier family 25, member 48
  ENSP ID: ENSP00000421427
MRCSQCHRWPPSGHSQDSPAGWRWLRKHPQLHPRGVQEGEYVRLLQGHVLPPRQHCRLQLRGVWGLQ

SEQ ID NO: 81107 - protein, 297 aa, Homo sapiens
  Payload ID: 16164
  Gene Symbol: SLC25A51
  Gene Name: solute carrier family 25, member 51
  Uniprot ID: Q9H1U9
  ENSP ID: ENSP00000242275
MMDSEAHEKRPPILTSSKQDISPHITNVGEMKHYLCGCCAAFNNVAITFPIQKVLFRQQLYGIKTRDAILQLRRDGFRNLYRGILPPLMQKTTTLALMFGLYEDLSCLLHKHVSAPEFATSGVAAVLAGTTEAIFTPLERVQTLLQDHKHHDKFTNTYQAFKALKCHGIGEYYRGLVPILFRNGLSNVLFFGLRGPIKEHLPTATTHSAHLVNDFICGGLLGAMLGFLFFPINVVKTRIQSQIGGEFQSFPKVFQKIWLERDRKLINLFRGAHLNYHRSLISWGIINATYEFLLKVI

SEQ ID NO: 81108 - protein, 297 aa, Homo sapiens; identical to SEQ ID NO: 81107
  Payload ID: 16164
  Gene Symbol: SLC25A51
  Gene Name: solute carrier family 25, member 51
  Uniprot ID: Q9H1U9
  ENSP ID: ENSP00000366945

SEQ ID NO: 81109 - protein, 297 aa, Homo sapiens; identical to SEQ ID NO: 81107
  Payload ID: 16164
  Gene Symbol: SLC25A51
  Gene Name: solute carrier family 25, member 51
  Uniprot ID: Q9H1U9
  ENSP ID: ENSP00000369964

SEQ ID NO: 81110 - protein, 307 aa, Homo sapiens
  Payload ID: 16165
  Gene Symbol: SLC25A52
  Gene Name: solute carrier family 25, member 52
  ENSP ID: ENSP00000372612
MPFMRKILSNMIDSEAHEKRPPILTSSKQDISPHITNVGEMKHYLCGCCAAFNNVAITYPIQKVLFRQQLYGIKTRDAVLQLRRDGFRNLYRGILPPLMQKTTTLALMFGLYEDLSCLLRKHVRAPEFATHGVAAVLAGTAEAIFTPLERVQTLLQNHKHHDKFTNTYQAFKALKCHGIGEYYRGLVPILFRNGLSNVLFFGLRGPIKEHLPTATTHSAHLVNDFIGGGLLGAMLGFLCFPINVVKTRLQSQIGGEFQSFPKVFQKIWLERDRKLINLFRGAHLNYHRSLISWGIINATYEFLLKFI

SEQ ID NO: 81111 - protein, 307 aa, Homo sapiens
  Payload ID: 16166
  Gene Symbol: SLC25A53
  Gene Name: solute carrier family 25, member 53
  Uniprot ID: Q5H9E4
  ENSP ID: ENSP00000468980
MGEQNHSPGKELQHRTRAEAPGKKSWHSQAYALGAVSNFMSTFLTFPIYKVVFRQQIHAMAVSEAVRQLWHEGPQYFYRGIYPPLLSKTLQGTLLFGTYDSLLCFLSPVGPHTLGHRWAAGLMSGVVEAVALSPFERVQNVLQDGRKQARFPSTFSILKEFNSYGLWGRLSLGYYRGFWPVLARNSLGSALYFSFKDPIQDGLAEQGLPHWVPALVSGSVNGTITCLVLYPLIVLVANMQSHIGWQNMPSLWASAQDVWNTRGRKLLLIYRGGSLVILRSSVTWGLTTAIHDFLQRKSHSRKELKTD

SEQ ID NO: 81112 - protein, 701 aa, Homo sapiens
  Payload ID: 16167
  Gene Symbol: SLC26A1
  Gene Name: solute carrier family 26 (anion exchanger), member 1
  Uniprot ID: Q9H2B4
  ENSP ID: ENSP00000354721
MDESPEPLQQGRGPVPVRRQRPAPRGLREMLKARLWCSCSCSVLCVRALVQDLLPATRWLRQYRPREYLAGDVMSGLVIGIILVPQAIAYSLLAGLQPIYSLYTSFFANLIYFLMGTSRHVSVGIFSLLCLMVGQVVDRELQLAGFDPSQDGLQPGANSSTLNGSAAMLDCGRDCYAIRVATALTLMTGLYQVLMGVLRLGFVSAYLSQPLLDGFAMGASVTILTSQLKHLLGVRIPRHQGPGMVVLTWLSLLRGAGQANVCDVVTSTVCLAVLLAAKELSDRYRHRLRVPLPTELLVIVVATLVSHFGQLHKRFGSSVAGDIPTGFMPPQVPEPRLMQRVALDAVALALVAAAFSISLAEMFARSHGYSVRANQELLAVGCCNVLPAFLHCFATSAALAKSLVKTATGCRTQLSSVVSATVVLLVLLALAPLFHDLQRSVLACVIVVSLRGALRKVWDLPRLWRMSPADALVWAGTAATCMLVSTEAGLLAGVILSLLSLAGRTQRPRTALLARIGDTAFYEDATEFEGLVPEPGVRVFRFGGPLYYANKDFFLQSLYSLTGLDAGCMAARRKEGGSETGVGEGGPAQGEDLGPVSTRAALVPAAAGFHTVVIDCAPLLFLDAAGVSTLQDLRRDYGALGISLLLACCSPPVRDILSRGGFLGEGPGDTAEEEQLFLSVHDAVQTARARHRELEATDAHL

SEQ ID NO: 81113 - protein, 701 aa, Homo sapiens; identical to SEQ ID NO: 81112
  Payload ID: 16167
  Gene Symbol: SLC26A1
  Gene Name: solute carrier family 26 (anion exchanger), member 1
  Uniprot ID: Q9H2B4
  ENSP ID: ENSP00000381528

SEQ ID NO: 81114 - protein, 224 aa, Homo sapiens
  Payload ID: 16167
  Gene Symbol: SLC26A1
  Gene Name: solute carrier family 26 (anion exchanger), member 1
  Uniprot ID: Q9H2B4
  ENSP ID: ENSP00000381532
MDESPEPLQQGRGPVPVRRQRPAPRGLREMLKARLWCSCSCSVLCVRALVQDLLPATRWLRQYRPREYLAGDVMSGLVIGIILVPQAIAYSLLAGLQPIYSLYTSFFANLIYFLMGTSRHVSVGIFSLLCLMVGQVVDRELQLAGFDPSQDGLQPGANSSTLNGSAAMLDCGRDCYAIRVATALTLMTGLYQTSWGRNSFQQHPWQLTQRSDSQELLEEEERSC

SEQ ID NO: 81115 - protein, 224 aa, Homo sapiens; identical to SEQ ID NO: 81114
  Payload ID: 16167
  Gene Symbol: SLC26A1
  Gene Name: solute carrier family 26 (anion exchanger), member 1
  Uniprot ID: Q9H2B4
  ENSP ID: ENSP00000483506

SEQ ID NO: 81116 - protein, 606 aa, Homo sapiens
  Payload ID: 16168
  Gene Symbol: SLC26A11
  Gene Name: solute carrier family 26 (anion exchanger), member 11
  Uniprot ID: Q86WA9
  ENSP ID: ENSP00000355384
MPSSVTALGQARSSGPGMAPSACCCSPAALQRRLPILAWLPSYSLQWLKMDFVAGLSVGLTAIPQALAYAEVAGLPPQYGLYSAFMGCFVYFFLGTSRDVTLGPTAIMSLLVSFYTFHEPAYAVLLAFLSGCIQLAMGVLRLGFLLDFISYPVIKGFTSAAAVTIGFGQIKNLLGLQNIPRPFFLQVYHTFLRIAETRVGDAVLGLVCMLLLLVLKLMRDHVPPVHPEMPPGVRLSRGLVWAATTARNALVVSFAALVAYSFEVTGYQPFILTGETAEGLPPVRIPPFSVTTANGTISFTEMVQDMGAGLAVVPLMGLLESIAVAKAFASQNNYRIDANQELLAIGLTNMLGSLVSSYPVTGSFGRTAVNAQSGVCTPAGGLVTGVLVLLSLDYLTSLFYYIPKSALAAVIIMAVAPLFDTKIFRTLWRVKRLDLLPLCVTFLLCFWEVQYGILAGALVSLLMLLHSAARPETKVSEGPVLVLQPASGLSFPAMEALREEILSRALEVSPPRCLVLECTHVCSIDYTVVLGLGELLQDFQKQGVALAFVGLQVPVLRVLLSADLKGFQYFSTLEEAEKHLRQEPGTQPYNIREDSILDQKVALLKA

SEQ ID NO: 81117 - protein, 606 aa, Homo sapiens; identical to SEQ ID NO: 81116
  Payload ID: 16168
  Gene Symbol: SLC26A11
  Gene Name: solute carrier family 26 (anion exchanger), member 11
  Uniprot ID: Q86WA9
  ENSP ID: ENSP00000403998

SEQ ID NO: 81118 - protein, 606 aa, Homo sapiens; identical to SEQ ID NO: 81116
  Payload ID: 16168
  Gene Symbol: SLC26A11
  Gene Name: solute carrier family 26 (anion exchanger), member 11
  Uniprot ID: Q86WA9
  ENSP ID: ENSP00000440724

SEQ ID NO: 81119 - protein, 197 aa, Homo sapiens
  Payload ID: 16168
  Gene Symbol: SLC26A11
  Gene Name: solute carrier family 26 (anion exchanger), member 11
  ENSP ID: ENSP00000458234
LLLLVLKLMRDHVPPVHPEMPPGVRLSRGLVWAATTARNALVVSFAALVAYSFEVTGYQPFILTGETAEGLPPVRIPPFSVTTANGTISFTEMVQGRFSCFGLQLRMNLPCSSQHLAPLQTRRRILQLTSTCSCYLWGGDMGAGLAVVPLMGLLESIAVAKAFASQNNYRIDANQELLAIGLTNMLGSLVSSYPVTG

SEQ ID NO: 81120 - protein, 153 aa, Homo sapiens
  Payload ID: 16168
  Gene Symbol: SLC26A11
  Gene Name: solute carrier family 26 (anion exchanger), member 11
  ENSP ID: ENSP00000458521
MPSSVTALGQARSSGPGMAPSACCCSPAALQRRLPILAWLPSYSLQWLKMDFVAGLSVGLTAIPQALAYAEVAGLPPQYGLYSAFMGCFVYFFLGTSRDVTLGPTAIMSLLVSFYTFHEPAYAVLLAFLSGCIQLAMGVLRLGFLLDFISYPV

SEQ ID NO: 81121 - protein, 210 aa, Homo sapiens
  Payload ID: 16168
  Gene Symbol: SLC26A11
  Gene Name: solute carrier family 26 (anion exchanger), member 11
  ENSP ID: ENSP00000458831
MPSSVTALGQARSSGPGMAPSACCCSPAALQRRLPILAWLPSYSLQWLKMDFVAGLSVGLTAIPQALAYAEVAGLPPQYGLYSAFMGCFVYFFLGTSRDVTLGPTAIMSLLVSFYTFHEPAYAVLLAFLSGCIQLAMGVLRLGFLLDFISYPVIKGFTSAAAVTIGFGQIKNLLGLQNIPRPFFLQVYHTFLRIAETRVGDAVLGLVCML

SEQ ID NO: 81122 - protein, 58 aa, Homo sapiens
  Payload ID: 16168
  Gene Symbol: SLC26A11
  Gene Name: solute carrier family 26 (anion exchanger), member 11
  ENSP ID: ENSP00000459379
  MOD_RES (1)..(1): Any amino acid
XLLMLLHSAARPETKVSEGPVLVLQPASGLSFPAMEALREEILSRALEGPRSPCPAVR

SEQ ID NO: 81123 - protein, 133 aa, Homo sapiens
  Payload ID: 16168
  Gene Symbol: SLC26A11
  Gene Name: solute carrier family 26 (anion exchanger), member 11
  ENSP ID: ENSP00000459420
MPSSVTALGQARSSGPGMAPSACCCSPAALQRRLPILAWLPSYSLQWLKMDFVAGLSVGLTAIPQALAYAEVAGLPPQGSCWTSFPTPSLKASPLLLPSPSALDRSRTCWDYRTSPGRSSCRCTTPSSGLQRP

SEQ ID NO: 81124 - protein, 606 aa, Homo sapiens; identical to SEQ ID NO: 81116
  Payload ID: 16168
  Gene Symbol: SLC26A11
  Gene Name: solute carrier family 26 (anion exchanger), member 11
  Uniprot ID: Q86WA9
  ENSP ID: ENSP00000459470

SEQ ID NO: 81125 - protein, 64 aa, Homo sapiens
  Payload ID: 16168
  Gene Symbol: SLC26A11
  Gene Name: solute carrier family 26 (anion exchanger), member 11
  ENSP ID: ENSP00000459735
MGCFVYFFLGTSRDVTLGPTAIMSLLVSFYTFHEPAYAVLLAFLSGCIQLAMGVLRLGFLLDFI

SEQ ID NO: 81126 - protein, 77 aa, Homo sapiens
  Payload ID: 16168
  Gene Symbol: SLC26A11
  Gene Name: solute carrier family 26 (anion exchanger), member 11
  ENSP ID: ENSP00000460535
MPSSVTALGQARSSGPGMAPSACCCSPAALQRRLPILAWLPSYSLQWLKMDFVAGLSVGLTAIPQALAYAEVAGLPP

SEQ ID NO: 81127 - protein, 739 aa, Homo sapiens
  Payload ID: 16169
  Gene Symbol: SLC26A2
  Gene Name: solute carrier family 26 (anion exchanger), member 2
  Uniprot ID: P50443
  ENSP ID: ENSP00000286298
MSSESKEQHNVSPRDSAEGNDSYPSGIHLELQRESSTDFKQFETNDQCRPYHRILIERQEKSDTNFKEFVIKKLQKNCQCSPAKAKNMILGFLPVLQWLPKYDLKKNILGDVMSGLIVGILLVPQSIAYSLLAGQEPVYGLYTSFFASIIYFLLGTSRHISVGIFGVLCLMIGETVDRELQKAGYDNAHSAPSLGMVSNGSTLLNHTSDRICDKSCYAIMVGSTVTFIAGVYQVAMGFFQVGFVSVYLSDALLSGFVTGASFTILTSQAKYLLGLNLPRTNGVGSLITTWIHVFRNIHKTNLCDLITSLLCLLVLLPTKELNEHFKSKLKAPIPIELVVVVAATLASHFGKLHENYNSSIAGHIPTGFMPPKVPEWNLIPSVAVDAIAISIIGFAITVSLSEMFAKKHGYTVKANQEMYAIGFCNIIPSFFHCFTTSAALAKTLVKESTGCHTQLSGVVTALVLLLVLLVIAPLFYSLQKSVLGVITIVNLRGALRKFRDLPKMWSISRMDTVIWFVTMLSSALLSTEIGLLVGVCFSIFCVILRTQKPKSSLLGLVEESEVFESVSAYKNLQIKPGIKIFRFVAPLYYINKECFKSALYKQTVNPILIKVAWKKAAKRKIKEKVVTLGGIQDEMSVQLSHDPLELHTIVIDCSAIQFLDTAGIHTLKEVRRDYEAIGIQVLLAQCNPTVRDSLTNGEYCKKEEENLLFYSVYEAMAFAEVSKNQKGVCVPNGLSLSSD

SEQ ID NO: 81128 - protein, 23 aa, Homo sapiens
  Payload ID: 16169
  Gene Symbol: SLC26A2
  Gene Name: solute carrier family 26 (anion exchanger), member 2
  ENSP ID: ENSP00000405496
MSSESKEQHNVSPRDSAEGNDSY

SEQ ID NO: 81129 - protein, 124 aa, Homo sapiens
  Payload ID: 16169
  Gene Symbol: SLC26A2
  Gene Name: solute carrier family 26 (anion exchanger), member 2
  ENSP ID: ENSP00000426053
GDVMSGLIVGILLVPQSIAYSLLAGQEPVYGLYTSFFASIIYFLLGTSRHISVGIFGVLCLMIGETVDRELQKAGYDNAHSAPSLGMVSNGSTLLNHTSDRICDKSCYAIMVGSTVTFIAGVYQ

SEQ ID NO: 81130 - protein, 764 aa, Homo sapiens
  Payload ID: 16170
  Gene Symbol: SLC26A3
  Gene Name: solute carrier family 26 (anion exchanger), member 3
  Uniprot ID: P40879
  ENSP ID: ENSP00000345873
MIEPFGNQYIVARPVYSTNAFEENHKKTGRHHKTFLDHLKVCCSCSPQKAKRIVLSLFPIASWLPAYRLKEWLLSDIVSGISTGIVAVLQGLAFALLVDIPPVYGLYASFFPAIIYLFFGTSRHISVGPFPILSMMVGLAVSGAVSKAVPDRNATTLGLPNNSNNSSLLDDERVRVAAAASVTVLSGIIQLAFGILRIGFVVIYLSESLISGFTTAAAVHVLVSQLKFIFQLTVPSHTDPVSIFKVLYSVFSQIEKTNIADLVTALIVLLVVSIVKEINQRFKDKLPVPIPIEFIMTVIAAGVSYGCDFKNRFKVAVVGDMNPGFQPPITPDVETFQNTVGDCFGIAMVAFAVAFSVASVYSLKYDYPLDGNQELIALGLGNIVCGVFRGFAGSTALSRSAVQESTGGKTQIAGLIGAIIVLIVVLAIGFLLAPLQKSVLAALALGNLKGMLMQFAEIGRLWRKDKYDCLIWIMTFIFTIVLGLGLGLAASVAFQLLTIVFRTQFPKCSTLANIGRTNIYKNKKDYYDMYEPEGVKIFRCPSPIYFANIGFFRRKLIDAVGFSPLRILRKRNKALRKIRKLQKQGLLQVTPKGFICTVDTIKDSDEELDNNQIEVLDQPINTTDLPFHIDWNDDLPLNIEVPKISLHSLILDFSAVSFLDVSSVRGLKSILQEFIRIKVDVYIVGTDDDFIEKLNRYEFFDGEVKSSIFFLTIHDAVLHILMKKDYSTSKFNPSQEKDGKIDFTINTNGGLRNRVYEVPVETKF

SEQ ID NO: 81131 - protein, 52 aa, Homo sapiens
  Payload ID: 16170
  Gene Symbol: SLC26A3
  Gene Name: solute carrier family 26 (anion exchanger), member 3
  ENSP ID: ENSP00000368375
MIEPFGNQYIVARPVYSTNAFEENHKKTGRHHKTFLDHLKVCCSILVASIPA

SEQ ID NO: 81132 - protein, 120 aa, Homo sapiens
  Payload ID: 16170
  Gene Symbol: SLC26A3
  Gene Name: solute carrier family 26 (anion exchanger), member 3
  ENSP ID: ENSP00000395955
MIEPFGNQYIVARPVYSTNAFEENHKKTGRHHKTFLDHLKVCCSCSPQKAKRIVLSLFPIASWLPAYRLKEWLLSDIVSGISTGIVAVLQGLAFALLVDIPPVYGLYASFFPAIIYLFFG

SEQ ID NO: 81133 - protein, 780 aa, Homo sapiens
  Payload ID: 16171
  Gene Symbol: SLC26A4
  Gene Name: solute carrier family 26 (anion exchanger), member 4
  Uniprot ID: O43511
  ENSP ID: ENSP00000265715
MAAPGGRSEPPQLPEYSCSYMVSRPVYSELAFQQQHERRLQERKTLRESLAKCCSCSRKRAFGVLKTLVPILEWLPKYRVKEWLLSDVISGVSTGLVATLQGMAYALLAAVPVGYGLYSAFFPILTYFIFGTSRHISVGPFPVVSLMVGSVVLSMAPDEHFLVSSSNGTVLNTTMIDTAARDTARVLIASALTLLVGIIQLIFGGLQIGFIVRYLADPLVGGFTTAAAFQVLVSQLKIVLNVSTKNYNGVLSIIYTLVEIFQNIGDTNLADFTAGLLTIVVCMAVKELNDRFRHKIPVPIPIEVIVTIIATAISYGANLEKNYNAGIVKSIPRGFLPPELPPVSLFSEMLAASFSIAVVAYAIAVSVGKVYATKYDYTIDGNQEFIAFGISNIFSGFFSCFVATTALSRTAVQESTGGKTQVAGIISAAIVMIAILALGKLLEPLQKSVLAAVVIANLKGMFMQLCDIPRLWRQNKIDAVIWVFTCIVSIILGLDLGLLAGLIFGLLTVVLRVQFPSWNGLGSIPSTDIYKSTKNYKNIEEPQGVKILRFSSPIFYGNVDGFKKCIKSTVGFDAIRVYNKRLKALRKIQKLIKSGQLRATKNGIISDAVSTNNAFEPDEDIEDLEELDIPTKEIEIQVDWNSELPVKVNVPKVPIHSLVLDCGAISFLDVVGVRSLRVIVKEFQRIDVNVYFASLQDYVIEKLEQCGFFDDNIRKDTFFLTVHDAILYLQNQVKSQEGQGSILETITLIQDCKDTLELIETELTEEELDVQDEAMRTLAS

SEQ ID NO: 81134 - protein, 131 aa, Homo sapiens
  Payload ID: 16171
  Gene Symbol: SLC26A4
  Gene Name: solute carrier family 26 (anion exchanger), member 4
  ENSP ID: ENSP00000394760
MAAPGGRSEPPQLPEYSCSYMVSRPVYSELAFQQQHERRLQERKTLRESLAKCCSCSRKRAFGVLKTLVPILEWLPKYRVKEWLLSDVISGVSTGLVATLQGMAYALLAAVPVGYGLYSAFFPILTYFIFG

SEQ ID NO: 81135 - protein, 744 aa, Homo sapiens
  Payload ID: 16172
  Gene Symbol: SLC26A5
  Gene Name: solute carrier family 26 (anion exchanger), member 5
  Uniprot ID: P58743
  ENSP ID: ENSP00000304783
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQAVLSAIVIVNLKGMFMQFSDLPFFWRTSKIELTIWLTTFVSSLFLGLDYGLITAVIIALLTVIYRTQSPSYKVLGKLPETDVYIDIDAYEEVKEIPGIKIFQINAPIYYANSDLYSNALKRKTGVNPAVIMGARRKAMRKYAKEVGNANMANATVVKADAEVDGEDATKPEEEDGEVKYPPIVIKSTFPEEMQRFMPPGDNVHTVILDFTQVNFIDSVGVKTLAGIVKEYGDVGIYVYLAGCSAQVVNDLTRNRFFENPALWELLFHSIHDAVLGSQLREALAEQEASAPPSQEDLEPNATPATPEA

SEQ ID NO: 81136 - protein, 685 aa, Homo sapiens
  Payload ID: 16172
  Gene Symbol: SLC26A5
  Gene Name: solute carrier family 26 (anion exchanger), member 5
  Uniprot ID: P58743
  ENSP ID: ENSP00000342396
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQAVLSAIVIVNLKGMFMQFSDLPFFWRTSKIELTIWLTTFVSSLFLGLDYGLITAVIIALLTVIYRTQSPSYKVLGKLPETDVYIDIDAYEEVKEIPGIKIFQINAPIYYANSDLYSNALKRKTGVNPAVIMGARRKAMRKYAKEVGNANMANATVVKADAEVDGEDATKPEEEDGEVKYPPIVIKSTFPEEMQRFMPPGDNVHTVILDFTQVNFIDSVGVKTLAGIVKEYGDVGIYVYLAGCSAFIQR

SEQ ID NO: 81137 - protein, 746 aa, Homo sapiens
  Payload ID: 16172
  Gene Symbol: SLC26A5
  Gene Name: solute carrier family 26 (anion exchanger), member 5
  ENSP ID: ENSP00000346325
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQAVLSAIVIVNLKGMFMQFSDLPFFWRTSKIELTIWLTTFVSSLFLGLDYGLITAVIIALLTVIYRTQSPSYKVLGKLPETDVYIDIDAYEEVKEIPGIKIFQINAPIYYANSDLYSNALKRKTGVNPAVIMGARRKAMRKYAKEVGNANMANATVVKATQDAEVDGEDATKPEEEDGEVKYPPIVIKSTFPEEMQRFMPPGDNVHTVILDFTQVNFIDSVGVKTLAGIVKEYGDVGIYVYLAGCSAQVVNDLTRNRFFENPALWELLFHSIHDAVLGSQLREALAEQEASAPPSQEDLEPNATPATPEA

SEQ ID NO: 81138 - protein, 335 aa, Homo sapiens
  Payload ID: 16172
  Gene Symbol: SLC26A5
  Gene Name: solute carrier family 26 (anion exchanger), member 5
  Uniprot ID: P58743
  ENSP ID: ENSP00000349210
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGFHTEMTRRWRP

SEQ ID NO: 81139 - protein, 714 aa, Homo sapiens
  Payload ID: 16172
  Gene Symbol: SLC26A5
  Gene Name: solute carrier family 26 (anion exchanger), member 5
  Uniprot ID: P58743
  ENSP ID: ENSP00000377324
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQTIWLTTFVSSLFLGLDYGLITAVIIALLTVIYRTQSPSYKVLGKLPETDVYIDIDAYEEVKEIPGIKIFQINAPIYYANSDLYSNALKRKTGVNPAVIMGARRKAMRKYAKEVGNANMANATVVKATQDAEVDGEDATKPEEEDGEVKYPPIVIKSTFPEEMQRFMPPGDNVHTVILDFTQVNFIDSVGVKTLAGIVKEYGDVGIYVYLAGCSAQVVNDLTRNRFFENPALWELLFHSIHDAVLGSQLREALAEQEASAPPSQEDLEPNATPATPEA

SEQ ID NO: 81140 - protein, 746 aa, Homo sapiens; identical to SEQ ID NO: 81137
  Payload ID: 16172
  Gene Symbol: SLC26A5
  Gene Name: solute carrier family 26 (anion exchanger), member 5
  ENSP ID: ENSP00000377328

SEQ ID NO: 81141 - protein, 707 aa, Homo sapiens
  Payload ID: 16172
  Gene Symbol: SLC26A5
  Gene Name: solute carrier family 26 (anion exchanger), member 5
  ENSP ID: ENSP00000377330
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQAVLSAIVIVNLKGMFMQFSDLPFFWRTSKIELTIWLTTFVSSLFLGLDYGLITAVIIALLTVIYRTQSPSYKVLGKLPETDVYIDIDAYEEVKEIPGIKIFQINAPIYYANSDLYSNALKRKTGVNPAVIMGARRKAMRKYAKEVGNANMANATVVKADAEVDGEDATKPEEEDGEVKYPPIVIKSTFPEEMQRFMPPGDNVHTVILDFTQVNFIDSVGVKTLAGIVKEYGDVGIYVYLAGCSAQVVNDLTRNRFFENPALWELLFHSIHDAVLGSQLREALAEQEASAPPSQEDLEPNATPATPEA

SEQ ID NO: 81142 - protein, 712 aa, Homo sapiens
  Payload ID: 16172
  Gene Symbol: SLC26A5
  Gene Name: solute carrier family 26 (anion exchanger), member 5
  Uniprot ID: P58743
  ENSP ID: ENSP00000377331
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQTIWLTTFVSSLFLGLDYGLITAVIIALLTVIYRTQSPSYKVLGKLPETDVYIDIDAYEEVKEIPGIKIFQINAPIYYANSDLYSNALKRKTGVNPAVIMGARRKAMRKYAKEVGNANMANATVVKADAEVDGEDATKPEEEDGEVKYPPIVIKSTFPEEMQRFMPPGDNVHTVILDFTQVNFIDSVGVKTLAGIVKEYGDVGIYVYLAGCSAQVVNDLTRNRFFENPALWELLFHSIHDAVLGSQLREALAEQEASAPPSQEDLEPNATPATPEA

SEQ ID NO: 81143 - protein, 516 aa, Homo sapiens
  Payload ID: 16172
  Gene Symbol: SLC26A5
  Gene Name: solute carrier family 26 (anion exchanger), member 5
  Uniprot ID: P58743
  ENSP ID: ENSP00000377336
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQAVLSAIVIVNLKGMFMQFSDLPFFWRTSKIELTIWLTTFVSSLFLGLDYGLITAVIIALLTVIYRTQSFHTEMTRRWRP

SEQ ID NO: 81144 - protein, 473 aa, Homo sapiens
  Payload ID: 16172
  Gene Symbol: SLC26A5
  Gene Name: solute carrier family 26 (anion exchanger), member 5
  ENSP ID: ENSP00000389018
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQTIWLTTFVSSLFLGLDYGLITAVIIALLTVIYRTQR

SEQ ID NO: 81145 - protein, 712 aa, Homo sapiens; identical to SEQ ID NO: 81142
  Payload ID: 16172
  Gene Symbol: SLC26A5
  Gene Name: solute carrier family 26 (anion exchanger), member 5
  Uniprot ID: P58743
  ENSP ID: ENSP00000389733

SEQ ID NO: 81146 - protein, 211 aa, Homo sapiens
  Payload ID: 16172
  Gene Symbol: SLC26A5
  Gene Name: solute carrier family 26 (anion exchanger), member 5
  ENSP ID: ENSP00000395568
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYASG

SEQ ID NO: 81147 - protein, 248 aa, Homo sapiens
  Payload ID: 16172
  Gene Symbol: SLC26A5
  Gene Name: solute carrier family 26 (anion exchanger), member 5
  ENSP ID: ENSP00000396833
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYASG

SEQ ID NO: 81148 - protein, 447 aa, Homo sapiens
  Payload ID: 16172
  Gene Symbol: SLC26A5
  Gene Name: solute carrier family 26 (anion exchanger), member 5
  ENSP ID: ENSP00000416502
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQTIWLTTFVSSLFLGLDYGLITAVIIALLTVIYRTQR

SEQ ID NO: 81149 - protein, 120 aa, Homo sapiens
  Payload ID: 16173
  Gene Symbol: SLC26A6
  Gene Name: solute carrier family 26 (anion exchanger), member 6
  ENSP ID: ENSP00000307089
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQDLLSRPALLPFYP

SEQ ID NO: 81150 - protein, 651 aa, Homo sapiens
  Payload ID: 16173
  Gene Symbol: SLC26A6
  Gene Name: solute carrier family 26 (anion exchanger), member 6
  ENSP ID: ENSP00000337648
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAASPKGASVSINVNTSLEDMRSNNVEDCKMMVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 81151 - protein, 738 aa, Homo sapiens
  Payload ID: 16173
  Gene Symbol: SLC26A6
  Gene Name: solute carrier family 26 (anion exchanger), member 6
  ENSP ID: ENSP00000351597
MDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVGTFAVMSVMVGSVTESLAPQALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAASPKGASVSINVNTSLEDMRSNNVEDCKMMQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 81152 - protein, 740 aa, Homo sapiens
  Payload ID: 16173
  Gene Symbol: SLC26A6
  Gene Name: solute carrier family 26 (anion exchanger), member 6
  Uniprot ID: Q9BXS9
  ENSP ID: ENSP00000373239
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVGTFAVMSVMVGSVTESLAPQALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAGPLLSACLAPQQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 81153 - protein, 759 aa, Homo sapiens
  Payload ID: 16173
  Gene Symbol: SLC26A6
  Gene Name: solute carrier family 26 (anion exchanger), member 6
  Uniprot ID: Q9BXS9
  ENSP ID: ENSP00000378920
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVGTFAVMSVMVGSVTESLAPQALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAASPKGASVSINVNTSLEDMRSNNVEDCKMMQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 81154 - protein, 88 aa, Homo sapiens
  Payload ID: 16173
  Gene Symbol: SLC26A6
  Gene Name: solute carrier family 26 (anion exchanger), member 6
  ENSP ID: ENSP00000387532
ARAYALLLQHLPVLVWLPRYPVRDWLLGDLLSGLSVAIMQLPQGLAYALLAGLPPVFGLYSSFYPVFIYFLFGTSRHISVGLERLHDQ

SEQ ID NO: 81155 - protein, 194 aa, Homo sapiens
  Payload ID: 16173
  Gene Symbol: SLC26A6
  Gene Name: solute carrier family 26 (anion exchanger), member 6
  ENSP ID: ENSP00000388721
  MOD_RES (1)..(1): Any amino acid
XGGLHTQCPGWPLPGGAGPDPLRLRGHLPVRTSCPRLYHSCSCAGLRLTAQVCVWPPSEQPLWATVPHLLLEVCWKLPQSKVGTVVTAAVAGVVLVVVKLLNDKLQQQLPMPIPGELLTLIGATGISYGMGLKHRFEAGAPSGPQHPAVLKARGQRLHHRCGWVCHCHLTGEDLRPEARLPGGQQPGAGGPGPQ

SEQ ID NO: 81156 - protein, 303 aa, Homo sapiens
  Payload ID: 16173
  Gene Symbol: SLC26A6
  Gene Name: solute carrier family 26 (anion exchanger), member 6
  ENSP ID: ENSP00000389922
GSVTESLAPQALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVV

SEQ ID NO: 81157 - protein, 723 aa, Homo sapiens
  Payload ID: 16173
  Gene Symbol: SLC26A6
  Gene Name: solute carrier family 26 (anion exchanger), member 6
  Uniprot ID: Q9BXS9
  ENSP ID: ENSP00000401066
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVATPGPLPLLTAPGRPTGGAGPDPLRLRGHLPVRTSCPRLYHSCSCAGLRLTAQVCVWPPSEQPLWATVPHLLLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAASPKGASVSINVNTSLEDMRSNNVEDCKMMQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 81158 - protein, 180 aa, Homo sapiens
  Payload ID: 16173
  Gene Symbol: SLC26A6
  Gene Name: solute carrier family 26 (anion exchanger), member 6
  ENSP ID: ENSP00000401813
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVGGAGPDPLRLRGHLPVRTSCPRLYHSCSCAGLRLTA

SEQ ID NO: 81159 - protein, 217 aa, Homo sapiens
  Payload ID: 16173
  Gene Symbol: SLC26A6
  Gene Name: solute carrier family 26 (anion exchanger), member 6
  ENSP ID: ENSP00000404607
ALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEVDVVGNIPAGGPQHPAVLKARGQRLHHRCGWVCHCHLTGEDLRPEARLPGGQQPGAGGPGPQ

SEQ ID NO: 81160 - protein, 758 aa, Homo sapiens
  Payload ID: 16173
  Gene Symbol: SLC26A6
  Gene Name: solute carrier family 26 (anion exchanger), member 6
  Uniprot ID: Q9BXS9
  ENSP ID: ENSP00000404684
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVGTFAVMSVMVGSVTESLAPQALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAASPKGASVSINVNTSLEDMRSNNVEDCKMMVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 81161 - protein, 169 aa, Homo sapiens
  Payload ID: 16173
  Gene Symbol: SLC26A6
  Gene Name: solute carrier family 26 (anion exchanger), member 6
  ENSP ID: ENSP00000405872
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVATPGPLPLLTAPGRPTGGAGPDPLR

SEQ ID NO: 81162 - protein, 753 aa, Homo sapiens
  Payload ID: 16173
  Gene Symbol: SLC26A6
  Gene Name: solute carrier family 26 (anion exchanger), member 6
  ENSP ID: ENSP00000483669
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQDLLSRLHCYHSTLGLAYALLAGLPPVFGLYSSFYPVFIYFLFGTSRHISVGTFAVMSVMVGSVTESLAPQALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAGPLLSACLAPQQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 81163 - protein, 656 aa, Homo sapiens
  Payload ID: 16174
  Gene Symbol: SLC26A7
  Gene Name: solute carrier family 26 (anion exchanger), member 7
  Uniprot ID: Q8TE54
  ENSP ID: ENSP00000276609
MTGAKRKKKSMLWSKMHTPQCEDIIQWCRRRLPILDWAPHYNLKENLLPDTVSGIMLAVQQVTQGLAFAVLSSVHPVFGLYGSLFPAIIYAIFGMGHHVATGTFALTSLISANAVERIVPQNMQNLTTQSNTSVLGLSDFEMQRIHVAAAVSFLGGVIQVAMFVLQLGSATFVVTEPVISAMTTGAATHVVTSQVKYLLGMKMPYISGPLGFFYIYAYVFENIKSVRLEALLLSLLSIVVLVLVKELNEQFKRKIKVVLPVDLVLIIAASFACYCTNMENTYGLEVVGHIPQGIPSPRAPPMNILSAVITEAFGVALVGYVASLALAQGSAKKFKYSIDDNQEFLAHGLSNIVSSFFFCIPSAAAMGRTAGLYSTGAKTQVACLISCIFVLIVIYAIGPLLYWLPMCVLASIIVVGLKGMLIQFRDLKKYWNVDKIDWGIWVSTYVFTICFAANVGLLFGVVCTIAIVIGRFPRAMTVSIKNMKEMEFKVKTEMDSETLQQVKIISINNPLVFLNAKKFYTDLMNMIQKENACNQPLDDISKCEQNTLLNSLSNGNCNEEASQSCPNEKCYLILDCSGFTFFDYSGVSMLVEVYMDCKGRSVDVLLAHCTASLIKAMTYYGNLDSEKPIFFESVSAAISHIHSNKNLSKLSDHSEV

SEQ ID NO: 81164 - protein, 663 aa, Homo sapiens
  Payload ID: 16174
  Gene Symbol: SLC26A7
  Gene Name: solute carrier family 26 (anion exchanger), member 7
  Uniprot ID: Q8TE54
  ENSP ID: ENSP00000309504
MTGAKRKKKSMLWSKMHTPQCEDIIQWCRRRLPILDWAPHYNLKENLLPDTVSGIMLAVQQVTQGLAFAVLSSVHPVFGLYGSLFPAIIYAIFGMGHHVATGTFALTSLISANAVERIVPQNMQNLTTQSNTSVLGLSDFEMQRIHVAAAVSFLGGVIQVAMFVLQLGSATFVVTEPVISAMTTGAATHVVTSQVKYLLGMKMPYISGPLGFFYIYAYVFENIKSVRLEALLLSLLSIVVLVLVKELNEQFKRKIKVVLPVDLVLIIAASFACYCTNMENTYGLEVVGHIPQGIPSPRAPPMNILSAVITEAFGVALVGYVASLALAQGSAKKFKYSIDDNQEFLAHGLSNIVSSFFFCIPSAAAMGRTAGLYSTGAKTQVACLISCIFVLIVIYAIGPLLYWLPMCVLASIIVVGLKGMLIQFRDLKKYWNVDKIDWGIWVSTYVFTICFAANVGLLFGVVCTIAIVIGRFPRAMTVSIKNMKEMEFKVKTEMDSETLQQVKIISINNPLVFLNAKKFYTDLMNMIQKENACNQPLDDISKCEQNTLLNSLSNGNCNEEASQSCPNEKCYLILDCSGFTFFDYSGVSMLVEVYMDCKGRSVDVLLAHCTASLIKAMTYYGNLDSEKPIFFESVSAAISHIHSNKASYKLLFDNLDLPTMPPL

SEQ ID NO: 81165 - protein, 269 aa, Homo sapiens
  Payload ID: 16174
  Gene Symbol: SLC26A7
  Gene Name: solute carrier family 26 (anion exchanger), member 7
  ENSP ID: ENSP00000427712
MTGAKRKKKSMLWSKMHTPQCEDIIQWCRRRLPILDWAPHYNLKENLLPDTVSGIMLAVQQVTQGLAFAVLSSVHPVFGLYGSLFPAIIYAIFGMGHHVATGTFALTSLISANAVERIVPQNMQNLTTQSNTSVLGLSDFEMQRIHVAAAVSFLGGVIQVAMFVLQLGSATFVVTEPVISAMTTGAATHVVTSQVKYLLGMKMPYISGPLGFFYIYAYVFENIKSVRLEALLLSLLSIVVLVLVKELNEQFKRKIKVVLPVDLVLNSLT

SEQ ID NO: 81166 - protein, 237 aa, Homo sapiens
  Payload ID: 16174
  Gene Symbol: SLC26A7
  Gene Name: solute carrier family 26 (anion exchanger), member 7
  ENSP ID: ENSP00000428747
  MOD_RES (1)..(1): Any amino acid
XVLGLSDFEMQRIHVAAAVSFLGGVIQVAMFVLQLGSATFVVTEPVISAMTTGAATHVVTSQVKYLLGMKMPYISGPLGFFYIYAYVFENIKSVRLEALLLSLLSIVVLVLVKELNEQFKRKIKVVLPVDLVLIIAASFACYCTNMENTYGLEVVGHIPQGIPSPRAPPMNILSAVITEAFGVALVGYVASLALAQGSAKKFKYSIDDNQVECAPSPSPLQLYHCTVHSQILKMMNL

SEQ ID NO: 81167 - protein, 656 aa, Homo sapiens; identical to SEQ ID NO: 81163
  Payload ID: 16174
  Gene Symbol: SLC26A7
  Gene Name: solute carrier family 26 (anion exchanger), member 7
  Uniprot ID: Q8TE54
  ENSP ID: ENSP00000428849

SEQ ID NO: 81168 - protein, 207 aa, Homo sapiens
  Payload ID: 16174
  Gene Symbol: SLC26A7
  Gene Name: solute carrier family 26 (anion exchanger), member 7
  ENSP ID: ENSP00000428881
MTGAKRKKKSMLWSKMHTPQCEDIIQWCRRRLPILDWAPHYNLKENLLPDTVSGIMLAVQQVTQGLAFAVLSSVHPVFGLYGSLFPAIIYAIFGMGHHVATGTFALTSLISANAVERIVPQNMQNLTTQSNTSVLGLSDFEMQRIHVAAAVSFLGGVIQVAMFVLQLGSATFVVTEPVISAMTTGAATHVVTSQVKYLLGMKMPYIS

SEQ ID NO: 81169 - protein, 656 aa, Homo sapiens; identical to SEQ ID NO: 81163
  Payload ID: 16174
  Gene Symbol: SLC26A7
  Gene Name: solute carrier family 26 (anion exchanger), member 7
  Uniprot ID: Q8TE54
  ENSP ID: ENSP00000482549

SEQ ID NO: 81170 - protein, 355 aa, Homo sapiens
  Payload ID: 16174
  Gene Symbol: SLC26A7
  Gene Name: solute carrier family 26 (anion exchanger), member 7
  ENSP ID: ENSP00000482686
MNILSAVITEAFGVALVGYVASLALAQGSAKKFKYSIDDNQEFLAHGLSNIVSSFFFCIPSAAAMGRTAGLYSTGAKTQVACLISCIFVLIVIYAIGPLLYWLPMCVLASIIVVGLKGMLIQFRDLKKYWNVDKIDWGIWVSTYVFTICFAANVGLLFGVVCTIAIVIGRFPRAMTVSIKNMKEMEFKVKTEMDSETLQQVKIISINNPLVFLNAKKFYTDLMNMIQKENACNQPLDDISKCEQNTLLNSLSNGNCNEEASQSCPNEKCYLILDCSGFTFFDYSGVSMLVEVYMDCKGRSVDVLLAHCTASLIKAMTYYGNLDSEKPIFFESVSAAISHIHSNKNLSKLSDHSEV

SEQ ID NO: 81171 - protein, 970 aa, Homo sapiens
  Payload ID: 16175
  Gene Symbol: SLC26A8
  Gene Name: solute carrier family 26 (anion exchanger), member 8
  Uniprot ID: Q96RN1
  ENSP ID: ENSP00000347778
MAQLERSAISGFSSKSRRNSFAYDVKREVYNEETFQQEHKRKASSSGNMNINITTFRHHVQCRCSWHRFLRCVLTIFPFLEWMCMYRLKDWLLGDLLAGISVGLVQVPQGLTLSLLARQLIPPLNIAYAAFCSSVIYVIFGSCHQMSIGSFFLVSALLINVLKVSPFNNGQLVMGSFVKNEFSAPSYLMGYNKSLSVVATTTFLTGIIQLIMGVLGLGFIATYLPESAMSAYLAAVALHIMLSQLTFIFGIMISFHAGPISFFYDIINYCVALPKANSTSILVFLTVVVALRINKCIRISFNQYPIEFPMELFLIIGFTVIANKISMATETSQTLIDMIPYSFLLPVTPDFSLLPKIILQAFSLSLVSSFLLIFLGKKIASLHNYSVNSNQDLIAIGLCNVVSSFFRSCVFTGAIARTIIQDKSGGRQQFASLVGAGVMLLLMVKMGHFFYTLPNAVLAGIILSNVIPYLETISNLPSLWRQDQYDCALWMMTFSSSIFLGLDIGLIISVVSAFFITTVRSHRAKILLLGQIPNTNIYRSINDYREIITIPGVKIFQCCSSITFVNVYYLKHKLLKEVDMVKVPLKEEEIFSLFNSSDTNLQGGKICRCFCNCDDLEPLPRILYTERFENKLDPEASSINLIHCSHFESMNTSQTASEDQVPYTVSSVSQKNQGQQYEEVEEVWLPNNSSRNSSPGLPDVAESQGRRSLIPYSDASLLPSVHTIILDFSMVHYVDSRGLVVLRQICNAFQNANILILIAGCHSSIVRAFERNDFFDAGITKTQLFLSVHDAVLFALSRKVIGSSELSIDESETVIRETYSETDKNDNSRYKMSSSFLGSQKNVSPGFIKIQQPVEEESELDLELESEQEAGLGLDLDLDRELEPEMEPKAETETKTQTEMEPQPETEPEMEPNPKSRPRAHTFPQQRYWPMYHPSMASTQSQTQTRTWSVERRRHPMDSYSPEGNSNEDV

SEQ ID NO: 81172 - protein, 865 aa, Homo sapiens
  Payload ID: 16175
  Gene Symbol: SLC26A8
  Gene Name: solute carrier family 26 (anion exchanger), member 8
  Uniprot ID: Q96RN1
  ENSP ID: ENSP00000378100
MAQLERSAISGFSSKSRRNSFAYDVKREVYNEETFQQEHKRKASSSGNMNINITTFRHHVQCRCSWHRFLRCVLTIFPFLEWMCMYRLKDWLLGDLLAGISVGLVQVPQGLTLSLLARQLIPPLNIAYAAFCSSVIYVIFGSCHQMSIGSFFLVSALLINVLKVSPFNNGQLVMGSFVKNEFSAPSYLMGYNKSLSVVATTTFLTGIIQIIGFTVIANKISMATETSQTLIDMIPYSFLLPVTPDFSLLPKIILQAFSLSLVSSFLLIFLGKKIASLHNYSVNSNQDLIAIGLCNVVSSFFRSCVFTGAIARTIIQDKSGGRQQFASLVGAGVMLLLMVKMGHFFYTLPNAVLAGIILSNVIPYLETISNLPSLWRQDQYDCALWMMTFSSSIFLGLDIGLIISVVSAFFITTVRSHRAKILLLGQIPNTNIYRSINDYREIITIPGVKIFQCCSSITFVNVYYLKHKLLKEVDMVKVPLKEEEIFSLFNSSDTNLQGGKICRCFCNCDDLEPLPRILYTERFENKLDPEASSINLIHCSHFESMNTSQTASEDQVPYTVSSVSQKNQGQQYEEVEEVWLPNNSSRNSSPGLPDVAESQGRRSLIPYSDASLLPSVHTIILDFSMVHYVDSRGLVVLRQICNAFQNANILILIAGCHSSIVRAFERNDFFDAGITKTQLFLSVHDAVLFALSRKVIGSSELSIDESETVIRETYSETDKNDNSRYKMSSSFLGSQKNVSPGFIKIQQPVEEESELDLELESEQEAGLGLDLDLDRELEPEMEPKAETETKTQTEMEPQPETEPEMEPNPKSRPRAHTFPQQRYWPMYHPSMASTQSQTQTRTWSVERRRHPMDSYSPEGNSNEDV

SEQ ID NO: 81173 - protein, 970 aa, Homo sapiens; identical to SEQ ID NO: 81171
  Payload ID: 16175
  Gene Symbol: SLC26A8
  Gene Name: solute carrier family 26 (anion exchanger), member 8
  Uniprot ID: Q96RN1
  ENSP ID: ENSP00000417638

SEQ ID NO: 81174 - protein, 320 aa, Homo sapiens
  Payload ID: 16175
  Gene Symbol: SLC26A8
  Gene Name: solute carrier family 26 (anion exchanger), member 8
  ENSP ID: ENSP00000418107
  MOD_RES (1)..(1): Any amino acid
XFYTLPNAVLAGIILSNVIPYLETISNLPSLWRQDQYDCALWMMTFSSSIFLGLDIGLIISVVSAFFITTVRSHRAKILLLGQIPNTNIYRSINDYREIITIPGVKIFQCCSSITFVNVYYLKHKLLKEVDMVKVPLKEEEIFSLFNSSDTNLQGGKICRCFCNCDDLEPLPRILYTERFENKLDPEASSINLIHCSHFESMNTSQTASEDQVPYTVSSVSQKNQGQQYEEVEEVWLPNNSSRNSSPGLPDVAESQGRRSLIPYSDASLLPSVHTIILDFSMVHYVDSRGLVVLRQVSTEEALAGALIPLLPSQPHPDPD

SEQ ID NO: 81175 - protein, 184 aa, Homo sapiens
  Payload ID: 16175
  Gene Symbol: SLC26A8
  Gene Name: solute carrier family 26 (anion exchanger), member 8
  ENSP ID: ENSP00000419700
  MOD_RES (1)..(1): Any amino acid
XVYRFTKYQGDPTTQPARNARGLGHNGSGTAAGIRVRSAASQARAVWDPSARTPAPAKEPGEPLLGDAWAPGAAGPRAGAASVTGRYPGMAQLERSAISGFSSKSRRNSFAYDVKREVYNEETFQQEHKRKASSSGNMNINITTFRHHVQCRMDVYVSIKGLASGRLTCWYKCWPCASSPRPDT

SEQ ID NO: 81176 - protein, 190 aa, Homo sapiens
  Payload ID: 16175
  Gene Symbol: SLC26A8
  Gene Name: solute carrier family 26 (anion exchanger), member 8
  ENSP ID: ENSP00000420488
MFRTRGLAPNRPSIKNSKTSEREGALVYRFTKYQGDPTTQPARNARGLGHNGSGTAAGIRVRSAASQARAVWDPSARTPAPAKEPGMAQLERSAISGFSSKSRRNSFAYDVKREVYNEETFQQEHKRKASSSGNMNINITTFRHHVQCRCSWHRFLRCVLTIFPFLEWMCMYRLKDWLLGDLLAGISVGL

SEQ ID NO: 81177 - protein, 887 aa, Homo sapiens
  Payload ID: 16176
  Gene Symbol: SLC26A9
  Gene Name: solute carrier family 26 (anion exchanger), member 9
  Uniprot ID: Q7LBE3
  ENSP ID: ENSP00000341682
MSQPRPRYVVDRAAYSLTLFDDEFEKKDRTYPVGEKLRNAFRCSSAKIKAVVFGLLPVLSWLPKYKIKDYIIPDLLGGLSGGSIQVPQGMAFALLANLPAVNGLYSSFFPLLTYFFLGGVHQMVPGTFAVISILVGNICLQLAPESKFQVFNNATNESYVDTAAMEAERLHVSATLACLTAIIQMGLGFMQFGFVAIYLSESFIRGFMTAAGLQILISVLKYIFGLTIPSYTGPGSIVFTFIDICKNLPHTNIASLIFALISGAFLVLVKELNARYMHKIRFPIPTEMIVVVVATAISGGCKMPKKYHMQIVGEIQRGFPTPVSPVVSQWKDMIGTAFSLAIVSYVINLAMGRTLANKHGYDVDSNQEMIALGCSNFFGSFFKIHVICCALSVTLAVDGAGGKSQVASLCVSLVVMITMLVLGIYLYPLPKSVLGALIAVNLKNSLKQLTDPYYLWRKSKLDCCIWVVSFLSSFFLSLPYGVAVGVAFSVLVVVFQTQFRNGYALAQVMDTDIYVNPKTYNRAQDIQGIKIITYCSPLYFANSEIFRQKVIAKTGMDPQKVLLAKQKYLKKQEKRRMRPTQQRRSLFMKTKTVSLQELQQDFENAPPTDPNNNQTPANGTSVSYITFSPDSSSPAQSEPPASAEAPGEPSDMLASVPPFVTFHTLILDMSGVSFVDLMGIKALAKLSSTYGKIGVKVFLVNIHAQVYNDISHGGVFEDGSLECKHVFPSIHDAVLFAQANARDVTPGHNFQGAPGDAELSLYDSEEDIRSYWDLEQEMFGSMFHAETLTALESLSAAGGCYPYRSESLVSPLFTRQALAAMDKPPAHSTPPTSALSLAAEGHLDFQLLRVSQKQKDKYNCAGLLYKLQKVSQSPHGSVSDGVRLSRT

SEQ ID NO: 81178 - protein, 887 aa, Homo sapiens; identical to SEQ ID NO: 81177
  Payload ID: 16176
  Gene Symbol: SLC26A9
  Gene Name: solute carrier family 26 (anion exchanger), member 9
  Uniprot ID: Q7LBE3
  ENSP ID: ENSP00000356102

SEQ ID NO: 81179 - protein, 791 aa, Homo sapiens
  Payload ID: 16176
  Gene Symbol: SLC26A9
  Gene Name: solute carrier family 26 (anion exchanger), member 9
  Uniprot ID: Q7LBE3
  ENSP ID: ENSP00000356103
MSQPRPRYVVDRAAYSLTLFDDEFEKKDRTYPVGEKLRNAFRCSSAKIKAVVFGLLPVLSWLPKYKIKDYIIPDLLGGLSGGSIQVPQGMAFALLANLPAVNGLYSSFFPLLTYFFLGGVHQMVPGTFAVISILVGNICLQLAPESKFQVFNNATNESYVDTAAMEAERLHVSATLACLTAIIQMGLGFMQFGFVAIYLSESFIRGFMTAAGLQILISVLKYIFGLTIPSYTGPGSIVFTFIDICKNLPHTNIASLIFALISGAFLVLVKELNARYMHKIRFPIPTEMIVVVVATAISGGCKMPKKYHMQIVGEIQRGFPTPVSPVVSQWKDMIGTAFSLAIVSYVINLAMGRTLANKHGYDVDSNQEMIALGCSNFFGSFFKIHVICCALSVTLAVDGAGGKSQVASLCVSLVVMITMLVLGIYLYPLPKSVLGALIAVNLKNSLKQLTDPYYLWRKSKLDCCIWVVSFLSSFFLSLPYGVAVGVAFSVLVVVFQTQFRNGYALAQVMDTDIYVNPKTYNRAQDIQGIKIITYCSPLYFANSEIFRQKVIAKTGMDPQKVLLAKQKYLKKQEKRRMRPTQQRRSLFMKTKTVSLQELQQDFENAPPTDPNNNQTPANGTSVSYITFSPDSSSPAQSEPPASAEAPGEPSDMLASVPPFVTFHTLILDMSGVSFVDLMGIKALAKLSSTYGKIGVKVFLVNIHAQVYNDISHGGVFEDGSLECKHVFPSIHDAVLFAQANARDVTPGHNFQGAPGDAELSLYDSEEDIRSYWDLEQEMFGSMFHAETLTAL

SEQ ID NO: 81180 - protein, 563 aa, Homo sapiens
  Payload ID: 16177
  Gene Symbol: SLC26A10
  Gene Name: solute carrier family 26, member 10
  Uniprot ID: Q8NG04
  ENSP ID: ENSP00000320217
MRLDLASLMSAPKSLGSAFKSWRLDKAPSPQHTFPSTSIPGMAFALLASVPPVFGLYTSFFPVLIYSLLGTGRHLSTGTFAILSLMTGSAVERLVPEPLVGNLSGIEKEQLDAQRVGVAAAVAFGSGALMLGMFVLQLGVLSTFLSEPVVKALTSGAALHVLLSQLPSLLGLSLPRQIGCFSLFKTLASLLTALPRSSPAELTISALSLALLVPVKELNVRFRDRLPTPIPGEVVLVLLASVLCFTSSVDTRYQVQIVGLLPGGFPQPLLPNLAELPRILADSLPIALVSFAVSASLASIHADKYSYTIDSNQEFLAHGASNLISSLFSCFPNSATLATTNLLVDAGGKTQLAGLFSCTVVLSVLLWLGPFFYYLPKAVLACINISSMRQVFCQMQELPQLWHISRVDFLLQVPGLCILSYPTPLYFGTRGQFRCNLEWHLGLGEGEKETSKPDGPMVAVAEPVRVVVLDFSGVTFADAAGAREVVQVRERLASRCRDARIRLLLAQCNALVQGTLTRVGLLDRVTPDQLFVSVQDAAAYALGSLLRGSSTRSGSQEALGCGK

SEQ ID NO: 81181 - protein, 412 aa, Homo sapiens
  Payload ID: 16177
  Gene Symbol: SLC26A10
  Gene Name: solute carrier family 26, member 10
  ENSP ID: ENSP00000403619
  MOD_RES (1)..(1): Any amino acid
XFALLASVPPVFGLYTSFFPVLIYSLLGTGRHLSTGTFAILSLMTGSAVERLVPEPLVGNLSGIEKEQLDAQRVGVAAAVAFGSGALMLGMFVLQLGVLSTFLSEPVVKALTSGAALHVLLSQLPSLLGLSLPRQIGCFSLFKTLASLLTALPRSSPAELTISALSLALLVPVKELNVRFRDRLPTPIPGEVVLVLLASVLCFTSSVDTRYQVQIVGLLPGGFPQPLLPNLAELPRILADSLPIALVSFAVSASLASIHADKYSYTIDSNQEFLAHGASNLISSLFSCFPNSATLATTNLLVDAGGKTQLAGLFSCTVVLSVLLWLGPFFYYLPKAVLACINISSMRQVFCQMQELPQLWHISRVDFAVWMVTWVAVVTLSVDLGLAVGVVFSMMTVVCRTRSSSRSRGSAS

SEQ ID NO: 81182 - protein, 520 aa, Homo sapiens
  Payload ID: 16177
  Gene Symbol: SLC26A10
  Gene Name: solute carrier family 26, member 10
  ENSP ID: ENSP00000431994
MSGIQGTRTYPGAGDTSDLKYPLATRLREALTEARFHQLFRGEEQEPELPEERGFPRLFGLWRLRARACSGTGAWRLLLARLPALHWLPHYRWRAWLLGDAVAGVTVGIVHVPQGMAFALLASVPPVFGLYTSFFPVLIYSLLGTGRHLSTGTFAILSLMTGSAVERLVPEPLVGNLSGIEKEQLDAQRVGVAAAVAFGSGALMLGMFVLQLGVLSTFLSEPVVKALTSGAALHVLLSQLPSLLGLSLPRQIGCFSLFKTLASLLTALPRSSPAELTISALSLALLVPVKELNVRFRDRLPTPIPGEVVLVLLASVLCFTSSVDTRYQVQIVGLLPGGFPQPLLPNLAELPRILADSLPIALVSFAVSASLASIHADKYSYTIDSNQEFLAHGASNLISSLFSCFPNSATLATTNLLVDAGGKTQLAGLFSCTVVLSVLLWLGPFFYYLPKAVLACINISSMRQVFCQMQELPQLWHISRVDFAVWMVTWVAVVTLSVDLGLAVGVVFSMMTVVCRTRRV

SEQ ID NO: 81183 - protein, 646 aa, Homo sapiens
  Payload ID: 16178
  Gene Symbol: SLC27A1
  Gene Name: solute carrier family 27 (fatty acid transporter), member 1
  Uniprot ID: Q6PCB7
  ENSP ID: ENSP00000252595
MRAPGAGAASVVSLALLWLLGLPWTWSAAAALGVYVGSGGWRFLRIVCKTARRDLFGLSVLIRVRLELRRHQRAGHTIPRIFQAVVQRQPERLALVDAGTGECWTFAQLDAYSNAVANLFRQLGFAPGDVVAIFLEGRPEFVGLWLGLAKAGMEAALLNVNLRREPLAFCLGTSGAKALIFGGEMVAAVAEVSGHLGKSLIKFCSGDLGPEGILPDTHLLDPLLKEASTAPLAQIPSKGMDDRLFYIYTSGTTGLPKAAIVVHSRYYRMAAFGHHAYRMQAADVLYDCLPLYHSAGNIIGVGQCLIYGLTVVLRKKFSASRFWDDCIKYNCTVVQYIGEICRYLLKQPVREAERRHRVRLAVGNGLRPAIWEEFTERFGVRQIGEFYGATECNCSIANMDGKVGSCGFNSRILPHVYPIRLVKVNEDTMELLRDAQGLCIPCQAGEPGLLVGQINQQDPLRRFDGYVSESATSKKIAHSVFSKGDSAYLSGDVLVMDELGYMYFRDRSGDTFRWRGENVSTTEVEGVLSRLLGQTDVAVYGVAVPGVEGKAGMAAVADPHSLLDPNAIYQELQKVLAPYARPIFLRLLPQVDTTGTFKIQKTRLQREGFDPRQTSDRLFFLDLKQGHYLPLNEAVYTRICSGAFAL

SEQ ID NO: 81184 - protein, 96 aa, Homo sapiens
  Payload ID: 16178
  Gene Symbol: SLC27A1
  Gene Name: solute carrier family 27 (fatty acid transporter), member 1
  ENSP ID: ENSP00000469459
MRAPGAGAASVVSLALLWLLGLPWTWSAAAALGVYVGSGGWRFLRIVCKTARRDLLSSFLHLHVGDHRAAQGCHCRAQQVLPHGSLRPPRLPHAGG

SEQ ID NO: 81185 - protein, 224 aa, Homo sapiens
  Payload ID: 16178
  Gene Symbol: SLC27A1
  Gene Name: solute carrier family 27 (fatty acid transporter), member 1
  ENSP ID: ENSP00000469881
MRAPGAGAASVVSLALLWLLGLPWTWSAAAALGVYVGSGGWRFLRIVCKTARRDLFGLSVLIRVRLELRRHQRAGHTIPRIFQAVVQRQPERLALVDAGTGECWTFAQLDAYSNAVANLFRQLGFAPGDVVAIFLEGRPEFVGLWLGLAKAGMEAALLNVNLRREPLAFCLGTSGAKALIFGGEMVAGEARRGHQVGGDPGLAPGRAGRCCAPGLGRRPPWTWA

SEQ ID NO: 81186 - protein, 166 aa, Homo sapiens
  Payload ID: 16178
  Gene Symbol: SLC27A1
  Gene Name: solute carrier family 27 (fatty acid transporter), member 1
  ENSP ID: ENSP00000470457
  MOD_RES (1)..(1): Any amino acid
XRDAQGLCIPCQAGEPGLLVGQINQQDPLRRFDGYVSESATSKKIAHSVFSKGDSAYLSGDVLVMDELGYMYFRDRSGDTFRWRGENVSTTEVEGVLSRLLGQTDVAVYGVAVPGTFKIQKTRLQREGFDPRQTSDRLFFLDLKQGHYLPLNEAVYTRICSGAFAL

SEQ ID NO: 81187 - protein, 224 aa, Homo sapiens; identical to SEQ ID NO: 81185
  Payload ID: 16178
  Gene Symbol: SLC27A1
  Gene Name: solute carrier family 27 (fatty acid transporter), member 1
  ENSP ID: ENSP00000472082

SEQ ID NO: 81188 - protein, 467 aa, Homo sapiens
  Payload ID: 16178
  Gene Symbol: SLC27A1
  Gene Name: solute carrier family 27 (fatty acid transporter), member 1
  Uniprot ID: Q6PCB7
  ENSP ID: ENSP00000472313
MTHVLGTTAVAEVSGHLGKSLIKFCSGDLGPEGILPDTHLLDPLLKEASTAPLAQIPSKGMDDRLFYIYTSGTTGLPKAAIVVHSRYYRMAAFGHHAYRMQAADVLYDCLPLYHSAGNIIGVGQCLIYGLTVVLRKKFSASRFWDDCIKYNCTVVQYIGEICRYLLKQPVREAERRHRVRLAVGNGLRPAIWEEFTERFGVRQIGEFYGATECNCSIANMDGKVGSCGFNSRILPHVYPIRLVKVNEDTMELLRDAQGLCIPCQAGEPGLLVGQINQQDPLRRFDGYVSESATSKKIAHSVFSKGDSAYLSGDVLVMDELGYMYFRDRSGDTFRWRGENVSTTEVEGVLSRLLGQTDVAVYGVAVPGVEGKAGMAAVADPHSLLDPNAIYQELQKVLAPYARPIFLRLLPQVDTTGTFKIQKTRLQREGFDPRQTSDRLFFLDLKQGHYLPLNEAVYTRICSGAFAL

SEQ ID NO: 81189 - protein, 620 aa, Homo sapiens
  Payload ID: 16179
  Gene Symbol: SLC27A2
  Gene Name: solute carrier family 27 (fatty acid transporter), member 2
  Uniprot ID: O14975
  ENSP ID: ENSP00000267842
MLSAIYTVLAGLLFLPLLVNLCCPYFFQDIGYFLKVAAVGRRVRSYGKRRPARTILRAFLEKARQTPHKPFLLFRDETLTYAQVDRRSNQVARALHDHLGLRQGDCVALLMGNEPAYVWLWLGLVKLGCAMACLNYNIRAKSLLHCFQCCGAKVLLVSPELQAAVEEILPSLKKDDVSIYYVSRTSNTDGIDSFLDKVDEVSTEPIPESWRSEVTFSTPALYIYTSGTTGLPKAAMITHQRIWYGTGLTFVSGLKADDVIYITLPFYHSAALLIGIHGCIVAGATLALRTKFSASQFWDDCRKYNVTVIQYIGELLRYLCNSPQKPNDRDHKVRLALGNGLRGDVWRQFVKRFGDICIYEFYAATEGNIGFMNYARKVGAVGRVNYLQKKIITYDLIKYDVEKDEPVRDENGYCVRVPKGEVGLLVCKITQLTPFNGYAGAKAQTEKKKLRDVFKKGDLYFNSGDLLMVDHENFIYFHDRVGDTFRWKGENVATTEVADTVGLVDFVQEVNVYGVHVPDHEGRIGMASIKMKENHEFDGKKLFQHIADYLPSYARPRFLRIQDTIEITGTFKHRKMTLVEEGFNPAVIKDALYFLDDTAKMYVPMTEDIYNAISAKTLKL

SEQ ID NO: 81190 - protein, 567 aa, Homo sapiens
  Payload ID: 16179
  Gene Symbol: SLC27A2
  Gene Name: solute carrier family 27 (fatty acid transporter), member 2
  Uniprot ID: O14975
  ENSP ID: ENSP00000370289
MLSAIYTVLAGLLFLPLLVNLCCPYFFQDIGYFLKVAAVGRRVRSYGKRRPARTILRAFLEKARQTPHKPFLLFRDETLTYAQVDRRSNQVARALHDHLGLRQGDCVALLMGNEPAYVWLWLGLVKLGCAMACLNYNIRAKSLLHCFQCCGAKVLLVSPELQAAVEEILPSLKKDDVSIYYVSRTSNTDGIDSFLDKVDEVSTEPIPESWRSEVTFSTPALYIYTSGTTGATLALRTKFSASQFWDDCRKYNVTVIQYIGELLRYLCNSPQKPNDRDHKVRLALGNGLRGDVWRQFVKRFGDICIYEFYAATEGNIGFMNYARKVGAVGRVNYLQKKIITYDLIKYDVEKDEPVRDENGYCVRVPKGEVGLLVCKITQLTPFNGYAGAKAQTEKKKLRDVFKKGDLYFNSGDLLMVDHENFIYFHDRVGDTFRWKGENVATTEVADTVGLVDFVQEVNVYGVHVPDHEGRIGMASIKMKENHEFDGKKLFQHIADYLPSYARPRFLRIQDTIEITGTFKHRKMTLVEEGFNPAVIKDALYFLDDTAKMYVPMTEDIYNAISAKTLKL

SEQ ID NO: 81191 - protein, 385 aa, Homo sapiens
  Payload ID: 16179
  Gene Symbol: SLC27A2
  Gene Name: solute carrier family 27 (fatty acid transporter), member 2
  ENSP ID: ENSP00000444549
MITHQRIWYGTGLTFVSGLKADDVIYITLPFYHSAALLIGIHGCIVAGATLALRTKFSASQFWDDCRKYNVTVIQYIGELLRYLCNSPQKPNDRDHKVRLALGNGLRGDVWRQFVKRFGDICIYEFYAATEGNIGFMNYARKVGAVGRVNYLQKKIITYDLIKYDVEKDEPVRDENGYCVRVPKGEVGLLVCKITQLTPFNGYAGAKAQTEKKKLRDVFKKGDLYFNSGDLLMVDHENFIYFHDRVGDTFRWKGENVATTEVADTVGLVDFVQEVNVYGVHVPDHEGRIGMASIKMKENHEFDGKKLFQHIADYLPSYARPRFLRIQDTIEITGTFKHRKMTLVEEGFNPAVIKDALYFLDDTAKMYVPMTEDIYNAISAKTLKL

SEQ ID NO: 81192 - protein, 811 aa, Homo sapiens
  Payload ID: 16180
  Gene Symbol: SLC27A3
  Gene Name: solute carrier family 27 (fatty acid transporter), member 3
  ENSP ID: ENSP00000271857
MPKPPKPRNNLEDRHNPGIQGRREHRPGPGRVRAASSPGGSAPRAERRLWGEGWESGAAPHPHSSRVSALRPCGVVGAWVGMGVCQRTRAPWKEKSQLERAALGFRKGGSGMFASGWNQTVPIEEAGSMAALLLLPLLLLLPLLLLKLHLWPQLRWLPADLAFAVRALCCKRALRARALAAAAADPEGPEGGCSLAWRLAELAQQRAAHTFLIHGSRRFSYSEAERESNRAARAFLRALGWDWGPDGGDSGEGSAGEGERAAPGAGDAAAGSGAEFAGGDGAARGGGAAAPLSPGATVALLLPAGPEFLWLWFGLAKAGLRTAFVPTALRRGPLLHCLRSCGARALVLAPEFLESLEPDLPALRAMGLHLWAAGPGTHPAGISDLLAEVSAEVDGPVPGYLSSPQSITDTCLYIFTSGTTGLPKAARISHLKILQCQGFYQLCGVHQEDVIYLALPLYHMSGSLLGIVGCMGIGATVVLKSKFSAGQFWEDCQQHRVTVFQYIGELCRYLVNQPPSKAERGHKVRLAVGSGLRPDTWERFVRRFGPLQVLETYGLTEGNVATINYTGQRGAVGRASWLYKHIFPFSLIRYDVTTGEPIRDPQGHCMATSPGEPGLLVAPVSQQSPFLGYAGGPELAQGKLLKDVFRPGDVFFNTGDLLVCDDQGFLRFHDRTGDTFRWKGENVATTEVAEVFEALDFLQEVNVYGVTVPGHEGRAGMAALVLRPPHALDLMQLYTHVSENLPPYARPRFLRLQESLATTETFKQQKVRMANEGFDPSTLSDPLYVLDQAVGAYLPLTTARYSALLAGNLRI

SEQ ID NO: 81193 - protein, 730 aa, Homo sapiens
  Payload ID: 16180
  Gene Symbol: SLC27A3
  Gene Name: solute carrier family 27 (fatty acid transporter), member 3
  Uniprot ID: Q5K4L6
  ENSP ID: ENSP00000357650
MGVCQRTRAPWKEKSQLERAALGFRKGGSGMFASGWNQTVPIEEAGSMAALLLLPLLLLLPLLLLKLHLWPQLRWLPADLAFAVRALCCKRALRARALAAAAADPEGPEGGCSLAWRLAELAQQRAAHTFLIHGSRRFSYSEAERESNRAARAFLRALGWDWGPDGGDSGEGSAGEGERAAPGAGDAAAGSGAEFAGGDGAARGGGAAAPLSPGATVALLLPAGPEFLWLWFGLAKAGLRTAFVPTALRRGPLLHCLRSCGARALVLAPEFLESLEPDLPALRAMGLHLWAAGPGTHPAGISDLLAEVSAEVDGPVPGYLSSPQSITDTCLYIFTSGTTGLPKAARISHLKILQCQGFYQLCGVHQEDVIYLALPLYHMSGSLLGIVGCMGIGATVVLKSKFSAGQFWEDCQQHRVTVFQYIGELCRYLVNQPPSKAERGHKVRLAVGSGLRPDTWERFVRRFGPLQVLETYGLTEGNVATINYTGQRGAVGRASWLYKHIFPFSLIRYDVTTGEPIRDPQGHCMATSPGEPGLLVAPVSQQSPFLGYAGGPELAQGKLLKDVFRPGDVFFNTGDLLVCDDQGFLRFHDRTGDTFRWKGENVATTEVAEVFEALDFLQEVNVYGVTVPGHEGRAGMAALVLRPPHALDLMQLYTHVSENLPPYARPRFLRLQESLATTETFKQQKVRMANEGFDPSTLSDPLYVLDQAVGAYLPLTTARYSALLAGNLRI

SEQ ID NO: 81194 - protein, 400 aa, Homo sapiens
  Payload ID: 16180
  Gene Symbol: SLC27A3
  Gene Name: solute carrier family 27 (fatty acid transporter), member 3
  ENSP ID: ENSP00000389603
  MOD_RES (1)..(1): Any amino acid
XHPAGISDLLAEVSAEVDGPVPGYLSSPQSITDTCLYIFTSGTTGLPKAARISHLKILQCQGFYQLCGVHQEDVIYLALPLYHMSGSLLGIVGCMGIGATVVLKSKFSAGQFWEDCQQHRVTVFQYIGELCRYLVNQPPSKAERGHKVRLAVGSGLRPDTWERFVRRFGPLQVLETYGLTEGNVATINYTGQRGAVGRASWLYKHIFPFSLIRYDVTTGEPIRDPQGHCMATSPGEPGLLVAPVSQQSPFLGYAGGPELAQGKLLKDVFRPGDVFFNTGDLLVCDDQGFLRFHDRTGDTFRWKGENVATTEVAEVFEALDFLQEVNVYGVTVPGHEGRAGMAALVLRPPHALDLMQLYTHVSENLPPYARPRFLRLQAVGAYLPLTTARYSALLAGNLRI

SEQ ID NO: 81195 - protein, 144 aa, Homo sapiens
  Payload ID: 16180
  Gene Symbol: SLC27A3
  Gene Name: solute carrier family 27 (fatty acid transporter), member 3
  ENSP ID: ENSP00000433959
VGSGLRPDTWERFVRRFGPLQVLETYGLTEGNVATINYTGQRGAVGRASWLYKHIFPFSLIRYDVTTGEPIRDPQGHCMATSPGFLRFHDRTGDTFRWKGENVATTEVAEVFEALDFLQEVNVYGVTVPGHEGRAGMAALVLRP

SEQ ID NO: 81196 - protein, 152 aa, Homo sapiens
  Payload ID: 16180
  Gene Symbol: SLC27A3
  Gene Name: solute carrier family 27 (fatty acid transporter), member 3
  ENSP ID: ENSP00000434025
QFGTPRGTVWPHLQLAQGKLLKDVFRPGDVFFNTGDLLVCDDQGFLRFHDRTGDTFRWKGENVATTEVAEVFEALDFLQEVNVYGVTVPGHEGRAGMAALVLRPPHALDLMQLYTHVSENLPPYARPRFLRLQESLATTETFKQQKVRMANE

SEQ ID NO: 81197 - protein, 811 aa, Homo sapiens; identical to SEQ ID NO: 81192
  Payload ID: 16180
  Gene Symbol: SLC27A3
  Gene Name: solute carrier family 27 (fatty acid transporter), member 3
  ENSP ID: ENSP00000458504

SEQ ID NO: 81198 - protein, 152 aa, Homo sapiens; identical to SEQ ID NO: 81196
  Payload ID: 16180
  Gene Symbol: SLC27A3
  Gene Name: solute carrier family 27 (fatty acid transporter), member 3
  ENSP ID: ENSP00000458639

SEQ ID NO: 81199 - protein, 400 aa, Homo sapiens; identical to SEQ ID NO: 81194
  Payload ID: 16180
  Gene Symbol: SLC27A3
  Gene Name: solute carrier family 27 (fatty acid transporter), member 3
  ENSP ID: ENSP00000461019
  MOD_RES (1)..(1): Any amino acid

SEQ ID NO: 81200 - protein, 144 aa, Homo sapiens; identical to SEQ ID NO: 81195
  Payload ID: 16180
  Gene Symbol: SLC27A3
  Gene Name: solute carrier family 27 (fatty acid transporter), member 3
  ENSP ID: ENSP00000461185

SEQ ID NO: 81201 - protein, 730 aa, Homo sapiens; identical to SEQ ID NO: 81193
  Payload ID: 16180
  Gene Symbol: SLC27A3
  Gene Name: solute carrier family 27 (fatty acid transporter), member 3
  Uniprot ID: Q5K4L6
  ENSP ID: ENSP00000485061

SEQ ID NO: 81202 - protein, 730 aa, Homo sapiens; identical to SEQ ID NO: 81193
  Payload ID: 16180
  Gene Symbol: SLC27A3
  Gene Name: solute carrier family 27 (fatty acid transporter), member 3
  Uniprot ID: Q5K4L6
  ENSP ID: ENSP00000485585

SEQ ID NO: 81203 - protein, 643 aa, Homo sapiens
  Payload ID: 16181
  Gene Symbol: SLC27A4
  Gene Name: solute carrier family 27 (fatty acid transporter), member 4
  Uniprot ID: Q6P1M0
  ENSP ID: ENSP00000300456
MLLGASLVGVLLFSKLVLKLPWTQVGFSLLFLYLGSGGWRFIRVFIKTIRRDIFGGLVLLKVKAKVRQCLQERRTVPILFASTVRRHPDKTALIFEGTDTHWTFRQLDEYSSSVANFLQARGLASGDVAAIFMENRNEFVGLWLGMAKLGVEAALINTNLRRDALLHCLTTSRARALVFGSEMASAICEVHASLDPSLSLFCSGSWEPGAVPPSTEHLDPLLKDAPKHLPSCPDKGFTDKLFYIYTSGTTGLPKAAIVVHSRYYRMAALVYYGFRMRPNDIVYDCLPLYHSAGNIVGIGQCLLHGMTVVIRKKFSASRFWDDCIKYNCTIVQYIGELCRYLLNQPPREAENQHQVRMALGNGLRQSIWTNFSSRFHIPQVAEFYGATECNCSLGNFDSQVGACGFNSRILSFVYPIRLVRVNEDTMELIRGPDGVCIPCQPGEPGQLVGRIIQKDPLRRFDGYLNQGANNKKIAKDVFKKGDQAYLTGDVLVMDELGYLYFRDRTGDTFRWKGENVSTTEVEGTLSRLLDMADVAVYGVEVPGTEGRAGMAAVASPTGNCDLERFAQVLEKELPLYARPIFLRLLPELHKTGTYKFQKTELRKEGFDPAIVKDPLFYLDAQKGRYVPLDQEAYSRIQAGEEKL

SEQ ID NO: 81204 - protein, 237 aa, Homo sapiens
  Payload ID: 16181
  Gene Symbol: SLC27A4
  Gene Name: solute carrier family 27 (fatty acid transporter), member 4
  Uniprot ID: Q6P1M0
  ENSP ID: ENSP00000361961
MPLTLSTLLQPGRIWTGRRAAEPTPGHNAAWSLSGGGAAVLQAGAETALDPGGILPVVPLLGIWRLALHPGLHQDHQAYLTGDVLVMDELGYLYFRDRTGDTFRWKGENVSTTEVEGTLSRLLDMADVAVYGVEVPGTEGRAGMAAVASPTGNCDLERFAQVLEKELPLYARPIFLRLLPELHKTGTYKFQKTELRKEGFDPAIVKDPLFYLDAQKGRYVPLDQEAYSRIQAGEEKL

SEQ ID NO: 81205 - protein, 690 aa, Homo sapiens
  Payload ID: 16182
  Gene Symbol: SLC27A5
  Gene Name: solute carrier family 27 (fatty acid transporter), member 5
  Uniprot ID: Q9Y2P5
  ENSP ID: ENSP00000263093
MGVRQQLALLLLLLLLLWGLGQPVWPVAVALTLRWLLGDPTCCVLLGLAMLARPWLGPWVPHGLSLAAAALALTLLPARLPPGLRWLPADVIFLAKILHLGLKIRGCLSRQPPDTFVDAFERRARAQPGRALLVWTGPGAGSVTFGELDARACQAAWALKAELGDPASLCAGEPTALLVLASQAVPALCMWLGLAKLGCPTAWINPHGRGMPLAHSVLSSGARVLVVDPDLRESLEEILPKLQAENIRCFYLSHTSPTPGVGALGAALDAAPSHPVPADLRAGITWRSPALFIYTSGTTGLPKPAILTHERVLQMSKMLSLSGATADDVVYTVLPLYHVMGLVVGILGCLDLGATCVLAPKFSTSCFWDDCRQHGVTVILYVGELLRYLCNIPQQPEDRTHTVRLAMGNGLRADVWETFQQRFGPIRIWEVYGSTEGNMGLVNYVGRCGALGKMSCLLRMLSPFELVQFDMEAAEPVRDNQGFCIPVGLGEPGLLLTKVVSQQPFVGYRGPRELSERKLVRNVRQSGDVYYNTGDVLAMDREGFLYFRDRLGDTFRWKGENVSTHEVEGVLSQVDFLQQVNVYGVCVPGCEGKVGMAAVQLAPGQTFDGEKLYQHVRAWLPAYATPHFIRIQDAMEVTSTFKLMKTRLVREGFNVGIVVDPLFVLDNRAQSFRPLTAEMYQAVCEGTWRL

SEQ ID NO: 81206 - protein, 95 aa, Homo sapiens
  Payload ID: 16182
  Gene Symbol: SLC27A5
  Gene Name: solute carrier family 27 (fatty acid transporter), member 5
  ENSP ID: ENSP00000469512
MAAVQLAPGQTFDGEKLYQHVRAWLPAYATPHFIRIQDAMEVTSTFKLMKTRLVREGFNVGIVVDPLFVLDNRAQSFRPLTAEMYQAVCEGTWRL

SEQ ID NO: 81207 - protein, 606 aa, Homo sapiens
  Payload ID: 16182
  Gene Symbol: SLC27A5
  Gene Name: solute carrier family 27 (fatty acid transporter), member 5
  Uniprot ID: Q9Y2P5
  ENSP ID: ENSP00000470368
MGVRQQLALLLLLLLLLWGLGQPVWPVAVALTLRWLLGDPTCCVLLGLAMLARPWLGPWVPHGLSLAAAALALTLLPARLPPGLRWLPADVIFLAKILHLGLKIRGCLSRQPPDTFVDAFERRARAQPGRALLVWTGPGAGSVTFDLRESLEEILPKLQAENIRCFYLSHTSPTPGVGALGAALDAAPSHPVPADLRAGITWRSPALFIYTSGTTGLPKPAILTHERVLQMSKMLSLSGATADDVVYTVLPLYHVMGLVVGILGCLDLGATCVLAPKFSTSCFWDDCRQHGVTVILYVGELLRYLCNIPQQPEDRTHTVRLAMGNGLRADVWETFQQRFGPIRIWEVYGSTEGNMGLVNYVGRCGALGKMSCLLRMLSPFELVQFDMEAAEPVRDNQGFCIPVGLGEPGLLLTKVVSQQPFVGYRGPRELSERKLVRNVRQSGDVYYNTGDVLAMDREGFLYFRDRLGDTFRWKGENVSTHEVEGVLSQVDFLQQVNVYGVCVPGCEGKVGMAAVQLAPGQTFDGEKLYQHVRAWLPAYATPHFIRIQDAMEVTSTFKLMKTRLVREGFNVGIVVDPLFVLDNRAQSFRPLTAEMYQAVCEGTWRL

SEQ ID NO: 81208 - protein, 95 aa, Homo sapiens; identical to SEQ ID NO: 81206
  Payload ID: 16182
  Gene Symbol: SLC27A5
  Gene Name: solute carrier family 27 (fatty acid transporter), member 5
  ENSP ID: ENSP00000471065

SEQ ID NO: 81209 - protein, 619 aa, Homo sapiens
  Payload ID: 16183
  Gene Symbol: SLC27A6
  Gene Name: solute carrier family 27 (fatty acid transporter), member 6
  Uniprot ID: Q9Y2P4
  ENSP ID: ENSP00000262462
MLLSWLTVLGAGMVVLHFLQKLLFPYFWDDFWFVLKVVLIIIRLKKYEKRGELVTVLDKFLSHAKRQPRKPFIIYEGDIYTYQDVDKRSSRVAHVFLNHSSLKKGDTVALLMSNEPDFVHVWFGLAKLGCVVAFLNTNIRSNSLLNCIRACGPRALVVGADLLGTVEEILPSLSENISVWGMKDSVPQGVISLKEKLSTSPDEPVPRSHHVVSLLKSTCLYIFTSGTTGLPKAAVISQLQVLRGSAVLWAFGCTAHDIVYITLPLYHSSAAILGISGCVELGATCVLKKKFSASQFWSDCKKYDVTVFQYIGELCRYLCKQSKREGEKDHKVRLAIGNGIRSDVWREFLDRFGNIKVCELYAATESSISFMNYTGRIGAIGRTNLFYKLLSTFDLIKYDFQKDEPMRNEQGWCIHVKKGEPGLLISRVNAKNPFFGYAGPYKHTKDKLLCDVFKKGDVYLNTGDLIVQDQDNFLYFWDRTGDTFRWKGENVATTEVADVIGMLDFIQEANVYGVAISGYEGRAGMASIILKPNTSLDLEKVYEQVVTFLPAYACPRFLRIQEKMEATGTFKLLKHQLVEDGFNPLKISEPLYFMDNLKKSYVLLTRELYDQIMLGEIKL

SEQ ID NO: 81210 - protein, 619 aa, Homo sapiens; identical to SEQ ID NO: 81209
  Payload ID: 16183
  Gene Symbol: SLC27A6
  Gene Name: solute carrier family 27 (fatty acid transporter), member 6
  Uniprot ID: Q9Y2P4
  ENSP ID: ENSP00000378684

SEQ ID NO: 81211 - protein, 619 aa, Homo sapiens; identical to SEQ ID NO: 81209
  Payload ID: 16183
  Gene Symbol: SLC27A6
  Gene Name: solute carrier family 27 (fatty acid transporter), member 6
  Uniprot ID: Q9Y2P4
  ENSP ID: ENSP00000421024

SEQ ID NO: 81212 - protein, 162 aa, Homo sapiens
  Payload ID: 16183
  Gene Symbol: SLC27A6
  Gene Name: solute carrier family 27 (fatty acid transporter), member 6
  ENSP ID: ENSP00000421759
MKDSVPQGVISLKEKLSTSPDEPVPRSHHVVSLLKSTCLYIFTSGTTGLPKAAVISQLQVLRGSAVLWAFGCTAHDIVYITLPLYHSSAAILGISGCVELGATCVLKKKFSASQFWSDCKKYDVTVFQYIGELCRYLCKQSKREGEKDHKVRLAIGNGIRSD

SEQ ID NO: 81213 - protein, 649 aa, Homo sapiens
  Payload ID: 16184
  Gene Symbol: SLC28A1
  Gene Name: solute carrier family 28 (concentrative nucleoside transporter), member 1
  Uniprot ID: O00337
  ENSP ID: ENSP00000286749
MENDPSRRRESISLTPVAKGLENMGADFLESLEEGQLPRSDLSPAEIRSSWSEAAPKPFSRWRNLQPALRARSFCREHMQLFRWIGTGLLCTGLSAFLLVACLLDFQRALALFVLTCVVLTFLGHRLLKRLLGPKLRRFLKPQGHPRLLLWFKRGLALAAFLGLVLWLSLDTSQRPEQLVSFAGICVFVALLFACSKHHCAVSWRAVSWGLGLQFVLGLLVIRTEPGFIAFEWLGEQIRIFLSYTKAGSSFVFGEALVKDVFAFQVLPIIVFFSCVISVLYHVGLMQWVILKIAWLMQVTMGTTATETLSVAGNIFVSQTEAPLLIRPYLADMTLSEVHVVMTGGYATIAGSLLGAYISFGIDATSLIAASVMAAPCALALSKLVYPEVEESKFRREEGVKLTYGDAQNLIEAASTGAAISVKVVANIAANLIAFLAVLDFINAALSWLGDMVDIQGLSFQLICSYILRPVAFLMGVAWEDCPVVAELLGIKLFLNEFVAYQDLSKYKQRRLAGAEEWVGDRKQWISVRAEVLTTFALCGFANFSSIGIMLGGLTSMVPQRKSDFSQIVLRALFTGACVSLVNACMAGILYMPRGAEVDCMSLLNTTLSSSSFEIYQCCREAFQSVNPEFSPEALDNCCRFYNHTICAQ

SEQ ID NO: 81214 - protein, 175 aa, Homo sapiens
  Payload ID: 16184
  Gene Symbol: SLC28A1
  Gene Name: solute carrier family 28 (concentrative nucleoside transporter), member 1
  Uniprot ID: O00337
  ENSP ID: ENSP00000341629
MENDPSRRRESISLTPVAKGLENMGADFLESLEEGQLPRSDLSPAEIRSSWSEAAPKPFSRWRNLQPALRARSFCREHMQLFRWIGTGLLCTGLSAFLLVACLLDFQRALALFVLTCVVLTFLGHRLLKRLLGPKLRRFLKPQGHPRLLLWFKRDPRPWSKEGPNQYLPQITWTV

SEQ ID NO: 81215 - protein, 649 aa, Homo sapiens; identical to SEQ ID NO: 81213
  Payload ID: 16184
  Gene Symbol: SLC28A1
  Gene Name: solute carrier family 28 (concentrative nucleoside transporter), member 1
  Uniprot ID: O00337
  ENSP ID: ENSP00000378074

SEQ ID NO: 81216 - protein, 483 aa, Homo sapiens
  Payload ID: 16184
  Gene Symbol: SLC28A1
  Gene Name: solute carrier family 28 (concentrative nucleoside transporter), member 1
  ENSP ID: ENSP00000443752
MENDPSRRRESISLTPVAKGLENMGADFLESLEEGQLPRSDLSPAEIRSSWSEAAPKPFSRWRNLQPALRARSFCREHMQLFRWIGTGLLCTGLSAFLLVACLLDFQRALALFVLTCVVLTFLGHRLLKRLLGPKLRRFLKPQGHPRLLLWFKRGLALAAFLGLVLWLSLDTSQRPEQLVSFAGICVFVALLFACSKHHCAVSWRAVSWGLGLQFVLGLLVIRTEPGFIAFEWLGEQIRIFLSYTKAGSSFVFGEALVKDVFAFQVLPIIVFFSCVISVLYHVGLMQWVILKIAWLMQVTMGTTATETLSVAGNIFVSQTEAPLLIRPYLADMTLSEVHVVMTGGYATIAGSLLGAYISFGVRAEVLTTFALCGFANFSSIGIMLGGLTSMVPQRKSDFSQIVLRALFTGACVSLVNACMAGILYMPRGAEVDCMSLLNTTLSSSSFEIYQCCREAFQSVNPEFSPEALDNCCRFYNHTICAQ

SEQ ID NO: 81217 - protein, 658 aa, Homo sapiens
  Payload ID: 16185
  Gene Symbol: SLC28A2
  Gene Name: solute carrier family 28 (concentrative nucleoside transporter), member 2
  Uniprot ID: O43868
  ENSP ID: ENSP00000315006
MEKASGRQSIALSTVETGTVNPGLELMEKEVEPEGSKRTDAQGHSLGDGLGPSTYQRRSRWPFSKARSFCKTHASLFKKILLGLLCLAYAAYLLAACILNFQRALALFVITCLVIFVLVHSFLKKLLGKKLTRCLKPFENSRLRLWTKWVFAGVSLVGLILWLALDTAQRPEQLIPFAGICMFILILFACSKHHSAVSWRTVFSGLGLQFVFGILVIRTDLGYTVFQWLGEQVQIFLNYTVAGSSFVFGDTLVKDVFAFQALPIIIFFGCVVSILYYLGLVQWVVQKVAWFLQITMGTTATETLAVAGNIFVGMTEAPLLIRPYLGDMTLSEIHAVMTGGFATISGTVLGAFIAFGVDASSLISASVMAAPCALASSKLAYPEVEESKFKSEEGVKLPRGKERNVLEAASNGAVDAIGLATNVAANLIAFLAVLAFINAALSWLGELVDIQGLTFQVICSYLLRPMVFMMGVEWTDCPMVAEMVGIKFFINEFVAYQQLSQYKNKRLSGMEEWIEGEKQWISVRAEIITTFSLCGFANLSSIGITLGGLTSIVPHRKSDLSKVVVRALFTGACVSLISACMAGILYVPRGAEADCVSFPNTSFTNRTYETYMCCRGLFQSTSLNGTNPPSFSGPWEDKEFSAMALTNCCGFYNNTVCA

SEQ ID NO: 81218 - protein, 71 aa, Homo sapiens
  Payload ID: 16185
  Gene Symbol: SLC28A2
  Gene Name: solute carrier family 28 (concentrative nucleoside transporter), member 2
  ENSP ID: ENSP00000454046
  MOD_RES (1)..(1): Any amino acid
XYAAYLLAACILNFQRALALFVITCLVIFVLVHSFLKKLLGKKLTRCLKPFENSRLRLWTKWCPGGQCFRA

SEQ ID NO: 81219 - protein, 193 aa, Homo sapiens
  Payload ID: 16185
  Gene Symbol: SLC28A2
  Gene Name: solute carrier family 28 (concentrative nucleoside transporter), member 2
  ENSP ID: ENSP00000454074
SPSLRSQRESIPQAGEKEVEPEGSKRTDAQGHSLGDGLGPSTYQRRSRWPFSKARSFCKTHASLFKKILLGLLCLAYAAYLLAACILNFQRALALFVITCLVIFVLVHSFLKKLLGKKLTRCLKPFENSRLRLWTKWVFAGVSLVGLILWLALDTAQRPEQLIPFAGICMFILILFACSKHHSAVSWRTVFSG

SEQ ID NO: 81220 - protein, 691 aa, Homo sapiens
  Payload ID: 16186
  Gene Symbol: SLC28A3
  Gene Name: solute carrier family 28 (concentrative nucleoside transporter), member 3
  Uniprot ID: Q9HAS3
  ENSP ID: ENSP00000365413
MELRSTAAPRAEGYSNVGFQNEENFLENENTSGNNSIRSRAVQSREHTNTKQDEEQVTVEQDSPRNREHMEDDDEEMQQKGCLERRYDTVCGFCRKHKTTLRHIIWGILLAGYLVMVISACVLNFHRALPLFVITVAAIFFVVWDHLMAKYEHRIDEMLSPGRRLLNSHWFWLKWVIWSSLVLAVIFWLAFDTAKLGQQQLVSFGGLIMYIVLLFLFSKYPTRVYWRPVLWGIGLQFLLGLLILRTDPGFIAFDWLGRQVQTFLEYTDAGASFVFGEKYKDHFFAFKVLPIVVFFSTVMSMLYYLGLMQWIIRKVGWIMLVTTGSSPIESVVASGNIFVGQTESPLLVRPYLPYITKSELHAIMTAGFSTIAGSVLGAYISFGVPSSHLLTASVMSAPASLAAAKLFWPETEKPKITLKNAMKMESGDSGNLLEAATQGASSSISLVANIAVNLIAFLALLSFMNSALSWFGNMFDYPQLSFELICSYIFMPFSFMMGVEWQDSFMVARLIGYKTFFNEFVAYEHLSKWIHLRKEGGPKFVNGVQQYISIRSEIIATYALCGFANIGSLGIVIGGLTSMAPSRKRDIASGAVRALIAGTVACFMTACIAGILSSTPVDINCHHVLENAFNSTFPGNTTKVIACCQSLLSSTVAKGPGEVIPGGNHSLYSLKGCCTLLNPSTFNCNGISNTF

SEQ ID NO: 81221 - protein, 456 aa, Homo sapiens [sequence omitted]

SEQ ID NO: 81222 - protein, 456 aa, Homo sapiens [sequence omitted]

SEQ ID NO: 81223 - protein, 456 aa, Homo sapiens [sequence omitted]

SEQ ID NO: 81224 - protein, 456 aa, Homo sapiens [sequence omitted]

SEQ ID NO: 81225 - protein, 456 aa, Homo sapiens [sequence omitted]

SEQ ID NO: 81226 - protein, 456 aa, Homo sapiens [sequence omitted]

SEQ ID NO: 81227 - protein, 456 aa, Homo sapiens [sequence omitted]

SEQ ID NO: 81228 - protein, 456 aa, Homo sapiens [sequence omitted]

SEQ ID NO: 81229 - protein, 456 aa, Homo sapiens [sequence omitted]

SEQ ID NO: 81230 - protein, 361 aa, Homo sapiens
  Payload ID: 16188
  Gene Symbol: SLC29A2
  Gene Name: solute carrier family 29 (equilibrative nucleoside transporter), member 2
  ENSP ID: ENSP00000311250
MARGDAPRDSYHLVGISFFILGLGTLLPWNFFITAIPYFQARLAGAGNSTARILSTNHTGPEDAFNFNNWVTLLSQLPLLLFTLLNSFLYQCVPETVRILGSLLAILLLFALTAALVKVDMSPGPFFSITMASVCFINSFSAVLQGSLFGQLGTMPSTYSTLFLSGQGLAGIFAALAMLLSMASGVDAETSALGYFITPCVGILMSIVCYLSLPHLKFARYYLANKSSQAQAQELETKAELLQSDLADSAVPCVGLHSHPVRLPRHHSHGDQLHQSWEVESVLQPHLLLPPLQHHGLAGTEPDLLLPVARRGQPAAAPAGLPAVPVRAPLHAVPRAPEVPAAHPLPTGCLLHHLHAALCRF

SEQ ID NO: 81231 - protein, 456 aa, Homo sapiens
  Payload ID: 16188
  Gene Symbol: SLC29A2
  Gene Name: solute carrier family 29 (equilibrative nucleoside transporter), member 2
  Uniprot ID: Q14542
  ENSP ID: ENSP00000350024
MARGDAPRDSYHLVGISFFILGLGTLLPWNFFITAIPYFQARLAGAGNSTARILSTNHTGPEDAFNFNNWVTLLSQLPLLLFTLLNSFLYQCVPETVRILGSLLAILLLFALTAALVKVDMSPGPFFSITMASVCFINSFSAVLQGSLFGQLGTMPSTYSTLFLSGQGLAGIFAALAMLLSMASGVDAETSALGYFITPCVGILMSIVCYLSLPHLKFARYYLANKSSQAQAQELETKAELLQSDENGIPSSPQKVALTLDLDLEKEPESEPDEPQKPGKPSVFTVFQKIWLTALCLVLVFTVTLSVFPAITAMVTSSTSPGKWSQFFNPICCFLLFNIMDWLGRSLTSYFLWPDEDSRLLPLLVCLRFLFVPLFMLCHVPQRSRLPILFPQDAYFITFMLLFAVSNGYLVSLTMCLAPRQVLPHEREVAGALMTFFLALGLSCGASLSFLFKALL

SEQ ID NO: 81232 - protein, 456 aa, Homo sapiens; identical to SEQ ID NO: 81231
  Payload ID: 16188
  Gene Symbol: SLC29A2
  Gene Name: solute carrier family 29 (equilibrative nucleoside transporter), member 2
  Uniprot ID: Q14542
  ENSP ID: ENSP00000439456

SEQ ID NO: 81233 - protein, 456 aa, Homo sapiens; identical to SEQ ID NO: 81231
  Payload ID: 16188
  Gene Symbol: SLC29A2
  Gene Name: solute carrier family 29 (equilibrative nucleoside transporter), member 2
  Uniprot ID: Q14542
  ENSP ID: ENSP00000440329

SEQ ID NO: 81234 - protein, 202 aa, Homo sapiens
  Payload ID: 16188
  Gene Symbol: SLC29A2
  Gene Name: solute carrier family 29 (equilibrative nucleoside transporter), member 2
  Uniprot ID: Q14542
  ENSP ID: ENSP00000442116
MARGDAPRDSYHLVGISFFILGLGTLLPWNFFITAIPYFQARLAGAGNSTARILSTNHTGPEDAFNFNNWVTLLSQLPLLLFTLLNSFLYQCAGQGGHEPRTLLLHHHGLRLLHQLLQCSPTGQPLRAAGHHALHLQHPLPQRPGPGWDLCCPCHAPVHGQWRGRRDLCPGVLYHALCGHPHVHRVLPEPASPEVCPLLPGQ

SEQ ID NO: 81235 - protein, 301 aa, Homo sapiens
  Payload ID: 16188
  Gene Symbol: SLC29A2
  Gene Name: solute carrier family 29 (equilibrative nucleoside transporter), member 2
  Uniprot ID: Q14542
  ENSP ID: ENSP00000444870
MARGDAPRDSYHLVGISFFILGLGTLLPWNFFITAIPYFQARLAGAGNSTARILSTNHTGPEDAFNFNNWVTLLSQLPLLLFTLLNSFLYQCVPETVRILGSLLAILLLFALTAALVKVDMSPGPFFSITMASVCFINSFSAVLQGSLFGQLGTMPSTYSTLFLSGQGLAGIFAALAMLLSMASGVDAETSALGYFITPCVGILMSIVCYLSLPHLKFARYYLANKSSQAQAQELETKAELLQSDENGIPSSPQKVALTLDLDLEKEPESEPDEPQKPGKPSVFTVFQKSPCPSSPPSQPW

SEQ ID NO: 81236 - protein, 361 aa, Homo sapiens; identical to SEQ ID NO: 81230
  Payload ID: 16188
  Gene Symbol: SLC29A2
  Gene Name: solute carrier family 29 (equilibrative nucleoside transporter), member 2
  ENSP ID: ENSP00000481944

SEQ ID NO: 81237 - protein, 475 aa, Homo sapiens
  Payload ID: 16189
  Gene Symbol: SLC29A3
  Gene Name: solute carrier family 29 (equilibrative nucleoside transporter), member 3
  Uniprot ID: Q9BZD2
  ENSP ID: ENSP00000362285
MAVVSEDDFQHSSNSTYRTTSSSLRADQEALLEKLLDRPPPGLQRPEDRFCGTYIIFFSLGIGSLLPWNFFITAKEYWMFKLRNSSSPATGEDPEGSDILNYFESYLAVASTVPSMLCLVANFLLVNRVAVHIRVLASLTVILAIFMVITALVKVDTSSWTRGFFAVTIVCMVILSGASTVFSSSIYGMTGSFPMRNSQALISGGAMGGTVSAVASLVDLAASSDVRNSALAFFLTATVFLVLCMGLYLLLSRLEYARYYMRPVLAAHVFSGEEELPQDSLSAPSVASRFIDSHTPPLRPILKKTASLGFCVTYVFFITSLIYPAICTNIESLNKGSGSLWTTKFFIPLTTFLLYNFADLCGRQLTAWIQVPGPNSKALPGFVLLRTCLIPLFVLCNYQPRVHLKTVVFQSDVYPALLSSLLGLSNGYLSTLALLYGPKIVPRELAEATGVVMSFYVCLGLTLGSACSTLLVHLI

SEQ ID NO: 81238 - protein, 530 aa, Homo sapiens
  Payload ID: 16190
  Gene Symbol: SLC29A4
  Gene Name: solute carrier family 29 (equilibrative nucleoside transporter), member 4
  Uniprot ID: Q7RTT9
  ENSP ID: ENSP00000297195
MGSVGSQRLEEPSVAGTPDPGVVMSFTFDSHQLEEAAEAAQGQGLRARGVPAFTDTTLDEPVPDDRYHAIYFAMLLAGVGFLLPYNSFITDVDYLHHKYPGTSIVFDMSLTYILVALAAVLLNNVLVERLTLHTRITAGYLLALGPLLFISICDVWLQLFSRDQAYAINLAAVGTVAFGCTVQQSSFYGYTGMLPKRYTQGVMTGESTAGVMISLSRILTKLLLPDERASTLIFFLVSVALELLCFLLHLLVRRSRFVLFYTTRPRDSHRGRPGLGRGYGYRVHHDVVAGDVHFEHPAPALAPNESPKDSPAHEVTGSGGAYMRFDVPRPRVQRSWPTFRALLLHRYVVARVIWADMLSIAVTYFITLCLFPGLESEIRHCILGEWLPILIMAVFNLSDFVGKILAALPVDWRGTHLLACSCLRVVFIPLFILCVYPSGMPALRHPAWPCIFSLLMGISNGYFGSVPMILAAGKVSPKQRELAGNTMTVSYMSGLTLGSAVAYCTYSLTRDAHGSCLHASTANGSILAGL

SEQ ID NO: 81239 - protein, 530 aa, Homo sapiens; identical to SEQ ID NO: 81238
  Payload ID: 16190
  Gene Symbol: SLC29A4
  Gene Name: solute carrier family 29 (equilibrative nucleoside transporter), member 4
  Uniprot ID: Q7RTT9
  ENSP ID: ENSP00000380081

SEQ ID NO: 81240 - protein, 516 aa, Homo sapiens
  Payload ID: 16190
  Gene Symbol: SLC29A4
  Gene Name: solute carrier family 29 (equilibrative nucleoside transporter), member 4
  Uniprot ID: Q7RTT9
  ENSP ID: ENSP00000385845
MGSVGSQRLEEPSVAGTPDPGVVMSFTFDSHQLEEAAEAAQGQGLRARGVPAFTDTTLDEPVPDDRYHAIYFAMLLAGVGFLLPYNSFITDVDYLHHKYPGTSIVFDMSLTYILVALAAVLLNNVLVERLTLHTRITAASATCGCSSSLGTRPTPSTWPLWAPWPSAAQQSSFYGYTGMLPKRYTQGVMTGESTAGVMISLSRILTKLLLPDERASTLIFFLVSVALELLCFLLHLLVRRSRFVLFYTTRPRDSHRGRPGLGRGYGYRVHHDVVAGDVHFEHPAPALAPNESPKDSPAHEVTGSGGAYMRFDVPRPRVQRSWPTFRALLLHRYVVARVIWADMLSIAVTYFITLCLFPGLESEIRHCILGEWLPILIMAVFNLSDFVGKILAALPVDWRGTHLLACSCLRVVFIPLFILCVYPSGMPALRHPAWPCIFSLLMGISNGYFGSVPMILAAGKVSPKQRELAGNTMTVSYMSGLTLGSAVAYCTYSLTRDAHGSCLHASTANGSILAGL

SEQ ID NO: 81241 - protein, 163 aa, Homo sapiens
  Payload ID: 16190
  Gene Symbol: SLC29A4
  Gene Name: solute carrier family 29 (equilibrative nucleoside transporter), member 4
  ENSP ID: ENSP00000406803
MGSVGSQRLEEPSVAGTPDPGVVMSFTFDSHQLEEAAEAAQGQGLRARGVPAFTDTTLDEPVPDDRYHAIYFAMLLAGVGFLLPYNSFITDVDYLHHKYPGTSIVFDMSLTYILVALAAVLLNNVLVERLTLHTRITAGYLLALGPLLFISICDVWLQLFSRD

SEQ ID NO: 81242 - protein, 151 aa, Homo sapiens
  Payload ID: 16190
  Gene Symbol: SLC29A4
  Gene Name: solute carrier family 29 (equilibrative nucleoside transporter), member 4
  ENSP ID: ENSP00000413271
MGSVGSQRLEEPSVAGTPDPGVVMSFTFDSHQLEEAAEAAQGQGLRARGVPAFTDTTLDEPVPDDRYHAIYFAMLLAGVGFLLPYNSFITDVDYLHHKYPGTSIVFDMSLTYILVALAAVLLNNVLVERLTLHTRITAASATCGCSSSLGT

SEQ ID NO: 81243 - protein, 685 aa, Homo sapiens
  Payload ID: 16191
  Gene Symbol: SLC3A1
  Gene Name: solute carrier family 3 (amino acid transporter heavy chain), member 1
  Uniprot ID: Q07837
  ENSP ID: ENSP00000260649
MAEDKSKRDSIEMSMKGCQTNNGFVHNEDILEQTPDPGSSTDNLKHSTRGILGSQEPDFKGVQPYAGMPKEVLFQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDINTLRSKSPMQWDNSSNAGFSEASNTWLPTNSDYHTVNVDVQKTQPRSALKLYQDLSLLHANELLLNRGWFCHLRNDSHYVVYTRELDGIDRIFIVVLNFGESTLLNLHNMISGLPAKMRIRLSTNSADKGSKVDTSGIFLDKGEGLIFEHNTKNLLHRQTAFRDRCFVSNRACYSSVLNILYTSC

SEQ ID NO: 81244 - protein, 564 aa, Homo sapiens
  Payload ID: 16191
  Gene Symbol: SLC3A1
  Gene Name: solute carrier family 3 (amino acid transporter heavy chain), member 1
  Uniprot ID: Q07837
  ENSP ID: ENSP00000386620
MAEDKSKRDSIEMSMKGCQTNNGFVHNEDILEQTPDPGSSTDNLKHSTRGILGSQEPDFKGVQPYAGMPKEVLFQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDINTLRSKSPMQWDNSSNAGFSEASNTWLPTNSDYHTVNVDVSISENFMLILETKKWVSTESTHSP

SEQ ID NO: 81245 - protein, 316 aa, Homo sapiens
  Payload ID: 16191
  Gene Symbol: SLC3A1
  Gene Name: solute carrier family 3 (amino acid transporter heavy chain), member 1
  Uniprot ID: Q07837
  ENSP ID: ENSP00000386677
MTLNLVNSYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDINTLRSKSPMQWDNSSNAGFSEASNTWLPTNSDYHTVNVDVQKTQPRSALKLYQDLSLLHANELLLNRGWFCHLRNDSHYVVYTRELDGIDRIFIVVLNFGESTLLNLHNMISGLPAKMRIRLSTNSADKGSKVDTSGIFLDKGEGLIFEHNTKNLLHRQTAFRDRCFVSNRACYSSVLNILYTSC

SEQ ID NO: 81246 - protein, 407 aa, Homo sapiens
  Payload ID: 16191
  Gene Symbol: SLC3A1
  Gene Name: solute carrier family 3 (amino acid transporter heavy chain), member 1
  Uniprot ID: Q07837
  ENSP ID: ENSP00000386709
MKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDINTLRSKSPMQWDNSSNAGFSEASNTWLPTNSDYHTVNVDVQKTQPRSALKLYQDLSLLHANELLLNRGWFCHLRNDSHYVVYTRELDGIDRIFIVVLNFGESTLLNLHNMISGLPAKMRIRLSTNSADKGSKVDTSGIFLDKGEGLIFEHNTKNLLHRQTAFRDRCFVSNRACYSSVLNILYTSC

SEQ ID NO: 81247 - protein, 184 aa, Homo sapiens
  Payload ID: 16191
  Gene Symbol: SLC3A1
  Gene Name: solute carrier family 3 (amino acid transporter heavy chain), member 1
  ENSP ID: ENSP00000386852
MGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDINTLRSKSPMQWDNSSNAGFSEASNTWLPTNSDYHTVNVDVSISENFMLILETKKWVSTESTHSP

SEQ ID NO: 81248 - protein, 502 aa, Homo sapiens
  Payload ID: 16191
  Gene Symbol: SLC3A1
  Gene Name: solute carrier family 3 (amino acid transporter heavy chain), member 1
  Uniprot ID: Q07837
  ENSP ID: ENSP00000386954
MAEDKSKRDSIEMSMKGCQTNNGFVHNEDILEQTPDPGSSTDNLKHSTRGILGSQEPDFKGVQPYAGMPKEVLFQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDIVS

SEQ ID NO: 81249 - protein, 564 aa, Homo sapiens
  Payload ID: 16191
  Gene Symbol: SLC3A1
  Gene Name: solute carrier family 3 (amino acid transporter heavy chain), member 1
  ENSP ID: ENSP00000387308
MAEDKSKRDSIEMSMKGCQTNNGFVHNEDILEQTPDPGSSTDNLKHSTRGILGSQEPDFKGVQPYAGMPKEVLFQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDINTLRSKSPMQWDNSSNAGFSEASNTWLPTNSDYHTVNVDSCSVTHARVQWRDLGTLQPLLPGFK

SEQ ID NO: 81250 - protein, 391 aa, Homo sapiens
  Payload ID: 16191
  Gene Symbol: SLC3A1
  Gene Name: solute carrier family 3 (amino acid transporter heavy chain), member 1
  Uniprot ID: Q07837
  ENSP ID: ENSP00000387337
MAEDKSKRDSIEMSMKGCQTNNGFVHNEDILEQTPDPGSSTDNLKHSTRGILGSQEPDFKGVQPYAGMPKEVLFQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRLTTAYALISSQA

SEQ ID NO: 81251 - protein, 143 aa, Homo sapiens
  Payload ID: 16191
  Gene Symbol: SLC3A1
  Gene Name: solute carrier family 3 (amino acid transporter heavy chain), member 1
  ENSP ID: ENSP00000391642
MSGMFLSSKLTTILLLFTNKSLDPGQKIQENTLLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFR

SEQ ID NO: 81252 - protein, 552 aa, Homo sapiens
  Payload ID: 16191
  Gene Symbol: SLC3A1
  Gene Name: solute carrier family 3 (amino acid transporter heavy chain), member 1
  ENSP ID: ENSP00000483618
MAEDKSKRDSIEMSMKGCQTNNGFVHNEDILEQTPDPGSSTDNLKHSTRGILGSQEPDFKGVQPYAGMPKEVLFQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDINTLRSKSPMQWDNSSNAGFSEASNTWLPTNSDYHTVNVDVILLRHPCSSAVA

SEQ ID NO: 81253 - protein, 529 aa, Homo sapiens
  Payload ID: 16192
  Gene Symbol: SLC3A2
  Gene Name: solute carrier family 3 (amino acid transporter heavy chain), member 2
  Uniprot ID: P08195
  ENSP ID: ENSP00000340815
MSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 81254 - protein, 568 aa, Homo sapiens
  Payload ID: 16192
  Gene Symbol: SLC3A2
  Gene Name: solute carrier family 3 (amino acid transporter heavy chain), member 2
  Uniprot ID: P08195
  ENSP ID: ENSP00000367121
MELQPPEASIAVVSIPRQLPGSHSEAGVQGLSAGDDSGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 81255 - protein, 630 aa, Homo sapiens
  Payload ID: 16192
  Gene Symbol: SLC3A2
  Gene Name: solute carrier family 3 (amino acid transporter heavy chain), member 2
  Uniprot ID: P08195
  ENSP ID: ENSP00000367122
MELQPPEASIAVVSIPRQLPGSHSEAGVQGLSAGDDSELGSHCVAQTGLELLASGDPLPSASQNAEMIETGSDCVTQAGLQLLASSDPPALASKNAEVTGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 81256 - protein, 631 aa, Homo sapiens
  Payload ID: 16192
  Gene Symbol: SLC3A2
  Gene Name: solute carrier family 3 (amino acid transporter heavy chain), member 2
  ENSP ID: ENSP00000367123
MELQPPEASIAVVSIPRQLPGSHSEAGVQGLSAGDDSETGSDCVTQAGLQLLASSDPPALASKNAEVTVETGFHHVSQADIEFLTSIDPTASASGSAGITGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 81257 - protein, 145 aa, Homo sapiens
  Payload ID: 16192
  Gene Symbol: SLC3A2
  Gene Name: solute carrier family 3 (amino acid transporter heavy chain), member 2
  ENSP ID: ENSP00000438032
MSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGLKGRLDYLSSLKVKGLVLGPIHKNQKDDVAQTDLLQIDPNFGSKEDF

SEQ ID NO: 81258 - protein, 67 aa, Homo sapiens
  Payload ID: 16192
  Gene Symbol: SLC3A2
  Gene Name: solute carrier family 3 (amino acid transporter heavy chain), member 2
  ENSP ID: ENSP00000438353
MLFTLPGTPVFSYGDEIGLDAAALPGQPMEAPVMLWDESSFPDIPGAVSANMTVKGQSEDPGSLLSL

SEQ ID NO: 81259 - protein, 247 aa, Homo sapiens
  Payload ID: 16192
  Gene Symbol: SLC3A2
  Gene Name: solute carrier family 3 (amino acid transporter heavy chain), member 2
  ENSP ID: ENSP00000440001
  MOD_RES (1)..(1): Any amino acid
XSQNAEMIETGSDCVTQAGLQLLASSDPPALASKNAEVTETGFHHVSQADIEFLTSIDPTASASGSAGITGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTD

SEQ ID NO: 81260 - protein, 122 aa, Homo sapiens
  Payload ID: 16192
  Gene Symbol: SLC3A2
  Gene Name: solute carrier family 3 (amino acid transporter heavy chain), member 2
  ENSP ID: ENSP00000440819
  MOD_RES (1)..(1): Any amino acid
XLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPHEGLLLRFPYAA

SEQ ID NO: 81261 - protein, 135 aa, Homo sapiens
  Payload ID: 16192
  Gene Symbol: SLC3A2
  Gene Name: solute carrier family 3 (amino acid transporter heavy chain), member 2
  ENSP ID: ENSP00000442135
MSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGH

SEQ ID NO: 81262 - protein, 599 aa, Homo sapiens
  Payload ID: 16192
  Gene Symbol: SLC3A2
  Gene Name: solute carrier family 3 (amino acid transporter heavy chain), member 2
  ENSP ID: ENSP00000444236
MELQPPEASIAVVSIPRQLPGSHSEAGVQGLSAGDDSETGSDCVTQAGLQLLASSDPPALASKNAEVTGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 81263 - protein, 47 aa, Homo sapiens
  Payload ID: 16192
  Gene Symbol: SLC3A2
  Gene Name: solute carrier family 3 (amino acid transporter heavy chain), member 2
  ENSP ID: ENSP00000444250
MSQDTEVDMKEAAAAAKFTGLSKEELLKVAGSPGWVRTRWALLLLFW

SEQ ID NO: 81264 - protein, 175 aa, Homo sapiens
  Payload ID: 16192
  Gene Symbol: SLC3A2
  Gene Name: solute carrier family 3 (amino acid transporter heavy chain), member 2
  ENSP ID: ENSP00000444439
MLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 81265 - protein, 24 aa, Homo sapiens
  Payload ID: 16192
  Gene Symbol: SLC3A2
  Gene Name: solute carrier family 3 (amino acid transporter heavy chain), member 2
  ENSP ID: ENSP00000445858
FSTQVDTVATKVKASGNWERGDLD

SEQ ID NO: 81266 - protein, 507 aa, Homo sapiens
  Payload ID: 16193
  Gene Symbol: SLC30A1
  Gene Name: solute carrier family 30 (zinc transporter), member 1
  Uniprot ID: Q9Y6M5
  ENSP ID: ENSP00000355968
MGCWGRNRGRLLCMLALTFMFMVLEVVVSRVTSSLAMLSDSFHMLSDVLALVVALVAERFARRTHATQKNTFGWIRAEVMGALVNAIFLTGLCFAILLEAIERFIEPHEMQQPLVVLGVGVAGLLVNVLGLCLFHHHSGFSQDSGHGHSHGGHGHGHGLPKGPRVKSTRPGSSDINVAPGEQGPDQEETNTLVANTSNSNGLKLDPADPENPRSGDTVEVQVNGNLVREPDHMELEEDRAGQLNMRGVFLHVLGDALGSVIVVVNALVFYFSWKGCSEGDFCVNPCFPDPCKAFVEIINSTHASVYEAGPCWVLYLDPTLCVVMVCILLYTTYPLLKESALILLQTVPKQIDIRNLIKELRNVEGVEEVHELHVWQLAGSRIIATAHIKCEDPTSYMEVAKTIKDVFHNHGIHATTIQPEFASVGSKSSVVPCELACRTQCALKQCCGTLPQAPSGKDAEKTPAVSISCLELSNNLEKKPRRTKAENIPAVVIEIKNMPNKQPESSL

SEQ ID NO: 81267 - protein, 372 aa, Homo sapiens
  Payload ID: 16194
  Gene Symbol: SLC30A2
  Gene Name: solute carrier family 30 (zinc transporter), member 2
  Uniprot ID: Q9BRI3
  ENSP ID: ENSP00000363394
MEAKEKQHLLDARPAIRSYTGSLWQEGAGWIPLPRPGLDLQAIELAAQSNHHCHAQKGPDSHCDPKKGKAQRQLYVASAICLLFMIGEVVGGYLAHSLAVMTDAAHLLTDFASMLISLFSLWMSSRPATKTMNFGWQRAEILGALVSVLSIWVVTGVLVYLAVERLISGDYEIDGGTMLITSGCAVAVNIIMGLTLHQSGHGHSHGTTNQQEENPSVRAAFIHVIGDFMQSMGVLVAAYILYFKPEYKYVDPICTFVFSILVLGTTLTILRDVILVLMEGTPKGVDFTAVRDLLLSVEGVEALHSLHIWALTVAQPVLSVHIAIAQNTDAQAVLKTASSRLQGKFHFHTVTIQIEDYSEDMKDCQACQGPSD

SEQ ID NO: 81268 - protein, 323 aa, Homo sapiens
  Payload ID: 16194
  Gene Symbol: SLC30A2
  Gene Name: solute carrier family 30 (zinc transporter), member 2
  Uniprot ID: Q9BRI3
  ENSP ID: ENSP00000363396
MEAKEKQHLLDARPAIRSYTGSLWQEGAGWIPLPRPGLDLQAIELAAQSNHHCHAQKGPDSHCDPKKGKAQRQLYVASAICLLFMIGEVVEILGALVSVLSIWVVTGVLVYLAVERLISGDYEIDGGTMLITSGCAVAVNIIMGLTLHQSGHGHSHGTTNQQEENPSVRAAFIHVIGDFMQSMGVLVAAYILYFKPEYKYVDPICTFVFSILVLGTTLTILRDVILVLMEGTPKGVDFTAVRDLLLSVEGVEALHSLHIWALTVAQPVLSVHIAIAQNTDAQAVLKTASSRLQGKFHFHTVTIQIEDYSEDMKDCQACQGPSD

SEQ ID NO: 81269 - protein, 388 aa, Homo sapiens
  Payload ID: 16195
  Gene Symbol: SLC30A3
  Gene Name: solute carrier family 30 (zinc transporter), member 3
  Uniprot ID: Q99726
  ENSP ID: ENSP00000233535
MEPSPAAGGLETTRLVSPRDRGGAGGSLRLKSLFTEPSEPLPEESKPVEMPFHHCHRDPLPPPGLTPERLHARRQLYAACAVCFVFMAGEVVGGYLAHSLAIMTDAAHLLADVGSMMGSLFSLWLSTRPATRTMTFGWHRSETLGALASVVSLWMVTGILLYLAFVRLLHSDYHIEGGAMLLTASIAVCANLLMAFVLHQAGPPHSHGSRGAEYAPLEEGPEEPLPLGNTSVRAAFVHVLGDLLQSFGVLAASILIYFKPQYKAADPISTFLFSICALGSTAPTLRDVLRILMEGTPRNVGFEPVRDTLLSVPGVRATHELHLWALTLTYHVASAHLAIDSTADPEAVLAEASSRLYSRFGFSSCTLQVEQYQPEMAQCLRCQEPPQA

SEQ ID NO: 81270 - protein, 302 aa, Homo sapiens
  Payload ID: 16195
  Gene Symbol: SLC30A3
  Gene Name: solute carrier family 30 (zinc transporter), member 3
  ENSP ID: ENSP00000388219
  MOD_RES (1)..(1): Any amino acid
XTRLVSPRDRGGAGGSLRLKSLFTEPSEPLPEESKPVEMPFHHCHRDPLPPPGLTPERLHARRQLYAACAVCFVFMAGEVVGGYLAHSLAIMTDAAHLLADVGSMMGSLFSLWLSTRPATRTMTFGWHRSEWPLCCTRLGPPTATGLGEQSMHRWRRGLKSPCPWGTPASGRHLCTCWGTSCRALGYWLPPSSSTSSLNTRQPTPSAPSSSPSVPLDPPLPPSETFFESSWKVPPAMWGSNLCGIRCCRCQESGQPMSCTCGPLRSLTMLPLHTWPSTPPLTLKPSWLKPHPGSTPGLDSPA

SEQ ID NO: 81271 - protein, 98 aa, Homo sapiens
  Payload ID: 16195
  Gene Symbol: SLC30A3
  Gene Name: solute carrier family 30 (zinc transporter), member 3
  ENSP ID: ENSP00000392673
MPFHHCHRDPLPPPGLTPERLHARRQLYAACAVCFVFMAGEVVGGYLAHSLAIMTDAAHLLADVGSMMGSLFSLWLSTRPATRTMTFGWHRSETLGAL

SEQ ID NO: 81272 - protein, 230 aa, Homo sapiens
  Payload ID: 16195
  Gene Symbol: SLC30A3
  Gene Name: solute carrier family 30 (zinc transporter), member 3
  ENSP ID: ENSP00000393545
MAQLTPGNTMGLLTVADESLFTEPSEPLPEESKPVEMPFHHCHRDPLPPPGLTPERLHARRQLYAACAVCFVFMAGEVVGGYLAHSLAIMTDAAHLLADVGSMMGSLFSLWLSTRPATRTMTFGWHRSETLGALASVVSLWMVTGILLYLAFVRLLHSDYHIEGGAMLLTASIAVCANLLMAFVLHQAGPPHSHGSRGAEYAPLEEGPEEPLPLGNTSVRAAFVHVLGDL

SEQ ID NO: 81273 - protein, 110 aa, Homo sapiens
  Payload ID: 16195
  Gene Symbol: SLC30A3
  Gene Name: solute carrier family 30 (zinc transporter), member 3
  ENSP ID: ENSP00000403912
MPFHHCHRDPLPPPGLTPERLHARRQLYAACAVCFVFMAGEVVGGYLAHSLAIMTDAAHLLADVGSMMGSLFSLWLSTRPATRTMTFGWHRSETLGALASVVSLWMVTGI

SEQ ID NO: 81274 - protein, 170 aa, Homo sapiens
  Payload ID: 16195
  Gene Symbol: SLC30A3
  Gene Name: solute carrier family 30 (zinc transporter), member 3
  ENSP ID: ENSP00000403959
MHRVVVVGRSLFTEPSEPLPEESKPVEMPFHHCHRDPLPPPGLTPERLHARRQLYAACAVCFVFMAGEVVGGYLAHSLAIMTDAAHLLADVGSMMGSLFSLWLSTRPATRTMTFGWHRSETLGALASVVSLWMVTGILLYLAFVRLLHSDYHIEGGAMLLTASIAVCANL

SEQ ID NO: 81275 - protein, 240 aa, Homo sapiens
  Payload ID: 16195
  Gene Symbol: SLC30A3
  Gene Name: solute carrier family 30 (zinc transporter), member 3
  ENSP ID: ENSP00000414320
MPFHHCHRDPLPPPGLTPERLHARRQLYAACAVCFVFMAGEVVGGYLAHSLAIMTDAAHLLADVGSMMGSLFSLWLSTRPATRTMTFGWHRSETLGALASVVSLWMVTGILLYLAFVRLLHSDYHIEGGAMLLTASIAVCANLLMAFVLHQAGPPHSHGSRGAEYAPLEEGPEEPLPLGNTSVRAAFVHVLGDLLQSFGVLAASILIYFKPQYKAADPISTFLFSICALGSTAPTLRDVL

SEQ ID NO: 81276 - protein, 429 aa, Homo sapiens
  Payload ID: 16196
  Gene Symbol: SLC30A4
  Gene Name: solute carrier family 30 (zinc transporter), member 4
  Uniprot ID: O14863
  ENSP ID: ENSP00000261867
MAGSGAWKRLKSMLRKDDAPLFLNDTSAFDFSDEAGDEGLSRFNKLRVVVADDGSEAPERPVNGAHPTLQADDDSLLDQDLPLTNSQLSLKVDSCDNCSKQREILKQRKVKARLTIAAVLYLLFMIGELVGGYIANSLAIMTDALHMLTDLSAIILTLLALWLSSKSPTKRFTFGFHRLEVLSAMISVLLVYILMGFLLYEAVQRTIHMNYEINGDIMLITAAVGVAVNVIMGFLLNQSGHRHSHSHSLPSNSPTRGSGCERNHGQDSLAVRAAFVHALGDLVQSVGVLIAAYIIRFKPEYKIADPICTYVFSLLVAFTTFRIIWDTVVIILEGVPSHLNVDYIKEALMKIEDVYSVEDLNIWSLTSGKSTAIVHIQLIPGSSSKWEEVQSKANHLLLNTFGMYRCTIQLQSYRQEVDRTCANCQSSSP

SEQ ID NO: 81277 - protein, 118 aa, Homo sapiens
  Payload ID: 16197
  Gene Symbol: SLC30A5
  Gene Name: solute carrier family 30 (zinc transporter), member 5
  Uniprot ID: Q8TAD4
  ENSP ID: ENSP00000370241
MEEKYGGDVLAGPGGGGGLGPVDVPSARLTKYIVLLCFTKFLKAVGLFESYDLLKAVHIVQFIFILKLGTAFFMVLFQKPFSSGKTITKHQIIGSLKIPGRKEFKDKKLNDPRKLVGN

SEQ ID NO: 81278 - protein, 765 aa, Homo sapiens
  Payload ID: 16197
  Gene Symbol: SLC30A5
  Gene Name: solute carrier family 30 (zinc transporter), member 5
  Uniprot ID: Q8TAD4
  ENSP ID: ENSP00000379836
MEEKYGGDVLAGPGGGGGLGPVDVPSARLTKYIVLLCFTKFLKAVGLFESYDLLKAVHIVQFIFILKLGTAFFMVLFQKPFSSGKTITKHQWIKIFKHAVAGCIISLLWFFGLTLCGPLRTLLLFEHSDIVVISLLSVLFTSSGGGPAKTRGAAFFIIAVICLLLFDNDDLMAKMAEHPEGHHDSALTHMLYTAIAFLGVADHKGGVLLLVLALCCKVGFHTASRKLSVDVGGAKRLQALSHLVSVLLLCPWVIVLSVTTESKVESWFSLIMPFATVIFFVMILDFYVDSICSVKMEVSKCARYGSFPIFISALLFGNFWTHPITDQLRAMNKAAHQESTEHVLSGGVVVSAIFFILSANILSSPSKRGQKGTLIGYSPEGTPLYNFMGDAFQHSSQSIPRFIKESLKQILEESDSRQIFYFLCLNLLFTFVELFYGVLTNSLGLISDGFHMLFDCSALVMGLFAALMSRWKATRIFSYGYGRIEILSGFINGLFLIVIAFFVFMESVARLIDPPELDTHMLTPVSVGGLIVNLIGICAFSHAHSHAHGASQGSCHSSDHSHSHHMHGHSDHGHGHSHGSAGGGMNANMRGVFLHVLADTLGSIGVIVSTVLIEQFGWFIADPLCSLFIAILIFLSVVPLIKDACQVLLLRLPPEYEKELHIALEKIQKIEGLISYRDPHFWRHSASIVAGTIHIQVTSDVLEQRIVQQVTGILKDAGVNNLTIQVEKEAYFQHMSGLSTGFHDVLAMTKQMESMKYCKDGTYIM

SEQ ID NO: 81279 - protein, 77 aa, Homo sapiens
  Payload ID: 16197
  Gene Symbol: SLC30A5
  Gene Name: solute carrier family 30 (zinc transporter), member 5
  Uniprot ID: Q8TAD4
  ENSP ID: ENSP00000421251
MEEKYGGDVLAGPGGGGGLGPVDVPSARTAFFMVLFQKPFSSGKTITKHQIIGSLKIPGRKEFKDKKLNDPRKLVGN

SEQ ID NO: 81280 - protein, 84 aa, Homo sapiens
  Payload ID: 16197
  Gene Symbol: SLC30A5
  Gene Name: solute carrier family 30 (zinc transporter), member 5
  ENSP ID: ENSP00000423078
  MOD_RES (1)..(1): Any amino acid
XLIKDACQVLLLRLPPEYEKELHIALEKVTGILKDAGVNNLTIQVEKEAYFQHMSGLSTGFHDVLAMTKQMESMKYCKDGTYIM

SEQ ID NO: 81281 - protein, 71 aa, Homo sapiens
  Payload ID: 16197
  Gene Symbol: SLC30A5
  Gene Name: solute carrier family 30 (zinc transporter), member 5
  ENSP ID: ENSP00000426751
MEEKYGGDVLAGPGGGGGLGPVDVPSARTAFFMVLFQKPFSSGKTITKHQWIKIFKHAVAGCIISLLWFFG

SEQ ID NO: 81282 - protein, 65 aa, Homo sapiens
  Payload ID: 16197
  Gene Symbol: SLC30A5
  Gene Name: solute carrier family 30 (zinc transporter), member 5
  ENSP ID: ENSP00000427111
  MOD_RES (1)..(1): Any amino acid
XLFAALMSRWKATRIFSYGYGRIEILSGFINGLFLIVIAFFVFMESVARLIDPPELDTHMLTPCP

SEQ ID NO: 81283 - protein, 360 aa, Homo sapiens [sequence omitted]

SEQ ID NO: 81284 - protein, 461 aa, Homo sapiens
  Payload ID: 16198
  Gene Symbol: SLC30A6
  Gene Name: solute carrier family 30 (zinc transporter), member 6
  Uniprot ID: Q6NXT4
  ENSP ID: ENSP00000282587
MGTIHLFRKPQRSFFGKLLREFRLVAADRRSWKILLFGVINLICTGFLLMWCSSTNSIALTAYTYLTIFDLFSLMTCLISYWVTLRKPSPVYSFGFERLEVLAVFASTVLAQLGALFILKESAERFLEQPEIHTGRLLVGTFVALCFNLFTMLSIRNKPFAYVSEAASTSWLQEHVADLSRSLCGIIPGLSSIFLPRMNPFVLIDLAGAFALCITYMLIEINNYFAVDTASAIAIALMTFGTMYPMSVYSGKVLLQTTPPHVIGQLDKLIREVSTLDGVLEVRNEHFWTLGFGSLAGSVHVRIRRDANEQMVLAHVTNRLYTLVSTLTVQIFKDDWIRPALLSGPVAANVLNFSDHHVIPMPLLKGTDDLNPVTSTPAKPSSPPPEFSFNTPGKNVNPVILLNTQTRPYGFGLNHGHTPYSSMLNQGLGVPGIGATQGLRTGFTNIPSRYGTNNRIGQPRP

SEQ ID NO: 81285 - protein, 432 aa, Homo sapiens
  Payload ID: 16198
  Gene Symbol: SLC30A6
  Gene Name: solute carrier family 30 (zinc transporter), member 6
  Uniprot ID: Q6NXT4
  ENSP ID: ENSP00000349563
MSWKILLFGVINLICTGFLLMWCSSTNSIALTAYTYLTIFDLFSLMTCLISYWVTLRKPSPVYSFGFERLEVLAVFASTVLAQLGALFILKESAERFLEQPEIHTGRLLVGTFVALCFNLFTMLSIRNKPFAYVSEAASTSWLQEHVADLSRSLCGIIPGLSSIFLPRMNPFVLIDLAGAFALCITYMLIEINNYFAVDTASAIAIALMTFGTMYPMSVYSGKVLLQTTPPHVIGQLDKLIREVSTLDGVLEVRNEHFWTLGFGSLAGSVHVRIRRDANEQMVLAHVTNRLYTLVSTLTVQIFKDDWIRPALLSGPVAANVLNFSDHHVIPMPLLKGTDDLNPVTSTPAKPSSPPPEFSFNTPGKNVNPVILLNTQTRPYGFGLNHGHTPYSSMLNQGLGVPGIGATQGLRTGFTNIPSRYGTNNRIGQPRP

SEQ ID NO: 81286 - protein, 501 aa, Homo sapiens
  Payload ID: 16198
  Gene Symbol: SLC30A6
  Gene Name: solute carrier family 30 (zinc transporter), member 6
  Uniprot ID: Q6NXT4
  ENSP ID: ENSP00000368648
MGTIHLFRKPQRSFFGKLLREFRLVAADRRSWKILLFGVINLICTGFLLMWCSSTNSIALTAYTYLTIFDLFRDGVSPFWLGWSQTPDLKWSTHLGLPKCWDNRRELPCLSNSLMTCLISYWVTLRKPSPVYSFGFERLEVLAVFASTVLAQLGALFILKESAERFLEQPEIHTGRLLVGTFVALCFNLFTMLSIRNKPFAYVSEAASTSWLQEHVADLSRSLCGIIPGLSSIFLPRMNPFVLIDLAGAFALCITYMLIEINNYFAVDTASAIAIALMTFGTMYPMSVYSGKVLLQTTPPHVIGQLDKLIREVSTLDGVLEVRNEHFWTLGFGSLAGSVHVRIRRDANEQMVLAHVTNRLYTLVSTLTVQIFKDDWIRPALLSGPVAANVLNFSDHHVIPMPLLKGTDDLNPVTSTPAKPSSPPPEFSFNTPGKNVNPVILLNTQTRPYGFGLNHGHTPYSSMLNQGLGVPGIGATQGLRTGFTNIPSRYGTNNRIGQPRP

SEQ ID NO: 81287 - protein, 387 aa, Homo sapiens
  Payload ID: 16198
  Gene Symbol: SLC30A6
  Gene Name: solute carrier family 30 (zinc transporter), member 6
  ENSP ID: ENSP00000384041
MTCLISYWVTLRKPSPVYSFGFERLEVLAVFASTVLAQLGALFILKESAERFLEQPEIHTGRLLVGTFVALCFNLFTMLSIRNKPFAYVSEAASTSWLQEHVADLSRSLCGIIPGLSSIFLPRMNPFVLIDLAGAFALCITYMLIEINNYFAVDTASAIAIALMTFGTMYPMSVYSGKVLLQTTPPHVIGQLDKLIREVSTLDGVLEVRNEHFWTLGFGSLAGSVHVRIRRDANEQMVLAHVTNRLYTLVSTLTVQIFKDDWIRPALLSGPVAANVLNFSDHHVIPMPLLKGTDDLNPVTSTPAKPSSPPPEFSFNTPGKNVNPVILLNTQTRPYGFGLNHGHTPYSSMLNQGLGVPGIGATQGLRTGFTNIPSRYGTNNRIGQPRP

SEQ ID NO: 81288 - protein, 31 aa, Homo sapiens
  Payload ID: 16198
  Gene Symbol: SLC30A6
  Gene Name: solute carrier family 30 (zinc transporter), member 6
  ENSP ID: ENSP00000388013
MGTIHLFRKPQRSFFGKLLREFRLVAADRRV

SEQ ID NO: 81289 - protein, 178 aa, Homo sapiens
  Payload ID: 16198
  Gene Symbol: SLC30A6
  Gene Name: solute carrier family 30 (zinc transporter), member 6
  ENSP ID: ENSP00000393946
MSWKILLFGVINLICTGFLLMWCSSTNSIALTAYTYLTIFDLFSLMTCLISYWVTLRKPSPVYSFGFERLEVLAVFASTVLAQLGALFILKESAERFLEQPEIHTGRLLVGTFVALCFNLFTMLSIRNKPFAYVSEAASTSWLQEHVADLSRSLCGIIPGLSSIFLPRMNPFVLIDLA

SEQ ID NO: 81290 - protein, 122 aa, Homo sapiens
  Payload ID: 16198
  Gene Symbol: SLC30A6
  Gene Name: solute carrier family 30 (zinc transporter), member 6
  ENSP ID: ENSP00000396634
MGTIHLFRKPQRSFFGKLLREFRLVAADRRSWKILLFGVINLICTGFLLMWCSSTNSIALTAYTYLTIFDLFSLMTCLISYWVTLRKPSPVYSFGPAFLCMSCSVSQTTFLHQSEMMLLSRP

SEQ ID NO: 81291 - protein, 438 aa, Homo sapiens
  Payload ID: 16198
  Gene Symbol: SLC30A6
  Gene Name: solute carrier family 30 (zinc transporter), member 6
  Uniprot ID: Q6NXT4
  ENSP ID: ENSP00000399005
MGTIHLFRKPQRSFFGKLLREFRLVAADRRSWKILLFGVINLICTGFLLMWCSSTNSIALTAYTYLTIFDLFSLMTCLISYWVTLRKPSPVYSFGFERLEVLAVFASTVLAQLGALFILKESAERFLEQPEIHTGRLLVGTFVALCFNLFTMLSIRNKPFAYVSEAASTSWLQEHVADLSRSLCGIIPGLSSIFLPRMNPFVLIDLAGAFALCITYMLIEINNYFAVDTASAIAIALMTFGTMYPMSVYSGKVLLQTTPPHVIGQLDKLIREAGSVHVRIRRDANEQMVLAHVTNRLYTLVSTLTVQIFKDDWIRPALLSGPVAANVLNFSDHHVIPMPLLKGTDDLNPVTSTPAKPSSPPPEFSFNTPGKNVNPVILLNTQTRPYGFGLNHGHTPYSSMLNQGLGVPGIGATQGLRTGFTNIPSRYGTNNRIGQPRP

SEQ ID NO: 81292 - protein, 59 aa, Homo sapiens
  Payload ID: 16198
  Gene Symbol: SLC30A6
  Gene Name: solute carrier family 30 (zinc transporter), member 6
  ENSP ID: ENSP00000415790
MGTIHLFRKPQRSFFGKLLREFRLVAADRRSWKILLFGVINLICTGFLLMWCSSTNSIV

SEQ ID NO: 81293 - protein, 376 aa, Homo sapiens
  Payload ID: 16199
  Gene Symbol: SLC30A7
  Gene Name: solute carrier family 30 (zinc transporter), member 7
  Uniprot ID: Q8NEW0
  ENSP ID: ENSP00000350278
MLPLSIKDDEYKPPKFNLFGKISGWFRSILSDKTSRNLFFFLCLNLSFAFVELLYGIWSNCLGLISDSFHMFFDSTAILAGLAASVISKWRDNDAFSYGYVRAEVLAGFVNGLFLIFTAFFIFSEGVERALAPPDVHHERLLLVSILGFVVNLIGIFVFKHGGHGHSHGSGHGHSHSLFNGALDQAHGHVDHCHSHEVKHGAAHSHDHAHGHGHFHSHDGPSLKETTGPSRQILQGVFLHILADTLGSIGVIASAIMMQNFGLMIADPICSILIAILIVVSVIPLLRESVGILMQRTPPLLENSLPQCYQRVQQLQGVYSLQEQHFWTLCSDVYVGTLKLIVAPDADARWILSQTHNIFTQAGVRQLYVQIDFAAM

SEQ ID NO: 81294 - protein, 87 aa, Homo sapiens
  Payload ID: 16199
  Gene Symbol: SLC30A7
  Gene Name: solute carrier family 30 (zinc transporter), member 7
  ENSP ID: ENSP00000359129
  MOD_RES (1)..(1): Any amino acid
XVIPLLRESVGILMQRTPPLLENSLPQCYQRVQQLQGVYSLQEQHFWTLCSDVYVGTLKLIVAPDADARWILSQTHNIFTQETGRGK

SEQ ID NO: 81295 - protein, 376 aa, Homo sapiens; identical to SEQ ID NO: 81293
  Payload ID: 16199
  Gene Symbol: SLC30A7
  Gene Name: solute carrier family 30 (zinc transporter), member 7
  Uniprot ID: Q8NEW0
  ENSP ID: ENSP00000359130

SEQ ID NO: 81296 - protein, 320 aa, Homo sapiens
  Payload ID: 16200
  Gene Symbol: SLC30A8
  Gene Name: solute carrier family 30 (zinc transporter), member 8
  Uniprot ID: Q8IWU4
  ENSP ID: ENSP00000407505
MYHCHSGSKPTEKGANEYAYAKWKLCSASAICFIFMIAEVVGGHIAGSLAVVTDAAHLLIDLTSFLLSLFSLWLSSKPPSKRLTFGWHRAEILGALLSILCIWVVTGVLVYLACERLLYPDYQIQATVMIIVSSCAVAANIVLTVVLHQRCLGHNHKEVQANASVRAAFVHALGDLFQSISVLISALIIYFKPEYKIADPICTFIFSILVLASTITILKDFSILLMEGVPKSLNYSGVKELILAVDGVLSVHSLHIWSLTMNQVILSAHVATAASRDSQVVRREIAKALSKSFTMHSLTIQMESPVDQDPDCLFCEDPCD

SEQ ID NO: 81297 - protein, 369 aa, Homo sapiens
  Payload ID: 16200
  Gene Symbol: SLC30A8
  Gene Name: solute carrier family 30 (zinc transporter), member 8
  Uniprot ID: Q8IWU4
  ENSP ID: ENSP00000415011
MEFLERTYLVNDKAAKMYAFTLESVELQQKPVNKDQCPRERPEELESGGMYHCHSGSKPTEKGANEYAYAKWKLCSASAICFIFMIAEVVGGHIAGSLAVVTDAAHLLIDLTSFLLSLFSLWLSSKPPSKRLTFGWHRAEILGALLSILCIWVVTGVLVYLACERLLYPDYQIQATVMIIVSSCAVAANIVLTVVLHQRCLGHNHKEVQANASVRAAFVHALGDLFQSISVLISALIIYFKPEYKIADPICTFIFSILVLASTITILKDFSILLMEGVPKSLNYSGVKELILAVDGVLSVHSLHIWSLTMNQVILSAHVATAASRDSQVVRREIAKALSKSFTMHSLTIQMESPVDQDPDCLFCEDPCD

SEQ ID NO: 81298 - protein, 87 aa, Homo sapiens
  Payload ID: 16200
  Gene Symbol: SLC30A8
  Gene Name: solute carrier family 30 (zinc transporter), member 8
  ENSP ID: ENSP00000427760
MYHCHSGSKPTEKGANEYAYAKWKLCSASAICFIFMIAEVVGGHIAGSLAVVTDAAHLLIDLTSFLLSLFSLWLSSKPPSKRLTFGW

SEQ ID NO: 81299 - protein, 320 aa, Homo sapiens; identical to SEQ ID NO: 81296
  Payload ID: 16200
  Gene Symbol: SLC30A8
  Gene Name: solute carrier family 30 (zinc transporter), member 8
  Uniprot ID: Q8IWU4
  ENSP ID: ENSP00000428545

SEQ ID NO: 81300 - protein, 320 aa, Homo sapiens; identical to SEQ ID NO: 81296
  Payload ID: 16200
  Gene Symbol: SLC30A8
  Gene Name: solute carrier family 30 (zinc transporter), member 8
  Uniprot ID: Q8IWU4
  ENSP ID: ENSP00000431069

SEQ ID NO: 81301 - protein, 36 aa, Homo sapiens
  Payload ID: 16200
  Gene Symbol: SLC30A8
  Gene Name: solute carrier family 30 (zinc transporter), member 8
  ENSP ID: ENSP00000485167
MYHCHSGSKPTEKGANEYAYAKWKLCSASAICFIFM

SEQ ID NO: 81302 - protein, 52 aa, Homo sapiens
  Payload ID: 16200
  Gene Symbol: SLC30A8
  Gene Name: solute carrier family 30 (zinc transporter), member 8
  ENSP ID: ENSP00000485566
MYHCHSGSKPTEKGANEYAYAKWKLCSASAICFIFMIAEVVGGHIAGSLAVV

SEQ ID NO: 81303 - protein, 568 aa, Homo sapiens
  Payload ID: 16201
  Gene Symbol: SLC30A9
  Gene Name: solute carrier family 30 (zinc transporter), member 9
  Uniprot ID: Q6PML9
  ENSP ID: ENSP00000264451
MLPGLAAAAAHRCSWSSLCRLRLRCRAAACNPSDRQEWQNLVTFGSFSNMVPCSHPYIGTLSQVKLYSTNVQKEGQGSQTLRVEKVPSFETAEGIGTELKAPLKQEPLQVRVKAVLKKREYGSKYTQNNFITGVRAINEFCLKSSDLEQLRKIRRRSPHEDTESFTVYLRSDVEAKSLEVWGSPEALAREKKLRKEAEIEYRERLFRNQKILREYRDFLGNTKPRSRTASVFFKGPGKVVMVAICINGLNCFFKFLAWIYTGSASMFSEAIHSLSDTCNQGLLALGISKSVQTPDPSHPYGFSNMRYISSLISGVGIFMMGAGLSWYHGVMGLLHPQPIESLLWAYCILAGSLVSEGATLLVAVNELRRNARAKGMSFYKYVMESRDPSTNVILLEDTAAVLGVIIAATCMGLTSITGNPLYDSLGSLGVGTLLGMVSAFLIYTNTEALLGRSIQPEQVQRLTELLENDPSVRAIHDVKATDLGLGKVRFKAEVDFDGRVVTRSYLEKQDFDQMLQEIQEVKTPEELETFMLKHGENIIDTLGAEVDRLEKELKKRNPEVRHVDLEIL

SEQ ID NO: 81304 - protein, 119 aa, Homo sapiens
  Payload ID: 16201
  Gene Symbol: SLC30A9
  Gene Name: solute carrier family 30 (zinc transporter), member 9
  ENSP ID: ENSP00000423529
MLPGLAAAAAHRCSWSSLCRLRLRCRAAACNPSDRQEWQNLVTFGSFSNMVPCSHPYIGTLSQVKLYSTNVQKEGQGSQTLRVEKVPSFETAEGIGTELKAPLKQEPLQVRAQERNNGK

SEQ ID NO: 81305 - protein, 223 aa, Homo sapiens
  Payload ID: 16202
  Gene Symbol: SLC30A10
  Gene Name: solute carrier family 30, member 10
  Uniprot ID: Q6XR72
  ENSP ID: ENSP00000349018
MGRYSGKTCRLLFMLVLTVAFFVAELVSGYLGNSIALLSDSFNMLSDLISLCVGLSAGYIARRPTRGFSATYGYARAEVVGALSNAVFLTALCFTIFVEAVLRLARPERIDDPELVLIVGVLGLLVNVVGLLIFQDCAAWFACCLRGRSRRLQQRQQLAEGCVPGAFGGPQGAEDPRRAADPTAPGSDSAVTLRGTSVERKREKGATVFANVAELIHNTRFLL

SEQ ID NO: 81306 - protein, 485 aa, Homo sapiens
  Payload ID: 16202
  Gene Symbol: SLC30A10
  Gene Name: solute carrier family 30, member 10
  Uniprot ID: Q6XR72
  ENSP ID: ENSP00000355893
MGRYSGKTCRLLFMLVLTVAFFVAELVSGYLGNSIALLSDSFNMLSDLISLCVGLSAGYIARRPTRGFSATYGYARAEVVGALSNAVFLTALCFTIFVEAVLRLARPERIDDPELVLIVGVLGLLVNVVGLLIFQDCAAWFACCLRGRSRRLQQRQQLAEGCVPGAFGGPQGAEDPRRAADPTAPGSDSAVTLRGTSVERKREKGATVFANVAGDSFNTQNEPEDMMKKEKKSEALNIRGVLLHVMGDALGSVVVVITAIIFYVLPLKSEDPCNWQCYIDPSLTVLMVIIILSSAFPLIKETAAILLQMVPKGVNMEELMSKLSAVPGISSVHEVHIWELVSGKIIATLHIKYPKDRGYQDASTKIREIFHHAGIHNVTIQFENVDLKEPLEQKDLLLLCNSPCISKGCAKQLCCPPGALPLAHVNGCAEHNGGPSLDTYGSDGLSRRDAREVAIEVSLDSCLSDHGQSLNKTQEDQCYVNRTHF

SEQ ID NO: 81307 - protein, 190 aa, Homo sapiens
  Payload ID: 16203
  Gene Symbol: SLC31A1
  Gene Name: solute carrier family 31 (copper transporter), member 1
  Uniprot ID: O15431
  ENSP ID: ENSP00000363329
MDHSHHMGMSYMDSNSTMQPSHHHPTTSASHSHGGGDSSMMMMPMTFYFGFKNVELLFSGLVINTAGEMAGAFVAVFLLAMFYEGLKIARESLLRKSQVSIRYNSMPVPGPNGTILMETHKTVGQQMLSFPHLLQTVLHIIQVVISYFLMLIFMTYNGYLCIAVAAGAGTGYFLFSWKKAVVVDITEHCH

SEQ ID NO: 81308 - protein, 143 aa, Homo sapiens
  Payload ID: 16204
  Gene Symbol: SLC31A2
  Gene Name: solute carrier family 31 (copper transporter), member 2
  Uniprot ID: O15432
  ENSP ID: ENSP00000259392
MAMHFIFSDTAVLLFDFWSVHSPAGMALSVLVLLLLAVLYEGIKVGKAKLLNQVLVNLPTSISQQTIAETDGDSAGSDSFPVGRTHHRWYLCHFGQSLIHVIQVVIGYFIMLAVMSYNTWIFLGVVLGSAVGYYLAYPLLSTA

SEQ ID NO: 81309 - protein, 73 aa, Homo sapiens
  Payload ID: 16204
  Gene Symbol: SLC31A2
  Gene Name: solute carrier family 31 (copper transporter), member 2
  ENSP ID: ENSP00000363337
MAMHFIFSDTAVLLFDFWSVHSPAGQETKAQRQEERLVQGHTAWPFRCWCSCFWLYCMKASRLAKPSCSTRYW

SEQ ID NO: 81310 - protein, 525 aa, Homo sapiens
  Payload ID: 16205
  Gene Symbol: SLC32A1
  Gene Name: solute carrier family 32 (GABA vesicular transporter), member 1
  Uniprot ID: Q9H598
  ENSP ID: ENSP00000217420
MATLLRSKLSNVATSVSNKSQAKMSGMFARMGFQAATDEEAVGFAHCDDLDFEHRQGLQMDILKAEGEPCGDEGAEAPVEGDIHYQRGSGAPLPPSGSKDQVGGGGEFGGHDKPKITAWEAGWNVTNAIQGMFVLGLPYAILHGGYLGLFLIIFAAVVCCYTGKILIACLYEENEDGEVVRVRDSYVAIANACCAPRFPTLGGRVVNVAQIIELVMTCILYVVVSGNLMYNSFPGLPVSQKSWSIIATAVLLPCAFLKNLKAVSKFSLLCTLAHFVINILVIAYCLSRARDWAWEKVKFYIDVKKFPISIGIIVFSYTSQIFLPSLEGNMQQPSEFHCMMNWTHIAACVLKGLFALVAYLTWADETKEVITDNLPGSIRAVVNIFLVAKALLSYPLPFFAAVEVLEKSLFQEGSRAFFPACYSGDGRLKSWGLTLRCALVVFTLLMAIYVPHFALLMGLTGSLTGAGLCFLLPSLFHLRLLWRKLLWHQVFFDVAIFVIGGICSVSGFVHSLEGLIEAYRTNAED

SEQ ID NO: 81311 - protein, 549 aa, Homo sapiens
  Payload ID: 16206
  Gene Symbol: SLC33A1
  Gene Name: solute carrier family 33 (acetyl-CoA transporter), member 1
  Uniprot ID: O00400
  ENSP ID: ENSP00000352456
MSPTISHKDSSRQRRPGNFSHSLDMKSGPLPPGGWDDSHLDSAGREGDREALLGDTGTGDFLKAPQSFRAELSSILLLLFLYVLQGIPLGLAGSIPLILQSKNVSYTDQAFFSFVFWPFSLKLLWAPLVDAVYVKNFGRRKSWLVPTQYILGLFMIYLSTQVDRLLGNTDDRTPDVIALTVAFFLFEFLAATQDIAVDGWALTMLSRENVGYASTCNSVGQTAGYFLGNVLFLALESADFCNKYLRFQPQPRGIVTLSDFLFFWGTVFLITTTLVALLKKENEVSVVKEETQGITDTYKLLFAIIKMPAVLTFCLLILTAKIGFSAADAVTGLKLVEEGVPKEHLALLAVPMVPLQIILPLIISKYTAGPQPLNTFYKAMPYRLLLGLEYALLVWWTPKVEHQGGFPIYYYIVVLLSYALHQVTVYSMYVSIMAFNAKVSDPLIGGTYMTLLNTVSNLGGNWPSTVALWLVDPLTVKECVGASNQNCRTPDAVELCKKLGGSCVTALDGYYVESIICVFIGFGWWFFLGPKFKKLQDEGSSSWKCKRNN

SEQ ID NO: 81312 - protein, 549 aa, Homo sapiens; identical to SEQ ID NO: 81311
  Payload ID: 16206
  Gene Symbol: SLC33A1
  Gene Name: solute carrier family 33 (acetyl-CoA transporter), member 1
  Uniprot ID: O00400
  ENSP ID: ENSP00000376587

SEQ ID NO: 81313 - protein, 109 aa, Homo sapiens
  Payload ID: 16206
  Gene Symbol: SLC33A1
  Gene Name: solute carrier family 33 (acetyl-CoA transporter), member 1
  ENSP ID: ENSP00000418847
  MOD_RES (1)..(1): Any amino acid
XGNVLFLALESADFCNKYLRFQPQPRGIVTLSDWFFSSRCCNRTEIGRRGSTQRTFSLIGSSNGSFADNTASDYQQIHCRSPAIKHILQSHALQIIAWVRICPTGLVDS

SEQ ID NO: 81314 - protein, 269 aa, Homo sapiens
  Payload ID: 16206
  Gene Symbol: SLC33A1
  Gene Name: solute carrier family 33 (acetyl-CoA transporter), member 1
  ENSP ID: ENSP00000419066
  MOD_RES (1)..(1): Any amino acid
XDDRTPDVIALTVAFFLFEFLAATQDIAVDGWALTMLSRENIGFSAADAVTGLKLVEEGVPKEHLALLAVPMVPLQIILPLIISKYTAGPQPLNTFYKAMPYRLLLGLEYALLVWWTPKVEHQGGFPIYYYIVVLLSYALHQVTVYSMYVSIMAFNAKVSDPLIGGTYMTLLNTVSNLGGNWPSTVALWLVDPLTVKECVGASNQNCRTPDAVELCKKLGGSCVTALDGYYVESIICVFIGFGWWFFLGPKFKKLQDEGSSSWKCKRNN

SEQ ID NO: 81315 - protein, 185 aa, Homo sapiens
  Payload ID: 16206
  Gene Symbol: SLC33A1
  Gene Name: solute carrier family 33 (acetyl-CoA transporter), member 1
  ENSP ID: ENSP00000419165
WGTVFLITTTLVALLKKENEVSVVKEETQGITDTYKLLFAIIKMPAVLTFCLLILTAKVTVYSMYVSIMAFNAKVSDPLIGGTYMTLLNTVSNLGGNWPSTVALWLVDPLTVKECVGASNQNCRTPDAVELCKKLGGSCVTALDGYYVESIICVFIGFGWWFFLGPKFKKLQDEGSSSWKCKRNN

SEQ ID NO: 81316 - protein, 639 aa, Homo sapiens
  Payload ID: 16207
  Gene Symbol: SLC34A1
  Gene Name: solute carrier family 34 (type II sodium/phosphate cotransporter), member 1
  Uniprot ID: Q06495
  ENSP ID: ENSP00000321424
MLSYGERLGSPAVSPLPVRGGHVMRGTAFAYVPSPQVLHRIPGTSAYAFPSLGPVALAEHTCPCGEVLERHEPLPAKLALEEEQKPESRLVPKLRQAGAMLLKVPLMLTFLYLFVCSLDMLSSAFQLAGGKVAGDIFKDNAILSNPVAGLVVGILVTVLVQSSSTSTSIIVSMVSSGLLEVSSAIPIIMGSNIGTSVTNTIVALMQAGDRTDFRRAFAGATVHDCFNWLSVLVLLPLEAATGYLHHITRLVVASFNIHGGRDAPDLLKIITEPFTKLIIQLDESVITSIATGDESLRNHSLIQIWCHPDSLQAPTSMSRAEANSSQTLGNATMEKCNHIFVDTGLPDLAVGLILLAGSLVLLCTCLILLVKMLNSLLKGQVAKVIQKVINTDFPAPFTWVTGYFAMVVGASMTFVVQSSSVFTSAITPLIGLGVISIERAYPLTLGSNIGTTTTAILAALASPREKLSSAFQIALCHFFFNISGILLWYPVPCTRLPIRMAKALGKRTAKYRWFAVLYLLVCFLLLPSLVFGISMAGWQVMVGVGTPFGALLAFVVLINVLQSRSPGHLPKWLQTWDFLPRWMHSLKPLDHLITRATLCCARPEPRSPPLPPRVFLEELPPATPSPRLALPAHHNATRL

SEQ ID NO: 81317 - protein, 340 aa, Homo sapiens
  Payload ID: 16207
  Gene Symbol: SLC34A1
  Gene Name: solute carrier family 34 (type II sodium/phosphate cotransporter), member 1
  Uniprot ID: Q06495
  ENSP ID: ENSP00000423022
MLSYGERLGSPAVSPLPVRGGHVMRGTAFAYVPSPQVLHRIPGTSAYAFPSLGPVALAEHTCPCGEVLERHEPLPAKLALEEEQKPESRLVPKLRQAGAMLLKVPLMLTFLYLFVCSLDMLSSAFQLAGGKVAGDIFKDNAILSNPVAGLVVGILVTVLVQSSSTSTSIIVSMVSSGLLEVSSAIPIIMGSNIGTSVTNTIVALMQAGDRTDFRRAFAGATVHDCFNWLSVLVLLPLEAATGYLHHITRLVVASFNIHGGRDAPDLLKIITEPFTKLIIQLDESVITSIATGDESLRNHSLIQIWCHPDSLQQNLEGREITHFDLRKKQAMEDSSVPHCP

SEQ ID NO: 81318 - protein, 109 aa, Homo sapiens
  Payload ID: 16207
  Gene Symbol: SLC34A1
  Gene Name: solute carrier family 34 (type II sodium/phosphate cotransporter), member 1
  ENSP ID: ENSP00000423733
MLSYGERLGSPAVSPLPVRGGHVMRGTAFAYVPSPQVLHRIPGTSAYAFPSLGPVALAEHTCPCGEVLERHEPLPAKLALEEEQKPESRLVPKLRQAGAMLLKVPLMLT

SEQ ID NO: 81319 - protein, 690 aa, Homo sapiens
  Payload ID: 16208
  Gene Symbol: SLC34A2
  Gene Name: solute carrier family 34 (type II sodium/phosphate cotransporter), member 2
  Uniprot ID: O95436
  ENSP ID: ENSP00000371483
MAPWPELGDAQPNPDKYLEGAAGQQPTAPDKSKETNKTDNTEAPVTKIELLPSYSTATLIDEPTEVDDPWNLPTLQDSGIKWSERDTKGKILCFFQGIGRLILLLGFLYFFVCSLDILSSAFQLVGGKMAGQFFSNSSIMSNPLLGLVIGVLVTVLVQSSSTSTSIVVSMVSSSLLTVRAAIPIIMGANIGTSITNTIVALMQVGDRSEFRRAFAGATVHDFFNWLSVLVLLPVEVATHYLEIITQLIVESFHFKNGEDAPDLLKVITKPFTKLIVQLDKKVISQIAMNDEKAKNKSLVKIWCKTFTNKTQINVTVPSTANCTSPSLCWTDGIQNWTMKNVTYKENIAKCQHIFVNFHLPDLAVGTILLILSLLVLCGCLIMIVKILGSVLKGQVATVIKKTINTDFPFPFAWLTGYLAILVGAGMTFIVQSSSVFTSALTPLIGIGVITIERAYPLTLGSNIGTTTTAILAALASPGNALRSSLQIALCHFFFNISGILLWYPIPFTRLPIRMAKGLGNISAKYRWFAVFYLIIFFFLIPLTVFGLSLAGWRVLVGVGVPVVFIIILVLCLRLLQSRCPRVLPKKLQNWNFLPLWMRSLKPWDAVVSKFTGCFQMRCCCCCRVCCRACCLLCDCPKCCRCSKCCEDLEEAQEGQDVPVKAPETFDNITISREAQGEVPASDSKTECTAL

SEQ ID NO: 81320 - protein, 689 aa, Homo sapiens
  Payload ID: 16208
  Gene Symbol: SLC34A2
  Gene Name: solute carrier family 34 (type II sodium/phosphate cotransporter), member 2
  Uniprot ID: O95436
  ENSP ID: ENSP00000423021
MAPWPELGDAQPNPDKYLEGAAGQQPTAPDKSKETNKNNTEAPVTKIELLPSYSTATLIDEPTEVDDPWNLPTLQDSGIKWSERDTKGKILCFFQGIGRLILLLGFLYFFVCSLDILSSAFQLVGGKMAGQFFSNSSIMSNPLLGLVIGVLVTVLVQSSSTSTSIVVSMVSSSLLTVRAAIPIIMGANIGTSITNTIVALMQVGDRSEFRRAFAGATVHDFFNWLSVLVLLPVEVATHYLEIITQLIVESFHFKNGEDAPDLLKVITKPFTKLIVQLDKKVISQIAMNDEKAKNKSLVKIWCKTFTNKTQINVTVPSTANCTSPSLCWTDGIQNWTMKNVTYKENIAKCQHIFVNFHLPDLAVGTILLILSLLVLCGCLIMIVKILGSVLKGQVATVIKKTINTDFPFPFAWLTGYLAILVGAGMTFIVQSSSVFTSALTPLIGIGVITIERAYPLTLGSNIGTTTTAILAALASPGNALRSSLQIALCHFFFNISGILLWYPIPFTRLPIRMAKGLGNISAKYRWFAVFYLIIFFFLIPLTVFGLSLAGWRVLVGVGVPVVFIIILVLCLRLLQSRCPRVLPKKLQNWNFLPLWMRSLKPWDAVVSKFTGCFQMRCCCCCRVCCRACCLLCDCPKCCRCSKCCEDLEEAQEGQDVPVKAPETFDNITISREAQGEVPASDSKTECTAL

SEQ ID NO: 81321 - protein, 163 aa, Homo sapiens
  Payload ID: 16208
  Gene Symbol: SLC34A2
  Gene Name: solute carrier family 34 (type II sodium/phosphate cotransporter), member 2
  ENSP ID: ENSP00000423038
MAPWPELGDAQPNPDKYLEGAAGQQPTAPDKSKETNKNNTEAPVTKIELLPSYSTATLIDEPTEVDDPWNLPTLQDSGIKWSERDTKGKILCFFQGIGRLILLLGFLYFFVCSLDILSSAFQLVGGKMAGQFFSNSSIMSNPLLGLVIGVLVTVLVQSSSTST

SEQ ID NO: 81322 - protein, 161 aa, Homo sapiens
  Payload ID: 16208
  Gene Symbol: SLC34A2
  Gene Name: solute carrier family 34 (type II sodium/phosphate cotransporter), member 2
  ENSP ID: ENSP00000424266
MAPWPELGDAQPNPDKYLEGAAGQQPTAPDKSKETNKTDNTEAPVTKIELLPSYSTATLIDEPTEVDDPWNLPTLQDSGIKWSERDTKGKILCFFQGIGRLILLLGFLYFFVCSLDILSSAFQLVGGKMAGQFFSNSSIMSNPLLGLVIGVLVTVLVQSSS

SEQ ID NO: 81323 - protein, 689 aa, Homo sapiens; identical to SEQ ID NO: 81320
  Payload ID: 16208
  Gene Symbol: SLC34A2
  Gene Name: solute carrier family 34 (type II sodium/phosphate cotransporter), member 2
  Uniprot ID: O95436
  ENSP ID: ENSP00000425501

SEQ ID NO: 81324 - protein, 599 aa, Homo sapiens
  Payload ID: 16209
  Gene Symbol: SLC34A3
  Gene Name: solute carrier family 34 (type II sodium/phosphate cotransporter), member 3
  Uniprot ID: Q8N130
  ENSP ID: ENSP00000355353
MPSSLPGSQVPHPTLDAVDLVEKTLRNEGTSSSAPVLEEGDTDPWTLPQLKDTSQPWKELRVAGRLRRVAGSVLKACGLLGSLYFFICSLDVLSSAFQLLGSKVAGDIFKDNVVLSNPVAGLVIGVLVTALVQSSSTSSSIVVSMVAAKLLTVRVSVPIIMGVNVGTSITSTLVSMAQSGDRDEFQRAFSGSAVHGIFNWLTVLVLLPLESATALLERLSELALGAASLTPRAQAPDILKVLTKPLTHLIVQLDSDMIMSSATGNATNSSLIKHWCGTTGQPTQENSSCGAFGPCTEKNSTAPADRLPCRHLFAGTELTDLAVGCILLAGSLLVLCGCLVLIVKLLNSVLRGRVAQVVRTVINADFPFPLGWLGGYLAVLAGAGLTFALQSSSVFTAAVVPLMGVGVISLDRAYPLLLGSNIGTTTTALLAALASPADRMLSALQVALIHFFFNLAGILLWYLVPALRLPIPLARHFGVVTARYRWVAGVYLLLGFLLLPLAAFGLSLAGGMELAAVGGPLVGLVLLVILVTVLQRRRPAWLPVRLRSWAWLPVWLHSLEPWDRLVTRCCPCNVCSPPKATTKEAYCYENPEILASQQL

SEQ ID NO: 81325 - protein, 599 aa, Homo sapiens; identical to SEQ ID NO: 81324
  Payload ID: 16209
  Gene Symbol: SLC34A3
  Gene Name: solute carrier family 34 (type II sodium/phosphate cotransporter), member 3
  Uniprot ID: Q8N130
  ENSP ID: ENSP00000442397

SEQ ID NO: 81326 - protein, 94 aa, Homo sapiens
  Payload ID: 16210
  Gene Symbol: SLC35B2
  Gene Name: solute carrier family 35 (adenosine 3'-phospho 5'-phosphosulfate transporter), member B2
  ENSP ID: ENSP00000377399
MDARWWAVVVLAAFPSLGAGGETPEAPPESWTQLWFFRFVVNAAGYASFMVPGYLLVQYFRRKNYLETGVLSDLGCAAGKSDDPQLWGHSHITG

SEQ ID NO: 81327 - protein, 432 aa, Homo sapiens
  Payload ID: 16210
  Gene Symbol: SLC35B2
  Gene Name: solute carrier family 35 (adenosine 3'-phospho 5'-phosphosulfate transporter), member B2
  Uniprot ID: Q8TB61
  ENSP ID: ENSP00000377401
MDARWWAVVVLAAFPSLGAGGETPEAPPESWTQLWFFRFVVNAAGYASFMVPGYLLVQYFRRKNYLETGRGLCFPLVKACVFGNEPKASDEVPLAPRTEAAETTPMWQALKLLFCATGLQVSYLTWGVLQERVMTRSYGATATSPGERFTDSQFLVLMNRVLALIVAGLSCVLCKQPRHGAPMYRYSFASLSNVLSSWCQYEALKFVSFPTQVLAKASKVIPVMLMGKLVSRRSYEHWEYLTATLISIGVSMFLLSSGPEPRSSPATTLSGLILLAGYIAFDSFTSNWQDALFAYKMSSVQMMFGVNFFSCLFTVGSLLEQGALLEGTRFMGRHSEFAAHALLLSICSACGQLFIFYTIGQFGAAVFTIIMTLRQAFAILLSCLLYGHTVTVVGGLGVAVVFAALLLRVYARGRLKQRGKKAVPVESPVQKV

SEQ ID NO: 81328 - protein, 299 aa, Homo sapiens
  Payload ID: 16210
  Gene Symbol: SLC35B2
  Gene Name: solute carrier family 35 (adenosine 3'-phospho 5'-phosphosulfate transporter), member B2
  Uniprot ID: Q8TB61
  ENSP ID: ENSP00000440340
MTRSYGATATSPGERFTDSQFLVLMNRVLALIVAGLSCVLCKQPRHGAPMYRYSFASLSNVLSSWCQYEALKFVSFPTQVLAKASKVIPVMLMGKLVSRRSYEHWEYLTATLISIGVSMFLLSSGPEPRSSPATTLSGLILLAGYIAFDSFTSNWQDALFAYKMSSVQMMFGVNFFSCLFTVGSLLEQGALLEGTRFMGRHSEFAAHALLLSICSACGQLFIFYTIGQFGAAVFTIIMTLRQAFAILLSCLLYGHTVTVVGGLGVAVVFAALLLRVYARGRLKQRGKKAVPVESPVQKV

SEQ ID NO: 81329 - protein, 339 aa, Homo sapiens
  Payload ID: 16210
  Gene Symbol: SLC35B2
  Gene Name: solute carrier family 35 (adenosine 3'-phospho 5'-phosphosulfate transporter), member B2
  Uniprot ID: Q8TB61
  ENSP ID: ENSP00000443845
MLLAMPALWYLATSWCSTSGGRTTWRPVSYLTWGVLQERVMTRSYGATATSPGERFTDSQFLVLMNRVLALIVAGLSCVLCKQPRHGAPMYRYSFASLSNVLSSWCQYEALKFVSFPTQVLAKASKVIPVMLMGKLVSRRSYEHWEYLTATLISIGVSMFLLSSGPEPRSSPATTLSGLILLAGYIAFDSFTSNWQDALFAYKMSSVQMMFGVNFFSCLFTVGSLLEQGALLEGTRFMGRHSEFAAHALLLSICSACGQLFIFYTIGQFGAAVFTIIMTLRQAFAILLSCLLYGHTVTVVGGLGVAVVFAALLLRVYARGRLKQRGKKAVPVESPVQKV

SEQ ID NO: 81330 - protein, 383 aa, Homo sapiens
  Payload ID: 16210
  Gene Symbol: SLC35B2
  Gene Name: solute carrier family 35 (adenosine 3'-phospho 5'-phosphosulfate transporter), member B2
  Uniprot ID: Q8TB61
  ENSP ID: ENSP00000480681
MVPGYLLVQYFRRKNYLETGRGLCFPLVKACVFGNEPKASDEVPLAPRTEAAETTPMWQALKLLFCATGLQVSYLTWGVLQERVMTRSYGATATSPGERFTDSQFLVLMNRVLALIVAGLSCVLCKQPRHGAPMYRYSFASLSNVLSSWCQYEALKFVSFPTQVLAKASKVIPVMLMGKLVSRRSYEHWEYLTATLISIGVSMFLLSSGPEPRSSPATTLSGLILLAGYIAFDSFTSNWQDALFAYKMSSVQMMFGVNFFSCLFTVGSLLEQGALLEGTRFMGRHSEFAAHALLLSICSACGQLFIFYTIGQFGAAVFTIIMTLRQAFAILLSCLLYGHTVTVVGGLGVAVVFAALLLRVYARGRLKQRGKKAVPVESPVQKV

SEQ ID NO: 81331 - protein, 383 aa, Homo sapiens; identical to SEQ ID NO: 81330
  Payload ID: 16210
  Gene Symbol: SLC35B2
  Gene Name: solute carrier family 35 (adenosine 3'-phospho 5'-phosphosulfate transporter), member B2
  Uniprot ID: Q8TB61
  ENSP ID: ENSP00000483181

SEQ ID NO: 81332 - protein, 401 aa, Homo sapiens
  Payload ID: 16211
  Gene Symbol: SLC35B3
  Gene Name: solute carrier family 35 (adenosine 3'-phospho 5'-phosphosulfate transporter), member B3
  Uniprot ID: Q9H1N7
  ENSP ID: ENSP00000368981
MDLTQQAKDIQNITVQETNKNNSESIECSKITMDLKFNNSRKYISITVPSKTQTMSPHIKSVDDVVVLGMNLSKFNKLTQFFICVAGVFVFYLIYGYLQELIFSVEGFKSCGWYLTLVQFAFYSIFGLIELQLIQDKRRRIPGKTYMIIAFLTVGTMGLSNTSLGYLNYPTQVIFKCCKLIPVMLGGVFIQGKRYNVADVSAAICMSLGLIWFTLADSTTAPNFNLTGVVLISLALCADAVIGNVQEKAMKLHNASNSEMVLYSYSIGFVYILLGLTCTSGLGPAVTFCAKNPVRTYGYAFLFSLTGYFGISFVLALIKIFGALIAVTVTTGRKAMTIVLSFIFFAKPFTFQYVWSGLLVVLGIFLNVYSKNMDKIRLPSLYDLINKSVEARKSRTLAQTV

SEQ ID NO: 81333 - protein, 337 aa, Homo sapiens
  Payload ID: 16212
  Gene Symbol: SLC35A1
  Gene Name: solute carrier family 35 (CMP-sialic acid transporter), member A1
  Uniprot ID: P78382
  ENSP ID: ENSP00000358565
MAAPRDNVTLLFKLYCLAVMTLMAAVYTIALRYTRTSDKELYFSTTAVCITEVIKLLLSVGILAKETGSLGRFKASLRENVLGSPKELLKLSVPSLVYAVQNNMAFLALSNLDAAVYQVTYQLKIPCTALCTVLMLNRTLSKLQWVSVFMLCAGVTLVQWKPAQATKVVVEQNPLLGFGAIAIAVLCSGFAGVYFEKVLKSSDTSLWVRNIQMYLSGIIVTLAGVYLSDGAEIKEKGFFYGYTYYVWFVIFLASVGGLYTSVVVKYTDNIMKGFSAAAAIVLSTIASVMLFGLQITLTFALGTLLVCVSIYLYGLPRQDTTSIQQGETASKERVIGV

SEQ ID NO: 81334 - protein, 278 aa, Homo sapiens
  Payload ID: 16212
  Gene Symbol: SLC35A1
  Gene Name: solute carrier family 35 (CMP-sialic acid transporter), member A1
  Uniprot ID: P78382
  ENSP ID: ENSP00000358569
MAAPRDNVTLLFKLYCLAVMTLMAAVYTIALRYTRTSDKELYFSTTAVCITEVIKLLLSVGILAKETGSLGRFKASLRENVLGSPKELLKLSVPSLVYAVQNNMAFLALSNLDAAVYQVTYQLKIPCTALCTVLMLNRTLSKLQWVSVFMLCAGVTLVQWKPAQATKVVVEQNPLLGFGAIAIAVLCSGFAVLASVGGLYTSVVVKYTDNIMKGFSAAAAIVLSTIASVMLFGLQITLTFALGTLLVCVSIYLYGLPRQDTTSIQQGETASKERVIGV

SEQ ID NO: 81335 - protein, 189 aa, Homo sapiens
  Payload ID: 16212
  Gene Symbol: SLC35A1
  Gene Name: solute carrier family 35 (CMP-sialic acid transporter), member A1
  ENSP ID: ENSP00000358570
MAAPRDNVTLLFKLYCLAVMTLMAAVYTIALRYTRTSDKELYFSTTAVCITEVIKLLLSVGILAKETGSLGRFKASLRENVLGSPKELLKLSVPSLVYAVQNNMAFLALSNLDAAVYQVTYQLKIPCTALCTVLMLNRTLSKLQWVSVFMLCAGVTLVQWKPAQATKVVFLQVLVASTLLLWLSTQTTS

SEQ ID NO: 81336 - protein, 65 aa, Homo sapiens
  Payload ID: 16212
  Gene Symbol: SLC35A1
  Gene Name: solute carrier family 35 (CMP-sialic acid transporter), member A1
  ENSP ID: ENSP00000438603
MAAPRDNVTLLFKLYCLAVMTLMAAVYTIALRYTRTSDKELYFSTTAVCITEVIKLLLSVGILAK

SEQ ID NO: 81337 - protein, 189 aa, Homo sapiens
  Payload ID: 16212
  Gene Symbol: SLC35A1
  Gene Name: solute carrier family 35 (CMP-sialic acid transporter), member A1
  ENSP ID: ENSP00000479535
MTLMAAVYTIALRYTRTSDKELYFSTTAVCITEVIKLLLSVGILAKETGSLGRFKASLRENVLGSPKELLKLSVPSLVYAVQNNMAFLALSNLDAAVYQVTYQLKIPCTALCTVLMLNRTLSKLQWVSVFMLCAGVTLVQWKPAQATKVVEYILKKFKEFRYFSLGEKHSNVSIRDYCDISWRLLVRWS

SEQ ID NO: 81338 - protein, 364 aa, Homo sapiens
  Payload ID: 16213
  Gene Symbol: SLC35C1
  Gene Name: solute carrier family 35 (GDP-fucose transporter), member C1
  Uniprot ID: Q96A29
  ENSP ID: ENSP00000313318
MNRAPLKRSRILHMALTGASDPSAEAEANGEKPFLLRALQIALVVSLYWVTSISMVFLNKYLLDSPSLRLDTPIFVTFYQCLVTTLLCKGLSALAACCPGAVDFPSLRLDLRVARSVLPLSVVFIGMITFNNLCLKYVGVAFYNVGRSLTTVFNVLLSYLLLKQTTSFYALLTCGIIIGGFWLGVDQEGAEGTLSWLGTVFGVLASLCVSLNAIYTTKVLPAVDGSIWRLTFYNNVNACILFLPLLLLLGELQALRDFAQLGSAHFWGMMTLGGLFGFAIGYVTGLQIKFTSPLTHNVSGTAKACAQTVLAVLYYEETKSFLWWTSNMMVLGGSSAYTWVRGWEMKKTPEEPSPKDSEKSAMGV

SEQ ID NO: 81339 - protein, 351 aa, Homo sapiens
  Payload ID: 16213
  Gene Symbol: SLC35C1
  Gene Name: solute carrier family 35 (GDP-fucose transporter), member C1
  Uniprot ID: Q96A29
  ENSP ID: ENSP00000412408
MALTGASDPSAEAEANGEKPFLLRALQIALVVSLYWVTSISMVFLNKYLLDSPSLRLDTPIFVTFYQCLVTTLLCKGLSALAACCPGAVDFPSLRLDLRVARSVLPLSVVFIGMITFNNLCLKYVGVAFYNVGRSLTTVFNVLLSYLLLKQTTSFYALLTCGIIIGGFWLGVDQEGAEGTLSWLGTVFGVLASLCVSLNAIYTTKVLPAVDGSIWRLTFYNNVNACILFLPLLLLLGELQALRDFAQLGSAHFWGMMTLGGLFGFAIGYVTGLQIKFTSPLTHNVSGTAKACAQTVLAVLYYEETKSFLWWTSNMMVLGGSSAYTWVRGWEMKKTPEEPSPKDSEKSAMGV

SEQ ID NO: 81340 - protein, 72 aa, Homo sapiens
  Payload ID: 16213
  Gene Symbol: SLC35C1
  Gene Name: solute carrier family 35 (GDP-fucose transporter), member C1
  ENSP ID: ENSP00000432145
MALTGASDPSAEAEANGEKPFLLRALQIALVVSLYWVTSISMVFLNKYLLDSPSLRLDTPIFVTFYQCLVTT

SEQ ID NO: 81341 - protein, 165 aa, Homo sapiens
  Payload ID: 16213
  Gene Symbol: SLC35C1
  Gene Name: solute carrier family 35 (GDP-fucose transporter), member C1
  ENSP ID: ENSP00000432669
MALTGASDPSAEAEANGEKPFLLRALQIALVVSLYWVTSISMVFLNKYLLDSPSLRLDTPIFVTFYQCLVTTLLCKGLSALAACCPGAVDFPSLRLDLRVARSVLPLSVVFIGMITFNNLCLKYVGVAFYNVGRSLTTVFNVLLSYLLLKQTTSFYALLTCGIII

SEQ ID NO: 81342 - protein, 365 aa, Homo sapiens
  Payload ID: 16214
  Gene Symbol: SLC35C2
  Gene Name: solute carrier family 35 (GDP-fucose transporter), member C2
  Uniprot ID: Q9NQQ7
  ENSP ID: ENSP00000243896
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLYTMTKSSAVLFILIFSLIFKLEELRAALVLVVLLIAGGLFMFTYKSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGDGGPKALKGLGSSPDLELLLRSSQREEGDNEEEEYFVAQGQQ

SEQ ID NO: 81343 - protein, 394 aa, Homo sapiens
  Payload ID: 16214
  Gene Symbol: SLC35C2
  Gene Name: solute carrier family 35 (GDP-fucose transporter), member C2
  Uniprot ID: Q9NQQ7
  ENSP ID: ENSP00000318960
MGRVSTSHQPLRGVPAPADSGAPVLQPPRMGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLYTMTKSSAVLFILIFSLIFKLEELRAALVLVVLLIAGGLFMFTYKSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGDGGPKALKGLGSSPDLELLLRSSQREEGDNEEEEYFVAQGQQ

SEQ ID NO: 81344 - protein, 365 aa, Homo sapiens; identical to SEQ ID NO: 81342
  Payload ID: 16214
  Gene Symbol: SLC35C2
  Gene Name: solute carrier family 35 (GDP-fucose transporter), member C2
  Uniprot ID: Q9NQQ7
  ENSP ID: ENSP00000361301

SEQ ID NO: 81345 - protein, 365 aa, Homo sapiens; identical to SEQ ID NO: 81342
  Payload ID: 16214
  Gene Symbol: SLC35C2
  Gene Name: solute carrier family 35 (GDP-fucose transporter), member C2
  Uniprot ID: Q9NQQ7
  ENSP ID: ENSP00000361304

SEQ ID NO: 81346 - protein, 196 aa, Homo sapiens
  Payload ID: 16214
  Gene Symbol: SLC35C2
  Gene Name: solute carrier family 35 (GDP-fucose transporter), member C2
  ENSP ID: ENSP00000397142
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLPHSSTWRASPWCWGPRSSVAFAGPSPRCSCRRLNSASRIPSTPCSTCSHSCSWGSSLSLLYLKVSICPHLRKSSVSRTQGCSCG

SEQ ID NO: 81347 - protein, 157 aa, Homo sapiens
  Payload ID: 16214
  Gene Symbol: SLC35C2
  Gene Name: solute carrier family 35 (GDP-fucose transporter), member C2
  ENSP ID: ENSP00000415736
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLARHWSWWSSSSPGVSSCSPTSPHSSTWRASPWCWGPRSSVAFAGP

SEQ ID NO: 81348 - protein, 344 aa, Homo sapiens
  Payload ID: 16214
  Gene Symbol: SLC35C2
  Gene Name: solute carrier family 35 (GDP-fucose transporter), member C2
  Uniprot ID: Q9NQQ7
  ENSP ID: ENSP00000439974
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLYTMTKSSAVLFILIFSLIFKLEELSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGDGGPKALKGLGSSPDLELLLRSSQREEGDNEEEEYFVAQGQQ

SEQ ID NO: 81349 - protein, 396 aa, Homo sapiens
  Payload ID: 16215
  Gene Symbol: SLC35A2
  Gene Name: solute carrier family 35 (UDP-galactose transporter), member A2
  Uniprot ID: P78381
  ENSP ID: ENSP00000247138
MAAVGAGGSTAAPGPGAVSAGALEPGTASAAHRRLKYISLAVLVVQNASLILSIRYARTLPGDRFFATTAVVMAEVLKGLTCLLLLFAQKRGNVKHLVLFLHEAVLVQYVDTLKLAVPSLIYTLQNNLQYVAISNLPAATFQVTYQLKILTTALFSVLMLNRSLSRLQWASLLLLFTGVAIVQAQQAGGGGPRPLDQNPGAGLAAVVASCLSSGFAGVYFEKILKGSSGSVWLRNLQLGLFGTALGLVGLWWAEGTAVATRGFFFGYTPAVWGVVLNQAFGGLLVAVVVKYADNILKGFATSLSIVLSTVASIRLFGFHVDPLFALGAGLVIGAVYLYSLPRGAAKAIASASASASGPCVHQQPPGQPPPPQLSSHRGDLITEPFLPKLLTKVKGS

SEQ ID NO: 81350 - protein, 163 aa, Homo sapiens
  Payload ID: 16215
  Gene Symbol: SLC35A2
  Gene Name: solute carrier family 35 (UDP-galactose transporter), member A2
  ENSP ID: ENSP00000365695
MAAVGAGGSTAAPGPGAVSAGALEPGTASAAHRRLKYISLAVLVVQNASLILSIRYARTLPGDRFFATTAVVMAEVLKGLTCLLLLFAQKRGNVKHLVLFLHEAVLVQYVDTLKLAVPSLIYTLQNNLQYVAISNLPAATFQVSPKPSMAPEELTGLGTGVWE

SEQ ID NO: 81351 - protein, 218 aa, Homo sapiens
  Payload ID: 16215
  Gene Symbol: SLC35A2
  Gene Name: solute carrier family 35 (UDP-galactose transporter), member A2
  ENSP ID: ENSP00000365698
MKLCRDAHRRLKYISLAVLVVQNASLILSIRYARTLPGDRFFATTAVVMAEVLKGLTCLLLLFAQKRGNVKHLVLFLHEAVLVQYVDTLKLAVPSLIYTLQNNLQYVAISNLPAATFQPSPRCSQSHSLCLCLRLRALRSPAASRAATTTAAVFPPWRPHHGALSAKVSAGEVRAGSNGGTQGRGTGVEGVGHLQDPSRHPPGPGSSGFGRWSFLPGH

SEQ ID NO: 81352 - protein, 393 aa, Homo sapiens
  Payload ID: 16215
  Gene Symbol: SLC35A2
  Gene Name: solute carrier family 35 (UDP-galactose transporter), member A2
  Uniprot ID: P78381
  ENSP ID: ENSP00000365704
MAAVGAGGSTAAPGPGAVSAGALEPGTASAAHRRLKYISLAVLVVQNASLILSIRYARTLPGDRFFATTAVVMAEVLKGLTCLLLLFAQKRGNVKHLVLFLHEAVLVQYVDTLKLAVPSLIYTLQNNLQYVAISNLPAATFQVTYQLKILTTALFSVLMLNRSLSRLQWASLLLLFTGVAIVQAQQAGGGGPRPLDQNPGAGLAAVVASCLSSGFAGVYFEKILKGSSGSVWLRNLQLGLFGTALGLVGLWWAEGTAVATRGFFFGYTPAVWGVVLNQAFGGLLVAVVVKYADNILKGFATSLSIVLSTVASIRLFGFHVDPLFALGAGLVIGAVYLYSLPRGAAKAIASASASASGPCVHQQPPGQPPPPQLSSHRGDLITEPFLPKSVLVK

SEQ ID NO: 81353 - protein, 224 aa, Homo sapiens
  Payload ID: 16215
  Gene Symbol: SLC35A2
  Gene Name: solute carrier family 35 (UDP-galactose transporter), member A2
  ENSP ID: ENSP00000365712
MAAVGAGGSTAAPGPGAVSAGALEPGTASAAHRRLKYISLAVLVVQNASLILSIRYARTLPGDRFFATTAVVMAEVLKGLTCLLLLFAQKRGNVKHLVLFLHEAVLVQYVDTLKLAVPSLIYTLQNNLQYVAISNLPAATFQPSPRCSQSHSLCLCLRLRALRSPAASRAATTTAAVFPPWRPHHGALSAKVAHQGEGFLAAGIEDIGLASFSLLALGPAGTKL

SEQ ID NO: 81354 - protein, 202 aa, Homo sapiens
  Payload ID: 16215
  Gene Symbol: SLC35A2
  Gene Name: solute carrier family 35 (UDP-galactose transporter), member A2
  Uniprot ID: P78381
  ENSP ID: ENSP00000393233
  MOD_RES (1)..(1): Any amino acid
XMAEVLKGLTCLLLLFAQKRGNVKHLVLFLHEAVLVQYVDTLKLAVPSLIYTLQNNLQYVAISNLPAATFQVSTLRRSSKAAQAPCGCATCNWASSAQHWAWWGSGGLRVPPWPPVVSFLGTHLLSGAWCSTRPSAGYWWLWLSSTLTISSRALPPPCPLCCPLLPPFASLASTWTHYLPLALDSSLVLSTSTAFPEVQPKP

SEQ ID NO: 81355 - protein, 242 aa, Homo sapiens
  Payload ID: 16215
  Gene Symbol: SLC35A2
  Gene Name: solute carrier family 35 (UDP-galactose transporter), member A2
  Uniprot ID: P78381
  ENSP ID: ENSP00000402726
MAAVGAGGSTAAPGPGAVSAGALEPGTASAAHRRLKYISLAVLVVQNASLILSIRYARTLPGDRFFATTAVVMAEVLKGLTCLLLLFAQKRGNVKHLVLFLHEAVLVQYVDTLKLAVPSLIYTLQNNLQYVAISNLPAATFQPSPRCSQSHSLCLCLRLRALRSPAASRAATTTAAVFPPWRPHHGALSAKVSAGEVRAGSNGGTQGRGTGVEGVGHLQDPSRHPPGPGSSGFGRWSFLPGH

SEQ ID NO: 81356 - protein, 175 aa, Homo sapiens
  Payload ID: 16215
  Gene Symbol: SLC35A2
  Gene Name: solute carrier family 35 (UDP-galactose transporter), member A2
  ENSP ID: ENSP00000415518
MAEVLKGLTCLLLLFAQKRGNVKHLVLFLHEAVLVQYVDTLKLAVPSLIYTLQNNLQYVAISNLPAATFQVTYQLKILTTALFSVLMLNRSLSRLQWASLLLLFTGVAIVQAQQAGGGGPRPLDQNPGAGLAAVVASCLSSGFAGVYFEKILKGSSGSVWLRNLQLGLFGTALGL

SEQ ID NO: 81357 - protein, 421 aa, Homo sapiens
  Payload ID: 16215
  Gene Symbol: SLC35A2
  Gene Name: solute carrier family 35 (UDP-galactose transporter), member A2
  Uniprot ID: P78381
  ENSP ID: ENSP00000416002
MAAVGAGGSTAAPGPGAVSAGALEPGTASAELLLTWEEAEARGQGLPQPLPDTSVRIPAHRRLKYISLAVLVVQNASLILSIRYARTLPGDRFFATTAVVMAEVLKGLTCLLLLFAQKRGNVKHLVLFLHEAVLVQYVDTLKLAVPSLIYTLQNNLQYVAISNLPAATFQVTYQLKILTTALFSVLMLNRSLSRLQWASLLLLFTGVAIVQAQQAGGGGPRPLDQNPGAGLAAVVASCLSSGFAGVYFEKILKGSSGSVWLRNLQLGLFGTALGLVGLWWAEGTAVATRGFFFGYTPAVWGVVLNQAFGGLLVAVVVKYADNILKGFATSLSIVLSTVASIRLFGFHVDPLFALGAGLVIGAVYLYSLPRGAAKAIASASASASGPCVHQQPPGQPPPPQLSSHRGDLITEPFLPKSVLVK

SEQ ID NO: 81358 - protein, 406 aa, Homo sapiens
  Payload ID: 16215
  Gene Symbol: SLC35A2
  Gene Name: solute carrier family 35 (UDP-galactose transporter), member A2
  ENSP ID: ENSP00000478617
MAAVGAGGSTAAPGPGAVSAGALEPGTASAGETVCPSSRMGGGAHRRLKYISLAVLVVQNASLILSIRYARTLPGDRFFATTAVVMAEVLKGLTCLLLLFAQKRGNVKHLVLFLHEAVLVQYVDTLKLAVPSLIYTLQNNLQYVAISNLPAATFQVTYQLKILTTALFSVLMLNRSLSRLQWASLLLLFTGVAIVQAQQAGGGGPRPLDQNPGAGLAAVVASCLSSGFAGVYFEKILKGSSGSVWLRNLQLGLFGTALGLVGLWWAEGTAVATRGFFFGYTPAVWGVVLNQAFGGLLVAVVVKYADNILKGFATSLSIVLSTVASIRLFGFHVDPLFALGAGLVIGAVYLYSLPRGAAKAIASASASASGPCVHQQPPGQPPPPQLSSHRGDLITEPFLPKSVLVK

SEQ ID NO: 81359 - protein, 176 aa, Homo sapiens
  Payload ID: 16215
  Gene Symbol: SLC35A2
  Gene Name: solute carrier family 35 (UDP-galactose transporter), member A2
  ENSP ID: ENSP00000489089
MAAVGAGGSTAAPGPGAVSAGALEPGTASAGETVCPSSRMGGGAHRRLKYISLAVLVVQNASLILSIRYARTLPGDRFFATTAVVMAEVLKGLTCLLLLFAQKRGNVKHLVLFLHEAVLVQYVDTLKLAVPSLIYTLQNNLQYVAISNLPAATFQVSPKPSMAPEELTGLGTGVWE

SEQ ID NO: 81360 - protein, 332 aa, Homo sapiens
  Payload ID: 16215
  Gene Symbol: SLC35A2
  Gene Name: solute carrier family 35 (UDP-galactose transporter), member A2
  ENSP ID: ENSP00000489197
MAAVGAGGSTAAPGPGAVSAGALEPGTASAGNVKHLVLFLHEAVLVQYVDTLKLAVPSLIYTLQNNLQYVAISNLPAATFQVTYQLKILTTALFSVLMLNRSLSRLQWASLLLLFTGVAIVQAQQAGGGGPRPLDQNPGAGLAAVVASCLSSGFAGVYFEKILKGSSGSVWLRNLQLGLFGTALGLVGLWWAEGTAVATRGFFFGYTPAVWGVVLNQAFGGLLVAVVVKYADNILKGFATSLSIVLSTVASIRLFGFHVDPLFALGAGLVIGAVYLYSLPRGAAKAIASASASASGPCVHQQPPGQPPPPQLSSHRGDLITEPFLPKSVLVK

SEQ ID NO: 81361 - protein, 175 aa, Homo sapiens
  Payload ID: 16215
  Gene Symbol: SLC35A2
  Gene Name: solute carrier family 35 (UDP-galactose transporter), member A2
  ENSP ID: ENSP00000489339
  MOD_RES (1)..(1): Any amino acid
XAAVGAGGSTAAPGPGAVSAGALEPGTASAAHRRLKYISLAVLVVQNASLILSIRYARTLPGDRFFATTAVVMAEVLKGLTCLLLLFAQKRGNVKHLVLFLHEAVLVQYVDTLKLAVPSLIYTLQNNLQYVAISNLPAATFQVAHQGEGFLAAGIEDIGLASFSLLALGPAGTKL

SEQ ID NO: 81362 - protein, 114 aa, Homo sapiens
  Payload ID: 16215
  Gene Symbol: SLC35A2
  Gene Name: solute carrier family 35 (UDP-galactose transporter), member A2
  ENSP ID: ENSP00000489356
MAAVGAGGSTAAPGPGAVSAGALEPGTASAAHRRLKYISLAVLVVQNASLILSIRYARTLPGDRFFATTAVVMAEVLKGLTCLLLLFAQKRGCPGAVCGHAQARSALSHLHLAE

SEQ ID NO: 81363 - protein, 102 aa, Homo sapiens
  Payload ID: 16215
  Gene Symbol: SLC35A2
  Gene Name: solute carrier family 35 (UDP-galactose transporter), member A2
  ENSP ID: ENSP00000489440
MAAVGAGGSTAAPGPGAVSAGALEPGTASAGNVKHLVLFLHEAVLVQYVDTLKLAVPSLIYTLQNNLQYVAISNLPAATFQVSPKPSMAPEELTGLGTGVWE

SEQ ID NO: 81364 - protein, 393 aa, Homo sapiens; identical to SEQ ID NO: 81352
  Payload ID: 16215
  Gene Symbol: SLC35A2
  Gene Name: solute carrier family 35 (UDP-galactose transporter), member A2
  ENSP ID: ENSP00000489484

SEQ ID NO: 81365 - protein, 191 aa, Homo sapiens
  Payload ID: 16215
  Gene Symbol: SLC35A2
  Gene Name: solute carrier family 35 (UDP-galactose transporter), member A2
  ENSP ID: ENSP00000489515
MAAVGAGGSTAAPGPGAVSAGALEPGTASAAHRRLKYISLAVLVVQNASLILSIRYARTLPGDRFFATTAVVMAEVLKGNVKHLVLFLHEAVLVQYVDTLKLAVPSLIYTLQNNLQYVAISNLPAATFQVTYQLKILTTALFSVLMLNRSLSRLQWASLLLLFTGVAIVQAQQAGGGGPRPLDQNPGAGLA

SEQ ID NO: 81366 - protein, 60 aa, Homo sapiens
  Payload ID: 16215
  Gene Symbol: SLC35A2
  Gene Name: solute carrier family 35 (UDP-galactose transporter), member A2
  ENSP ID: ENSP00000489613
MAAVGAGGSTAAPGPGAVSAGALEPGTASAGETVCPSSRMGGGGRDRWESGMFLTKLTGA

SEQ ID NO: 81367 - protein, 355 aa, Homo sapiens
  Payload ID: 16216
  Gene Symbol: SLC35D1
  Gene Name: solute carrier family 35 (UDP-GlcA/UDP-GalNAc transporter), member D1
  Uniprot ID: Q9NTN3
  ENSP ID: ENSP00000235345
MAEVHRRQHARVKGEAPAKSSTLRDEEELGMASAETLTVFLKLLAAGFYGVSSFLIVVVNKSVLTNYRFPSSLCVGLGQMVATVAVLWVGKALRVVKFPDLDRNVPRKTFPLPLLYFGNQITGLFSTKKLNLPMFTVLRRFSILFTMFAEGVLLKKTFSWGIKMTVFAMIIGAFVAASSDLAFDLEGYAFILINDVLTAANGAYVKQKLDSKELGKYGLLYYNALFMILPTLAIAYFTGDAQKAVEFEGWADTLFLLQFTLSCVMGFILMYATVLCTQYNSALTTTIVGCIKNILITYIGMVFGGDYIFTWTNFIGLNISIAGSLVYSYITFTEEQLSKQSEANNKLDIKGKGAV

SEQ ID NO: 81368 - protein, 337 aa, Homo sapiens
  Payload ID: 16217
  Gene Symbol: SLC35D2
  Gene Name: solute carrier family 35 (UDP-GlcNAc/UDP-glucose transporter), member D2
  Uniprot ID: Q76EJ3
  ENSP ID: ENSP00000253270
MTAGGQAEAEGAGGEPGAARLPSRVARLLSALFYGTCSFLIVLVNKALLTTYGFPSPIFLGIGQMAATIMILYVSKLNKIIHFPDFDKKIPVKLFPLPLLYVGNHISGLSSTSKLSLPMFTVLRKFTIPLTLLLETIILGKQYSLNIILSVFAIILGAFIAAGSDLAFNLEGYIFVFLNDIFTAANGVYTKQKMDPKELGKYGVLFYNACFMIIPTLIISVSTGDLQQATEFNQWKNVVFILQFLLSCFLGFLLMYSTVLCSYYNSALTTAVVGAIKNVSVAYIGILIGGDYIFSLLNFVGLNICMAGGLRYSFLTLSSQLKPKPVGEENICLDLKS

SEQ ID NO: 81369 - protein, 163 aa, Homo sapiens
  Payload ID: 16217
  Gene Symbol: SLC35D2
  Gene Name: solute carrier family 35 (UDP-GlcNAc/UDP-glucose transporter), member D2
  ENSP ID: ENSP00000364406
MTAGGQAEAEGAGGEPGAARLPSRVARLLSALFYGTCSFLIVLVNKALLTTYGFPSPIFLGIGQMAATIMILYVSKLNKIIHFPDFDKKIPVKLFPLPLLYVGNHISGLSSTSKLSLPMFTVLRKFTIPLTLLLETIILGKQYSLNIILSVFAIILGAFIAAG

SEQ ID NO: 81370 - protein, 249 aa, Homo sapiens
  Payload ID: 16217
  Gene Symbol: SLC35D2
  Gene Name: solute carrier family 35 (UDP-GlcNAc/UDP-glucose transporter), member D2
  Uniprot ID: Q76EJ3
  ENSP ID: ENSP00000364408
MTAGGQAEAEGAGGEPGAARLPSRVARLLSALFYGTCSFLIVLVNKALLTTYGFPSPIFLGIGQMAATIMILYVSKLNKIIHFPDFDKKIPVKLFPLPLLYVGNHISGLSSTSKLSLPMFTVLRKFTIPLTLLLETIILGKQYSLNIILSVFAIILGAFIAAGFLLMYSTVLCSYYNSALTTAVVGAIKNVSVAYIGILIGGDYIFSLLNFVGLNICMAGGLRYSFLTLSSQLKPKPVGEENICLDLKS

SEQ ID NO: 81371 - protein, 367 aa, Homo sapiens
  Payload ID: 16218
  Gene Symbol: SLC35A3
  Gene Name: solute carrier family 35 (UDP-N-acetylglucosamine (UDP-GlcNAc) transporter), member A3
  Uniprot ID: Q9Y2D2
  ENSP ID: ENSP00000359172
MSSRSVLSPVVGTDAPDQHLELKKPQELKEMERLPLANEDKTMFANLKYVSLGILVFQTTSLVLTMRYSRTLKEEGPRYLSSTAVVVAELLKIMACILLVYKDSKCSLRALNRVLHDEILNKPMETLKLAIPSGIYTLQNNLLYVALSNLDAATYQVTYQLKILTTALFSVSMLSKKLGVYQWLSLVILMTGVAFVQWPSDSQLDSKELSAGSQFVGLMAVLTACFSSGFAGVYFEKILKETKQSVWIRNIQLGFFGSIFGLMGVYIYDGELVSKNGFFQGYNRLTWIVVVLQALGGLVIAAVIKYADNILKGFATSLSIILSTLISYFWLQDFVPTSVFFLGAILVITATFLYGYDPKPAGNPTKA

SEQ ID NO: 81372 - protein, 325 aa, Homo sapiens
  Payload ID: 16218
  Gene Symbol: SLC35A3
  Gene Name: solute carrier family 35 (UDP-N-acetylglucosamine (UDP-GlcNAc) transporter), member A3
  Uniprot ID: Q9Y2D2
  ENSP ID: ENSP00000359174
MFANLKYVSLGILVFQTTSLVLTMRYSRTLKEEGPRYLSSTAVVVAELLKIMACILLVYKDSKCSLRALNRVLHDEILNKPMETLKLAIPSGIYTLQNNLLYVALSNLDAATYQVTYQLKILTTALFSVSMLSKKLGVYQWLSLVILMTGVAFVQWPSDSQLDSKELSAGSQFVGLMAVLTACFSSGFAGVYFEKILKETKQSVWIRNIQLGFFGSIFGLMGVYIYDGELVSKNGFFQGYNRLTWIVVVLQALGGLVIAAVIKYADNILKGFATSLSIILSTLISYFWLQDFVPTSVFFLGAILVITATFLYGYDPKPAGNPTKA

SEQ ID NO: 81373 - protein, 224 aa, Homo sapiens
  Payload ID: 16218
  Gene Symbol: SLC35A3
  Gene Name: solute carrier family 35 (UDP-N-acetylglucosamine (UDP-GlcNAc) transporter), member A3
  ENSP ID: ENSP00000401679
MFANLKYVSLGILVFQTTSLVLTMRYSRTLKEEGPRYLSSTAVVVAELLKIMACILLVYKDSKCSLRALNRVLHDEILNKPMETLKLAIPSGIYTLQNNLLYVALSNLDAATYQVTYQLKILTTALFSVSMLSKKLGVYQWLSLVILMTGVAFVQWPSDSQLDSKELSAGSQFVGLMAVLTACFSSGFAGVYFEKILKETKQSVWIRNIQLGFFGSIFGLMGVY

SEQ ID NO: 81374 - protein, 325 aa, Homo sapiens; identical to SEQ ID NO: 81372
  Payload ID: 16218
  Gene Symbol: SLC35A3
  Gene Name: solute carrier family 35 (UDP-N-acetylglucosamine (UDP-GlcNAc) transporter), member A3
  Uniprot ID: Q9Y2D2
  ENSP ID: ENSP00000414947

SEQ ID NO: 81375 - protein, 220 aa, Homo sapiens
  Payload ID: 16218
  Gene Symbol: SLC35A3
  Gene Name: solute carrier family 35 (UDP-N-acetylglucosamine (UDP-GlcNAc) transporter), member A3
  Uniprot ID: Q9Y2D2
  ENSP ID: ENSP00000418527
MFANLKYVSLGILVFQTTSLVLTMRYSRTLKEEGPRYLSSTAVVVAELLKIMACILLVYKDSKCSLRALNRVLHDEILNKPMETLKLAIPSGIYTLQNNLLYVALSNLDAATYQVTYQLKILTTALFSVSMLSKKLGVYQWLSLVILMTGVAFVQWPSDSQLDSKELSAGSQFVGLMAVLTACFSSGFAGVYFEKILKETKQSVWIRNIQLVSFSLEPSL

SEQ ID NO: 81376 - protein, 325 aa, Homo sapiens; identical to SEQ ID NO: 81372
  Payload ID: 16218
  Gene Symbol: SLC35A3
  Gene Name: solute carrier family 35 (UDP-N-acetylglucosamine (UDP-GlcNAc) transporter), member A3
  Uniprot ID: Q9Y2D2
  ENSP ID: ENSP00000433849

SEQ ID NO: 81377 - protein, 84 aa, Homo sapiens
  Payload ID: 16218
  Gene Symbol: SLC35A3
  Gene Name: solute carrier family 35 (UDP-N-acetylglucosamine (UDP-GlcNAc) transporter), member A3
  ENSP ID: ENSP00000436938
MFANLKYVSLGILVFQTTSLVLTMRYSRTLKEEGPRYLSSTAVVVAELLKIMACILLVYKDSKCSLRALNRVLHDEILNKPMET

SEQ ID NO: 81378 - protein, 331 aa, Homo sapiens
  Payload ID: 16219
  Gene Symbol: SLC35B4
  Gene Name: solute carrier family 35 (UDP-xylose/UDP-N-acetylglucosamine transporter), member B4
  Uniprot ID: Q969S0
  ENSP ID: ENSP00000367770
MRPALAVGLVFAGCCSNVIFLELLARKHPGCGNIVTFAQFLFIAVEGFLFEADLGRKPPAIPIRYYAIMVTMFFTVSVVNNYALNLNIAMPLHMIFRSGSLIANMILGIIILKKRYSIFKYTSIALVSVGIFICTFMSAKQVTSQSSLSENDGFQAFVWWLLGIGALTFALLMSARMGIFQETLYKRFGKHSKEALFYNHALPLPGFVFLASDIYDHAVLFNKSELYEIPVIGVTLPIMWFYLLMNIITQYVCIRGVFILTTECASLTVTLVVTLRKFVSLIFSILYFQNPFTLWHWLGTLFVFIGTLMYTEVWNNLGTTKSEPQKDSKKN

SEQ ID NO: 81379 - protein, 132 aa, Homo sapiens
  Payload ID: 16219
  Gene Symbol: SLC35B4
  Gene Name: solute carrier family 35 (UDP-xylose/UDP-N-acetylglucosamine transporter), member B4
  ENSP ID: ENSP00000405445
MRPALAVGLVFAGCCSNVIFLELLARKHPGCGNIVTFAQFLFIAVEGFLFEADLGRKPPAIPIRYYAIMVTMFFTVSVVNNYALNLNIAMPLHMIFRSIQYIQIYLHCPGVCGDIYLHFYVSKAGDFPVQLE

SEQ ID NO: 81380 - protein, 231 aa, Homo sapiens
  Payload ID: 16219
  Gene Symbol: SLC35B4
  Gene Name: solute carrier family 35 (UDP-xylose/UDP-N-acetylglucosamine transporter), member B4
  Uniprot ID: Q969S0
  ENSP ID: ENSP00000485857
MRPALAVGLVFAGCCSNVIFLELLARKHPGCGNIVTFAQFLFIAVEGFLFEADLGRKPPAIPIRYYAIMVTMFFTVSVVNNYALNLNIAMPLHMIFRSGSLIANMILGIIILKKRYSIFKYTSIALVSVGIFICTFMSAKQVTSQSSLSENDGFQAFVWWLLGIGALTFALLMSARMGIFQETLYKRFGKHSKEALFYNHALPLPGFVFLASDIYDHAVLFNKSGEFGVRQ

SEQ ID NO: 81381 - protein, 324 aa, Homo sapiens
  Payload ID: 16220
  Gene Symbol: SLC35A4
  Gene Name: solute carrier family 35, member A4
  Uniprot ID: Q96G79
  ENSP ID: ENSP00000327133
MSVEDGGMPGLGRPRQARWTLMLLLSTAMYGAHAPLLALCHVDGRVPFRPSSAVLLTELTKLLLCAFSLLVGWQAWPQGPPPWRQAAPFALSALLYGANNNLVIYLQRYMDPSTYQVLSNLKIGSTAVLYCLCLRHRLSVRQGLALLLLMAAGACYAAGGLQVPGNTLPSPPPAAAASPMPLHITPLGLLLLILYCLISGLSSVYTELLMKRQRLPLALQNLFLYTFGVLLNLGLHAGGGSGPGLLEGFSGWAALVVLSQALNGLLMSAVMKHGSSITRLFVVSCSLVVNAVLSAVLLRLQLTAAFFLATLLIGLAMRLYYGSR

SEQ ID NO: 81382 - protein, 324 aa, Homo sapiens; identical to SEQ ID NO: 81381
  Payload ID: 16220
  Gene Symbol: SLC35A4
  Gene Name: solute carrier family 35, member A4
  Uniprot ID: Q96G79
  ENSP ID: ENSP00000424566

SEQ ID NO: 81383 - protein, 324 aa, Homo sapiens; identical to SEQ ID NO: 81381
  Payload ID: 16220
  Gene Symbol: SLC35A4
  Gene Name: solute carrier family 35, member A4
  Uniprot ID: Q96G79
  ENSP ID: ENSP00000479255

SEQ ID NO: 81384 - protein, 103 aa, Homo sapiens
  Payload ID: 16220
  Gene Symbol: SLC35A4
  Gene Name: solute carrier family 35, member A4
  ENSP ID: ENSP00000485218
MADDKDSLPKLKDLAFLKNQLESLQRRVEDEVNSGVGQDGSLLSSPFLKGFLAGYVVAKLRASAVLGFAVGTCTGIYAAQAYAVPNVEKTLRDYLQLLRKGPD

SEQ ID NO: 81385 - protein, 235 aa, Homo sapiens
  Payload ID: 16221
  Gene Symbol: SLC35A5
  Gene Name: solute carrier family 35, member A5
  ENSP ID: ENSP00000261034
MEKQCCSHPVICSLSTMYTFLLGAIFIALSSSRILLVKYSANEENKYDYLPTTVNVCSELVKLVFCVLVSFCVIKKDHQSRNLKYASWKEFSDFMKWSIPAFLYFLDNLIVFYVLSYLQPAMAVIFSNFSIITTALLFRIVLKRRLNWIQWASLLTLFLSIVALTAGTKTLQHNLAGRGFHHDAFFSPSNSCLLFRSPPWNFSWKPHQSFSLYLFIMPASLKFRNTHLGKKGSEI

SEQ ID NO: 81386 - protein, 424 aa, Homo sapiens
  Payload ID: 16221
  Gene Symbol: SLC35A5
  Gene Name: solute carrier family 35, member A5
  Uniprot ID: Q9BS91
  ENSP ID: ENSP00000417654
MEKQCCSHPVICSLSTMYTFLLGAIFIALSSSRILLVKYSANEENKYDYLPTTVNVCSELVKLVFCVLVSFCVIKKDHQSRNLKYASWKEFSDFMKWSIPAFLYFLDNLIVFYVLSYLQPAMAVIFSNFSIITTALLFRIVLKRRLNWIQWASLLTLFLSIVALTAGTKTLQHNLAGRGFHHDAFFSPSNSCLLFRSECPRKDNCTAKEWTFPEAKWNTTARVFSHIRLGMGHVLIIVQCFISSMANIYNEKILKEGNQLTESIFIQNSKLYFFGILFNGLTLGLQRSNRDQIKNCGFFYGHSAFSVALIFVTAFQGLSVAFILKFLDNMFHVLMAQVTTVIITTVSVLVFDFRPSLEFFLEAPSVLLSIFIYNASKPQVPEYAPRQERIRDLSGNLWERSSGDGEELERLTKPKSDESDEDTF

SEQ ID NO: 81387 - protein, 88 aa, Homo sapiens
  Payload ID: 16221
  Gene Symbol: SLC35A5
  Gene Name: solute carrier family 35, member A5
  ENSP ID: ENSP00000418265
MEKQCCSHPVICSLSTMYTFLLGAIFIALSSSRILLVKYSANEENKYDYLPTTVNVCSELVKLVFCVLVSFCVIKKDHQSRNLKYASW

SEQ ID NO: 81388 - protein, 147 aa, Homo sapiens
  Payload ID: 16221
  Gene Symbol: SLC35A5
  Gene Name: solute carrier family 35, member A5
  ENSP ID: ENSP00000419958
MEKQCCSHPVICSLSTMYTFLLGAIFIALSSSRILLVKYSANEENKYDYLPTTVNVCSELVKLVFCVLVSFCVIKKDHQSRNLKYASWKEFSDFMKWSIPAFLYFLDNLIVFYVLSYLQPAMAVIFSNFSIITTALLFRIVLKRRLN

SEQ ID NO: 81389 - protein, 119 aa, Homo sapiens
  Payload ID: 16221
  Gene Symbol: SLC35A5
  Gene Name: solute carrier family 35, member A5
  ENSP ID: ENSP00000420398
MKWSIPAFLYFLDNLIVFYVLSYLQPAMAVIFSNFSIITTALLFRIVLKRRLNWIQWASLLTLFLSIVALTAGTKTLQHNLAGRGFHHDAFFSPSNSCLLFRTSLKFRNTHLGKKGSEI

SEQ ID NO: 81390 - protein, 359 aa, Homo sapiens
  Payload ID: 16222
  Gene Symbol: SLC35B1
  Gene Name: solute carrier family 35, member B1
  Uniprot ID: P78383
  ENSP ID: ENSP00000240333
MRPLPPVGDVRLELSPPPPLLPVPVVSGSPVGSSGRLMASSSSLVPDRLRLPLCFLGVFVCYFYYGILQEKITRGKYGEGAKQETFTFALTLVFIQCVINAVFAKILIQFFDTARVDRTRSWLYAACSISYLGAMVSSNSALQFVNYPTQVLGKSCKPIPVMLLGVTLLKKKYPLAKYLCVLLIVAGVALFMYKPKKVVGIEEHTVGYGELLLLLSLTLDGLTGVSQDHMRAHYQTGSNHMMLNINLWSTLLLGMGILFTGELWEFLSFAERYPAIIYNILLFGLTSALGQSFIFMTVVYFGPLTCSIITTTRKFFTILASVILFANPISPMQWVGTVLVFLGLGLDAKFGKGAKKTSH

SEQ ID NO: 81391 - protein, 194 aa, Homo sapiens
  Payload ID: 16222
  Gene Symbol: SLC35B1
  Gene Name: solute carrier family 35, member B1
  ENSP ID: ENSP00000422104
  MOD_RES (1)..(1): Any amino acid
XPLPPVGDVRLELSPPPPLLPVPVVSGSPVGSSGRLMASSSSLVPDRLRLPLCFLGVFVCYFYYGILQEKMVDRTRSWLYAACSISYLGAMVSSNSALQFVNYPTQVLGKSCKPIPVMLLGVTLLKKKYPLAKYLCVLLIVAGVALFMYKPKKVVGIEEHTVGYGELLLLLSLTLDGLTGVSQDHMRAHYQTGS

SEQ ID NO: 81392 - protein, 227 aa, Homo sapiens
  Payload ID: 16222
  Gene Symbol: SLC35B1
  Gene Name: solute carrier family 35, member B1
  ENSP ID: ENSP00000423323
MCDQCCVCQDLVDRTRSWLYAACSISYLGAMVSSNSALQFVNYPTQVLGKSCKPIPVMLLGVTLLKKKYPLAKYLCVLLIVAGVALFMYKPKKVVGIEEHTVGYGELLLLLSLTLDGLTGVSQDHMRAHYQTGSNHMMLNINLWSTLLLGMGILFTGELWEFLSFAERYPAIIYNILLFGLTSALGQSFIFMTVVYFGPLTCSIITTTRKFFTILASVILFANPISP

SEQ ID NO: 81393 - protein, 254 aa, Homo sapiens
  Payload ID: 16222
  Gene Symbol: SLC35B1
  Gene Name: solute carrier family 35, member B1
  ENSP ID: ENSP00000424367
MEPRTRVGPLLVLPDACKQPIRPRPWCHSRNTVSSCLGTRGKYGEGAKQETFTFALTLVFIQCVINAVFAKILIQFFDTARVDRTRSWLYAACSISYLGAMVSSNSALQFVNYPTQVLGKSCKPIPVMLLGVTLLKKKYPLAKYLCVLLIVAGVALFMYKPKKVVGIEEHTVGYGELLLLLSLTLDGLTGVSQDHMRAHYQTGSNHMMLNINLWSTLLLGMGILFTGELWEFLSFAERYPAIIYNILLFGLTSA

SEQ ID NO: 81394 - protein, 37 aa, Homo sapiens
  Payload ID: 16222
  Gene Symbol: SLC35B1
  Gene Name: solute carrier family 35, member B1
  ENSP ID: ENSP00000424857
TRGKYGEGAKQETFTFALTLVFIQCVINAVFAKICPW

SEQ ID NO: 81395 - protein, 157 aa, Homo sapiens
  Payload ID: 16222
  Gene Symbol: SLC35B1
  Gene Name: solute carrier family 35, member B1
  ENSP ID: ENSP00000425179
MRPLPPVGDVRLELSPPPPLLPVPVVSGSPVGSSGRLMASSSSLVPDRLRLPLCFLGVFVCYFYYGILQEKITRGKYGEGAKQETFTFALTLVFIQCVINAVFAKIWWIVPGAGSMLPVLSPIWVPWSPAIQHYSLSTTQLRSLVNPASQSQSCSLG

SEQ ID NO: 81396 - protein, 76 aa, Homo sapiens
  Payload ID: 16222
  Gene Symbol: SLC35B1
  Gene Name: solute carrier family 35, member B1
  ENSP ID: ENSP00000426402
MCDQCCVCQDLVDRTRSWLYAACSISYLGAMVSSNSALQFVNYPTQVLGKSCKPIPVMLLGVTLLKKKYPLAKYLC

SEQ ID NO: 81397 - protein, 187 aa, Homo sapiens
  Payload ID: 16222
  Gene Symbol: SLC35B1
  Gene Name: solute carrier family 35, member B1
  ENSP ID: ENSP00000426961
MEPRTRGKYGEGAKQETFTFALTLVFIQCVINAVFAKILIQFFDTARVDRTRSWLYAACSISYLGAMVSSNSALQFVNYPTQVLGKSCKPIPVMLLGVTLLKKKYPLAKYLCVLLIVAGVALFMYKPKKVVGIEEHTVGYGELLLLLSLTLDGLTGVSQDHMRAHYQTGSNHMMLNINLWSTLLLGM

SEQ ID NO: 81398 - protein, 285 aa, Homo sapiens
  Payload ID: 16222
  Gene Symbol: SLC35B1
  Gene Name: solute carrier family 35, member B1
  ENSP ID: ENSP00000427689
MRPLPPVGDVRLELSPPPPLLPVPVVSGSPVGSSGRLMASSSSLVPDRLRLPLCFLGVFVCYFYYGILQEKMTRVGPLLVLPDACKQPIRPRPWCHSRNTVSSCLGTRGKYGEGAKQETFTFALTLVFIQCVINAVFAKILIQFFDTARVDRTRSWLYAACSISYLGAMVSSNSALQFVNYPTQVLGKSCKPIPVMLLGVTLLKKKYPLAKYLCVLLIVAGVALFMYKPKKVVGIEEHTVGYGELLLLLSLTLDGLTGVSQDHMRAHYQTGSNHMMLNINLWSTL

SEQ ID NO: 81399 - protein, 416 aa, Homo sapiens
  Payload ID: 16223
  Gene Symbol: SLC35D3
  Gene Name: solute carrier family 35, member D3
  Uniprot ID: Q5M8T2
  ENSP ID: ENSP00000333591
MRQLCRGRVLGISVAIAHGVFSGSLNILLKFLISRYQFSFLTLVQCLTSSTAALSLELLRRLGLIAVPPFGLSLARSFAGVAVLSTLQSSLTLWSLRGLSLPMYVVFKRCLPLVTMLIGVLVLKNGAPSPGVLAAVLITTCGAALAGAGDLTGDPIGYVTGVLAVLVHAAYLVLIQKASADTEHGPLTAQYVIAVSATPLLVICSFASTDSIHAWTFPGWKDPAMVCIFVACILIGCAMNFTTLHCTYINSAVTTSFVGVVKSIATITVGMVAFSDVEPTSLFIAGVVVNTLGSIIYCVAKFMETRKQSNYEDLEAQPRGEEAQLSGDQLPFVMEELPGEGGNGRSEGGEAAGGPAQESRQEVRGSPRGVPLVAGSSEEGSRRSLKDAYLEVWRLVRGTRYMKKDYLIENEELPSP

SEQ ID NO: 81400 - protein, 105 aa, Homo sapiens
  Payload ID: 16224
  Gene Symbol: SLC35E1
  Gene Name: solute carrier family 35, member E1
  ENSP ID: ENSP00000387152
  MOD_RES (1)..(1): Any amino acid
XMKEKQSTKVYLSLIPIISGVLLATVTELSFDMWGLVSALAATLCFSLQNIFSKKVLRDSRIHHLRLLNILGCHAVFFMIPTWVLVDLSAFLVSSDLGLPSENVL

SEQ ID NO: 81401 - protein, 116 aa, Homo sapiens
  Payload ID: 16224
  Gene Symbol: SLC35E1
  Gene Name: solute carrier family 35, member E1
  ENSP ID: ENSP00000394092
MAQTYVYQWPWTLLLLAVSGFCNFAQNVIAFSILNLVSPLSYSVANATKRIMVITVSLIMLRNPVTSTNVLGMMTAILGVFLYNKTKYDANQQARKHLLPVTTADLSSKERHRSPL

SEQ ID NO: 81402 - protein, 344 aa, Homo sapiens
  Payload ID: 16224
  Gene Symbol: SLC35E1
  Gene Name: solute carrier family 35, member E1
  ENSP ID: ENSP00000400435
SGGAREGARVAALCLLWYALSAGGNVVNKVILSAFPFPVTVSLCHILALCAGLPPLLRAWRVPPAPPVSGPGPSPHPSSGPLLPPRFYPRYVLPLAFGKYFASVSAHVSIWKVPVSYAHTVKATMPIWVVLLSRIIMKEKQSTKVLRDSRIHHLRLLNILGCHAVFFMIPTWVLVDLSAFLVSSDLTYVYQWPWTLLLLAVSGFCNFAQNVIAFSILNLVSPLSYSVANATKRIMVITVSLIMLRNPVTSTNVLGMMTAILGVFLYNKTKYDANQQARKHLLPVTTADLSSKERHRSPLEKPHNGLLFPQHGDYQYGRNNILTDHFQYSRQSYPNSYSLNRYDV

SEQ ID NO: 81403 - protein, 410 aa, Homo sapiens
  Payload ID: 16224
  Gene Symbol: SLC35E1
  Gene Name: solute carrier family 35, member E1
  Uniprot ID: Q96K37
  ENSP ID: ENSP00000470652
MAAAAVGAGHGAGGPGAASSSGGAREGARVAALCLLWYALSAGGNVVNKVILSAFPFPVTVSLCHILALCAGLPPLLRAWRVPPAPPVSGPGPSPHPSSGPLLPPRFYPRYVLPLAFGKYFASVSAHVSIWKVPVSYAHTVKATMPIWVVLLSRIIMKEKQSTKVYLSLIPIISGVLLATVTELSFDMWGLVSALAATLCFSLQNIFSKKVLRDSRIHHLRLLNILGCHAVFFMIPTWVLVDLSAFLVSSDLTYVYQWPWTLLLLAVSGFCNFAQNVIAFSILNLVSPLSYSVANATKRIMVITVSLIMLRNPVTSTNVLGMMTAILGVFLYNKTKYDANQQARKHLLPVTTADLSSKERHRSPLEKPHNGLLFPQHGDYQYGRNNILTDHFQYSRQSYPNSYSLNRYDV

SEQ ID NO: 81404 - protein, 107 aa, Homo sapiens
  Payload ID: 16224
  Gene Symbol: SLC35E1
  Gene Name: solute carrier family 35, member E1
  ENSP ID: ENSP00000484120
MVITVSLIMLRNPVTSTNVLGMMTAILGVFLYNKTKYDANQQARKHLLPVTTADLSSKERHRSPLEKPHNGSSSPSTGTISTAQQHLNRPLPIQPAELPKLVQFEPL

SEQ ID NO: 81405 - protein, 266 aa, Homo sapiens
  Payload ID: 16225
  Gene Symbol: SLC35E2
  Gene Name: solute carrier family 35, member E2
  Uniprot ID: P0CK97
  ENSP ID: ENSP00000246421
MSSSVKTPALEELVPGSEEKPKGRSPLSWGSLFGHRSEKIVFAKSDGGTDENVLTVTITETTVIESDLGVWSSRALLYLTLWFFFSFCTLFLNKYILSLLGGEPSMLGAVQMLSTTVIGCVKTLVPCCLYQHKARLSYPPNFLMTMLFVGLMRFATVVLGLVSLKNVAVSFAETVKSSAPIFTVIMSRMILGEYTGRPSDREEREELQLQPGRGAAASDRRSPVPPSERHGVRPHGENLPGDFQVPQALHRVALSMALPCPMLPAS

SEQ ID NO: 81406 - protein, 246 aa, Homo sapiens
  Payload ID: 16225
  Gene Symbol: SLC35E2
  Gene Name: solute carrier family 35, member E2
  Uniprot ID: P0CK97
  ENSP ID: ENSP00000347614
MSSSVKTPALEELVPGSEEKPKGRSPLSWGSLFGHRSEKIVFAKSDGGTDENVLTVTITETTVIESDLGVWSSRALLYLTLWFFFSFCTLFLNKYILSLLGGEPSMLGAVQMLSTTVIGCVKTLVPCCLYQHKARLSYPPNFLMTMLFVGLMRFATVVLGLVSLKNVAVSFAETVKSSAPIFTVIMSRMILGEYTGRPSDREEREELQLQPGRGAAASDRRSPVPPSERHGVRPHGENLPGDFQAQ

SEQ ID NO: 81407 - protein, 246 aa, Homo sapiens
  Payload ID: 16226
  Gene Symbol: SLC35E2B
  Gene Name: solute carrier family 35, member E2B
  ENSP ID: ENSP00000478733
MSSSVKTPALEELVPGSEEKPKGRSPLSWGSLFGHRSEKIVFAKSDGGTDENVLTVTITETTVIESDLGVWSSRALLYLTLWFFFSFCTLFLNKYILSLLGGEPSMLGAVQMLSTTVIGCVKTLVPCCLYQHKARLSYPPNFLMTMLFVGLMRFATVVLGLVSLKNVAVSFAETVKSSAPIFTVIMSRMILGEYTGRPSDREEWEELQLQPGRGAAASDRRSPVPPSERHGVRPHGENLPGDFQAQ

SEQ ID NO: 81408 - protein, 405 aa, Homo sapiens
  Payload ID: 16226
  Gene Symbol: SLC35E2B
  Gene Name: solute carrier family 35, member E2B
  Uniprot ID: P0CK96
  ENSP ID: ENSP00000481694
MSSSVKTPALEELVPGSEEKPKGRSPLSWGSLFGHRSEKIVFAKSDGGTDENVLTVTITETTVIESDLGVWSSRALLYLTLWFFFSFCTLFLNKYILSLLGGEPSMLGAVQMLSTTVIGCVKTLVPCCLYQHKARLSYPPNFLMTMLFVGLMRFATVVLGLVSLKNVAVSFAETVKSSAPIFTVIMSRMILGEYTGLLVNLSLIPVMGGLALCTATEISFNVLGFSAALSTNIMDCLQNVFSKKLLSGDKYRFSAPELQFYTSAAAVAMLVPARVFFTDVPVIGRSGKSFSYNQDVVLLLLTDGVLFHLQSVTAYALMGKISPVTFSVASTVKHALSIWLSVIVFGNKITSLSAVGTALVTVGVLLYNKARQHQQEALQSLAAATGRAPDDTVEPLLPQDPRQHP

SEQ ID NO: 81409 - protein, 405 aa, Homo sapiens; identical to SEQ ID NO: 81408
  Payload ID: 16226
  Gene Symbol: SLC35E2B
  Gene Name: solute carrier family 35, member E2B
  Uniprot ID: P0CK96
  ENSP ID: ENSP00000484635

SEQ ID NO: 81410 - protein, 313 aa, Homo sapiens
  Payload ID: 16227
  Gene Symbol: SLC35E3
  Gene Name: solute carrier family 35, member E3
  Uniprot ID: Q7Z769
  ENSP ID: ENSP00000381089
MALLVDRVRGHWRIAAGLLFNLLVSICIVFLNKWIYVYHGFPNMSLTLVHFVVTWLGLYICQKLDIFAPKSLPPSRLLLLALSFCGFVVFTNLSLQNNTIGTYQLAKAMTTPVIIAIQTFCYQKTFSTRIQLTLIPITLGVILNSYYDVKFNFLGMVFAALGVLVTSLYQVWVGAKQHELQVNSMQLLYYQAPMSSAMLLVAVPFFEPVFGEGGIFGPWSVSALLMVLLSGVIAFMVNLSIYWIIGNTSPVTYNMFGHFKFCITLFGGYVLFKDPLSINQALGILCTLFGILAYTHFKLSEQEGSRSKLAQRP

SEQ ID NO: 81411 - protein, 125 aa, Homo sapiens
  Payload ID: 16227
  Gene Symbol: SLC35E3
  Gene Name: solute carrier family 35, member E3
  ENSP ID: ENSP00000403769
QAPMSSAMLLVAVPFFEPVFGEGGIFGPWSVSALSTRLECSGTIMAHCSLSLLGSSNPPASTSPVAGTTGAHQHTWLIFIFFVETEFCHVAQADLKLLSSSHLSASASRSAGITGLSHHTWPVIS

SEQ ID NO: 81412 - protein, 350 aa, Homo sapiens
  Payload ID: 16228
  Gene Symbol: SLC35E4
  Gene Name: solute carrier family 35, member E4
  Uniprot ID: Q6ICL7
  ENSP ID: ENSP00000339626
MCRCPPEHHDGRMTSAEVGAAAGGAQAAGPPEWPPGSPQALRQPGRARVAMAALVWLLAGASMSSLNKWIFTVHGFGRPLLLSALHMLVAALACHRGARRPMPGGTRCRVLLLSLTFGTSMACGNVGLRAVPLDLAQLVTTTTPLFTLALSALLLGRRHHPLQLAAMGPLCLGAACSLAGEFRTPPTGCGFLLAATCLRGLKSVQQSALLQEERLDAVTLLYATSLPSFCLLAGAALVLEAGVAPPPTAGDSRLWACILLSCLLSVLYNLASFSLLALTSALTVHVLGNLTVVGNLILSRLLFGSRLSALSYVGIALTLSGMFLYHNCEFVASWAARRGLWRRDQPSKGL

SEQ ID NO: 81413 - protein, 234 aa, Homo sapiens
  Payload ID: 16228
  Gene Symbol: SLC35E4
  Gene Name: solute carrier family 35, member E4
  Uniprot ID: Q6ICL7
  ENSP ID: ENSP00000384377
MCRCPPEHHDGRMTSAEVGAAAGGAQAAGPPEWPPGSPQALRQPGRARVAMAALVWLLAGASMSSLNKWIFTVHGFGRPLLLSALHMLVAALACHRGARRPMPGGTRCRVLLLSLTFGTSMACGNVGLRAVPLDLAQLVTTTTPLFTLALSALLLGRRHHPLQLAAMGPLCLGAACSLAGEFRTPPTGCGFLLAATCLRGLKSVQQSLSFQICKMELMIPMERVRMRSAGQGQE

SEQ ID NO: 81414 - protein, 203 aa, Homo sapiens
  Payload ID: 16228
  Gene Symbol: SLC35E4
  Gene Name: solute carrier family 35, member E4
  ENSP ID: ENSP00000413552
AQAAGPPEWPPGSPQALRQPGRARVAMAALVWLLAGASMSSLNKWIFTVHGFGRPLLLSALHMLVAALACHRGARRPMPGGTRCRVLLLSLTFGTSMACGNVGLRAVPLDLAQLVTTTTPLFTLALSALLLGRRHHPLQLAAMGPLCLGAACSLAGEFRTPPTGCGFLLAATCLRGLKSVQQNPDLVHSAEDCRSLRSLKIST

SEQ ID NO: 81415 - protein, 408 aa, Homo sapiens
  Payload ID: 16229
  Gene Symbol: SLC35F1
  Gene Name: solute carrier family 35, member F1
  Uniprot ID: Q5T1Q4
  ENSP ID: ENSP00000353557
MIPPEQPQQQLQPPSPAPPNHVVTTIENLPAEGSGGGGSLSASSRAGVRQRIRKVLNREMLISVALGQVLSLLICGIGLTSKYLSEDFHANTPVFQSFLNYILLFLVYTTTLAVRQGEENLLAILRRRWWKYMILGLIDLEANYLVVKAYQYTTLTSIQLLDCFVIPVVILLSWFFLLIRYKAVHFIGIVVCILGMGCMVGADVLVGRHQGAGENKLVGDLLVLGGATLYGISNVWEEYIIRTLSRVEFLGMIGLFGAFFSGIQLAIMEHKELLKVPWDWQIGLLYVGFSACMFGLYSFMPVVIKKTSATSVNLSLLTADLYSLFCGLFLFHYKFSGLYLLSFFTILIGLVLYSSTSTYIAQDPRVYKQFRNPSGPVVDLPTTAQVEPSVTYTSLGQETEEEPHVRVA

SEQ ID NO: 81416 - protein, 349 aa, Homo sapiens
  Payload ID: 16229
  Gene Symbol: SLC35F1
  Gene Name: solute carrier family 35, member F1
  Uniprot ID: Q5T1Q4
  ENSP ID: ENSP00000484738
MLISVALGQVLSLLICGIGLTSKYLSEDFHANTPVFQSFLNYILLFLVYTTTLAVRQGEENLLAILRRRWWKYMILGLIDLEANYLVVKAYQYTTLTSIQLLDCFVIPVVILLSWFFLLIRYKAVHFIGIVVCILGMGCMVGADVLVGRHQGAGENKLVGDLLVLGGATLYGISNVWEEYIIRTLSRVEFLGMIGLFGAFFSGIQLAIMEHKELLKVPWDWQIGLLYVGFSACMFGLYSFMPVVIKKTSATSVNLSLLTADLYSLFCGLFLFHYKFSGLYLLSFFTILIGLVLYSSTSTYIAQDPRVYKQFRNPSGPVVDLPTTAQVEPSVTYTSLGQETEEEPHVRVA

SEQ ID NO: 81417 - protein, 327 aa, Homo sapiens
  Payload ID: 16230
  Gene Symbol: SLC35F2
  Gene Name: solute carrier family 35, member F2
  Uniprot ID: Q8IXU6
  ENSP ID: ENSP00000364834
MLSLCICGTAITSQYLAERYKVNTPMLQSFINYCLLFLIYTVMLAFRSGSDNLLVILKRKWWKYILLGLADVEANYVIVRAYQYTTLTSVQLLDCFGIPVLMALSWFILHARYRVIHFIAVAVCLLGVGTMVGADILAGREDNSGSDVLIGDILVLLGASLYAISNVCEEYIVKKLSRQEFLGMVGLFGTIISGIQLLIVEYKDIASIHWDWKIALLFVAFALCMFCLYSFMPLVIKVTSATSVNLGILTADLYSLFVGLFLFGYKFSGLYILSFTVIMVGFILYCSTPTRTAEPAESSVPPVTSIGIDNLGLKLEENLQETHSAVL

SEQ ID NO: 81418 - protein, 36 aa, Homo sapiens
  Payload ID: 16230
  Gene Symbol: SLC35F2
  Gene Name: solute carrier family 35, member F2
  ENSP ID: ENSP00000433461
MEADSPAGPGAPEPLAEGAAAEFSSLLRRIKGKLFT

SEQ ID NO: 81419 - protein, 265 aa, Homo sapiens
  Payload ID: 16230
  Gene Symbol: SLC35F2
  Gene Name: solute carrier family 35, member F2
  ENSP ID: ENSP00000433783
MEADSPAGPGAPEPLAEGAAAEFSSLLRRIKGKLFTWNILKTIALGQMLSLCICGTAITSQYLAERYKVNTPMLQSFINYCLLFLIYTVMLAFRSGSDNLLVILKRKWWKYILLGLADVEANYVIVRAYQYTTLTSVQLLDCFGIPVLMALSWFILHARYRVIHFIAVAVCLLGVGTMVGADILAGREDNSGSDVLIGDILVLLGASLYAISNVCEEYIVKKLSRQEFLGMVGLFGTIISGIQLPAVRGICPVYVLPVQLHAIGD

SEQ ID NO: 81420 - protein, 38 aa, Homo sapiens
  Payload ID: 16230
  Gene Symbol: SLC35F2
  Gene Name: solute carrier family 35, member F2
  ENSP ID: ENSP00000434076
MEADSPAGPGAPEPLAEGAAAEFSSLLRRIKGKLFTWQ

SEQ ID NO: 81421 - protein, 357 aa, Homo sapiens
  Payload ID: 16230
  Gene Symbol: SLC35F2
  Gene Name: solute carrier family 35, member F2
  Uniprot ID: Q8IXU6
  ENSP ID: ENSP00000434307
MEADSPAGPGAPEPLAEGAAAEFSSLLRRIKGKLFTWNILKTIALGQMLSLCICGTAITSQYLAERYKVNTPMLQSFINYCLLFLIYTVMLAFRSGSDNLLVILKRKWWKYILLGLADVEANYVIVRAYQYTTLTSVQLLDCFGIPVLMALSWFILHARYRVIHFIAVAVCLLGVGTMVGADILAGREDNSGSDVLIGDILVLLGASLYAISNVCEEYIVKKLSRQEFLGMVGLFGTIISGIQLLIVEYKDIASIHWDWKIALLFVAFALCMFCLYSFMPLVIKVTSATSVNLGILTADLYSLFVGLFLFGYKDSTSCPSLSSWWGLSCTAPPLLARPSRLKAACLQSPALGLTTWG

SEQ ID NO: 81422 - protein, 374 aa, Homo sapiens
  Payload ID: 16230
  Gene Symbol: SLC35F2
  Gene Name: solute carrier family 35, member F2
  Uniprot ID: Q8IXU6
  ENSP ID: ENSP00000436785
MEADSPAGPGAPEPLAEGAAAEFSSLLRRIKGKLFTWNILKTIALGQMLSLCICGTAITSQYLAERYKVNTPMLQSFINYCLLFLIYTVMLAFRSGSDNLLVILKRKWWKYILLGLADVEANYVIVRAYQYTTLTSVQLLDCFGIPVLMALSWFILHARYRVIHFIAVAVCLLGVGTMVGADILAGREDNSGSDVLIGDILVLLGASLYAISNVCEEYIVKKLSRQEFLGMVGLFGTIISGIQLLIVEYKDIASIHWDWKIALLFVAFALCMFCLYSFMPLVIKVTSATSVNLGILTADLYSLFVGLFLFGYKFSGLYILSFTVIMVGFILYCSTPTRTAEPAESSVPPVTSIGIDNLGLKLEENLQETHSAVL

SEQ ID NO: 81423 - protein, 421 aa, Homo sapiens
  Payload ID: 16231
  Gene Symbol: SLC35F3
  Gene Name: solute carrier family 35, member F3
  Uniprot ID: Q8IY50
  ENSP ID: ENSP00000355576
MKKHSARVAPLSACNSPVLTLTKVEGEERPRDSPGPAEAQAPAGVEAGGRASRRCWTCSRAQLKKIFWGVAVVLCVCSSWAGSTQLAKLTFRKFDAPFTLTWFATNWNFLFFPLYYVGHVCKSTEKQSVKQRYRECCRFFGDNGLTLKVFFTKAAPFGVLWTLTNYLYLHAIKKINTTDVSVLFCCNKAFVFLLSWIVLRDRFMGVRIVAAILAIAGIVMMTYADGFHSHSVIGIALVVASASMSALYKVLFKLLLGSAKFGEAALFLSILGVFNILFITCIPIILYFTKVEYWSSFDDIPWGNLCGFSVLLLTFNIVLNFGIAVTYPTLMSLGIVLSIPVNAVIDHYTSQIVFNGVRVIAIIIIGLGFLLLLLPEEWDVWLIKLLTRLKVRKKEEPAEGAADLSSGPQSKNRRARPSFAR

SEQ ID NO: 81424 - protein, 490 aa, Homo sapiens
  Payload ID: 16231
  Gene Symbol: SLC35F3
  Gene Name: solute carrier family 35, member F3
  Uniprot ID: Q8IY50
  ENSP ID: ENSP00000355577
MGIREFPSGAPRGKSIAVGMRRSPDVSPRRLSDISPQLRQLKYLVVDEAIKEDLKWSRSVEDLTSGPVGLTSIEERILRITGYYGYQPWAASCKREERPRDSPGPAEAQAPAGVEAGGRASRRCWTCSRAQLKKIFWGVAVVLCVCSSWAGSTQLAKLTFRKFDAPFTLTWFATNWNFLFFPLYYVGHVCKSTEKQSVKQRYRECCRFFGDNGLTLKVFFTKAAPFGVLWTLTNYLYLHAIKKINTTDVSVLFCCNKAFVFLLSWIVLRDRFMGVRIVAAILAIAGIVMMTYADGFHSHSVIGIALVVASASMSALYKVLFKLLLGSAKFGEAALFLSILGVFNILFITCIPIILYFTKVEYWSSFDDIPWGNLCGFSVLLLTFNIVLNFGIAVTYPTLMSLGIVLSIPVNAVIDHYTSQIVFNGVRVIAIIIIGLGFLLLLLPEEWDVWLIKLLTRLKVRKKEEPAEGAADLSSGPQSKNRRARPSFAR

SEQ ID NO: 81425 - protein, 521 aa, Homo sapiens
  Payload ID: 16232
  Gene Symbol: SLC35F4
  Gene Name: solute carrier family 35, member F4
  Uniprot ID: A4IF30
  ENSP ID: ENSP00000342518
MDELLLDLFHKLTSGRQLAAGNGLCGISHKEQEVWKPGHNILVKMRKEDKSLVWLIHSTLARYTQVTNFLGTSRSSVTRCKPGANCPSSHSGISRQLSPLSVTEDSSAPILELQNQGSSGVCGHRVERQNRSADDGTQTHSENSSQENRIKARCLSCTSMVLKGIWGLLIILSVSSSWVGTTQIVKITYKNFYCPFFMTWFSTNWNIMFFPVYYSGHLATAQEKQSPMKKFRECSRIFGEDGLTLKLFLKRTAPFSILWTLTNYLYLLALKKLTATDVSALFCCNKAFVFLLSWIVLKDRFMGVRIVAAIMAITGIVMMAYADNFHADSIIGVAFAVGSASTSALYKVLFKMFLGSANFGEAAHFVSTLGFFNLIFISFTPVILYFTKVEHWSSFAALPWGCLCGMAGLWLAFNILVNVGVVLTYPILISIGTVLSVPGNAAVDLLKQEVIFNVVRLAATIIICIGFLLMLLPEEWDEITLRFINSLKEKKSEEHVDDVTDPSIHLRGRGRANGTVSIPLA

SEQ ID NO: 81426 - protein, 151 aa, Homo sapiens
  Payload ID: 16232
  Gene Symbol: SLC35F4
  Gene Name: solute carrier family 35, member F4
  ENSP ID: ENSP00000450836
MVLKGIWGLLIILSVSSSWVGTTQIVKITYKNFYCPFFMTWFSTNWNIMFFPVYYSGHLATAQEKQSPMKKFRECSRIFGEDGLTLKLFLKRTAPFSILWTLTNYLYLLALKKLTATDVSALFCCNKAFVFLLSWIVLKDRFMGVRIAGKP

SEQ ID NO: 81427 - protein, 362 aa, Homo sapiens
  Payload ID: 16232
  Gene Symbol: SLC35F4
  Gene Name: solute carrier family 35, member F4
  Uniprot ID: A4IF30
  ENSP ID: ENSP00000451990
MVLKGIWGLLIILSVSSSWVGTTQIVKITYKNFYCPFFMTWFSTNWNIMFFPVYYSGHLATAQEKQSPMKKFRECSRIFGEDGLTLKLFLKRTAPFSILWTLTNYLYLLALKKLTATDVSALFCCNKAFVFLLSWIVLKDRFMGVRIVAAIMAITGIVMMAYADNFHADSIIGVAFAVGSASTSALYKVLFKMFLGSANFGEAAHFVSTLGFFNLIFISFTPVILYFTKVEHWSSFAALPWGCLCGMAGLWLAFNILVNVGVVLTYPILISIGTVLSVPGNAAVDLLKQEVIFNVVRLAATIIICIGFLLMLLPEEWDEITLRFINSLKEKKSEEHVDDVTDPSIHLRGRGRANGTVSIPLA

SEQ ID NO: 81428 - protein, 485 aa, Homo sapiens
  Payload ID: 16232
  Gene Symbol: SLC35F4
  Gene Name: solute carrier family 35, member F4
  ENSP ID: ENSP00000452086
MDVKAAPNGVATIEDRILRITGYYGYYPGYSSQKSTSRSSVTRCKPGANCPSSHSGISRQLSPLSVTEDSSAPILELQNQGSSGVCGHRVERQNRSADDGTQTHSENSSQENRIKARCLSCTSMVLKGIWGLLIILSVSSSWVGTTQIVKITYKNFYCPFFMTWFSTNWNIMFFPVYYSGHLATAQEKQSPMKKFRECSRIFGEDGLTLKLFLKRTAPFSILWTLTNYLYLLALKKLTATDVSALFCCNKAFVFLLSWIVLKDRFMGVRIVAAIMAITGIVMMAYADNFHADSIIGVAFAVGSASTSALYKVLFKMFLGSANFGEAAHFVSTLGFFNLIFISFTPVILYFTKVEHWSSFAALPWGCLCGMAGLWLAFNILVNVGVVLTYPILISIGTVLSVPGNAAVDLLKQEVIFNVVRLAATIIICIGFLLMLLPEEWDEITLRFINSLKEKKSEEHVDDVTDPSIHLRGRGRANGTVSIPLA

SEQ ID NO: 81429 - protein, 46 aa, Homo sapiens
  Payload ID: 16232
  Gene Symbol: SLC35F4
  Gene Name: solute carrier family 35, member F4
  ENSP ID: ENSP00000452196
  MOD_RES (1)..(1): Any amino acid
XYLLALKKLTATDVSALFCCNKAFVFLLSWIVLKDRFMGVRIAGKP

SEQ ID NO: 81430 - protein, 523 aa, Homo sapiens
  Payload ID: 16233
  Gene Symbol: SLC35F5
  Gene Name: solute carrier family 35, member F5
  Uniprot ID: Q8WV83
  ENSP ID: ENSP00000245680
MVPPRRHRGAGRPGVLSSSPPFRLRSAKFSGIALEDLRRALKTRLQMVCVFVMNRMNSQNSGFTQRRRMALGIVILLLVDVIWVASSELTSYVFTQYNKPFFSTFAKTSMFVLYLLGFIIWKPWRQQCTRGLRGKHAAFFADAEGYFAACTTDTTMNSSLSEPLYVPVKFHDLPSEKPESTNIDTEKTPKKSRVRFSNIMEIRQLPSSHALEAKLSRMSYPVKEQESILKTVGKLTATQVAKISFFFCFVWFLANLSYQEALSDTQVAIVNILSSTSGLFTLILAAVFPSNSGDRFTLSKLLAVILSIGGVVLVNLAGSEKPAGRDTVGSIWSLAGAMLYAVYIVMIKRKVDREDKLDIPMFFGFVGLFNLLLLWPGFFLLHYTGFEDFEFPNKVVLMCIIINGLIGTVLSEFLWLWGCFLTSSLIGTLALSLTIPLSIIADMCMQKVQFSWLFFAGAIPVFFSFFIVTLLCHYNNWDPVMVGIRRIFAFICRKHRIQRVPEDSEQCESLISMHSVSQEDGAS

SEQ ID NO: 81431 - protein, 517 aa, Homo sapiens
  Payload ID: 16233
  Gene Symbol: SLC35F5
  Gene Name: solute carrier family 35, member F5
  ENSP ID: ENSP00000386754
MDSSGWRGVLSSSPPFRLRSAKFSGIALEDLRRALKTRLQMVCVFVMNRMNSQNSGFTQRRRMALGIVILLLVDVIWVASSELTSYVFTQYNKPFFSTFAKTSMFVLYLLGFIIWKPWRQQCTRGLRGKHAAFFADAEGYFAACTTDTTMNSSLSEPLYVPVKFHDLPSEKPESTNIDTEKTPKKSRVRFSNIMEIRQLPSSHALEAKLSRMSYPVKEQESILKTVGKLTATQVAKISFFFCFVWFLANLSYQEALSDTQVAIVNILSSTSGLFTLILAAVFPSNSGDRFTLSKLLAVILSIGGVVLVNLAGSEKPAGRDTVGSIWSLAGAMLYAVYIVMIKRKVDREDKLDIPMFFGFVGLFNLLLLWPGFFLLHYTGFEDFEFPNKVVLMCIIINGLIGTVLSEFLWLWGCFLTSSLIGTLALSLTIPLSIIADMCMQKVQFSWLFFAGAIPVFFSFFIVTLLCHYNNWDPVMVGIRRIFAFICRKHRIQRVPEDSEQCESLISMHSVSQEDGAS

SEQ ID NO: 81432 - protein, 248 aa, Homo sapiens
  Payload ID: 16233
  Gene Symbol: SLC35F5
  Gene Name: solute carrier family 35, member F5
  ENSP ID: ENSP00000386991
MDSSGWRGVLSSSPPFRLRSAKFSGIALEDLRRALKTRLQMVCVFVMNRMNSQNSGFTQRRRMALGIVILLLVDVIWVASSELTSYVFTQYNKPFFSTFAKTSMFVLYLLGFIIWKPWRQQCTRGLRGKHAAFFADAEGYFAACTTDTTMNSSLSEPLYVPVKFHDLPSEKPESTNIDTEKTPKKSRVRFSNIMEIRQLPSSHALEAKLSRMSYPVKEQESILKTVGKLTATQVAKISFFFCFVVGLL

SEQ ID NO: 81433 - protein, 242 aa, Homo sapiens
  Payload ID: 16233
  Gene Symbol: SLC35F5
  Gene Name: solute carrier family 35, member F5
  ENSP ID: ENSP00000396456
  MOD_RES (1)..(1): Any amino acid
XFLANLSYQEALSDTQVAIVNILSSTSGLFTLILAAVFPSNSGDRFTLSKLLAVILRLDKEGNGYKILNFIGGVVLVNLAGSEKPAGRDTVGSIWSLAGAMLYAVYIVMIKRKVDREDKLDIPMFFGFVGLFNLLLLWPGFFLLHYTGFEDFEFPNKVVLMCIIINGLIGTVLSEFLWLWGCFLTSSLIGTLALSLTIPLSIIADMCMQKVQFSWLFFAGAIPVFFSFFIVTLLCHYNNWDP

SEQ ID NO: 81434 - protein, 38 aa, Homo sapiens
  Payload ID: 16233
  Gene Symbol: SLC35F5
  Gene Name: solute carrier family 35, member F5
  ENSP ID: ENSP00000406253
  MOD_RES (1)..(1): Any amino acid
XLLCHYNNWDPVMVGIRRIFAFICRKHRIQSSRRQRTV

SEQ ID NO: 81435 - protein, 371 aa, Homo sapiens
  Payload ID: 16234
  Gene Symbol: SLC35F6
  Gene Name: solute carrier family 35, member F6
  Uniprot ID: Q8N357
  ENSP ID: ENSP00000345528
MAWTKYQLFLAGLMLVTGSINTLSAKWADNFMAEGCGGSKEHSFQHPFLQAVGMFLGEFSCLAAFYLLRCRAAGQSDSSVDPQQPFNPLLFLPPALCDMTGTSLMYVALNMTSASSFQMLRGAVIIFTGLFSVAFLGRRLVLSQWLGILATIAGLVVVGLADLLSKHDSQHKLSEVITGDLLIIMAQIIVAIQMVLEEKFVYKHNVHPLRAVGTEGLFGFVILSLLLVPMYYIPAGSFSGNPRGTLEDALDAFCQVGQQPLIAVALLGNISSIAFFNFAGISVTKELSATTRMVLDSLRTVVIWALSLALGWEAFHALQILGFLILLIGTALYNGLHRPLLGRLSRGRPLAEESEQERLLGGTRTPINDAS

SEQ ID NO: 81436 - protein, 51 aa, Homo sapiens
  Payload ID: 16234
  Gene Symbol: SLC35F6
  Gene Name: solute carrier family 35, member F6
  ENSP ID: ENSP00000396256
MAWTKYQLFLAGLMLVTGSINTLSAKWADNFMAEGCGGSKEHSFQHPFLQL

SEQ ID NO: 81437 - protein, 55 aa, Homo sapiens
  Payload ID: 16234
  Gene Symbol: SLC35F6
  Gene Name: solute carrier family 35, member F6
  ENSP ID: ENSP00000397623
MAWTKYQLFLAGLMLVTGSINTLSAKQWACSWENSPAWLPSTSSDAELQGNQTPA

SEQ ID NO: 81438 - protein, 364 aa, Homo sapiens
  Payload ID: 16235
  Gene Symbol: SLC35G1
  Gene Name: solute carrier family 35, member G1
  Uniprot ID: Q2M3R5
  ENSP ID: ENSP00000360462
MRPQDSTGVAELQEPGLPLTDDAPPGATEEPAAAEAAGAPDRGRCWLCLSSPCCSRTEPAKKKAPCPGLGLFYTLLSAFLFSVGSLFVKKVQDVHAVEISAFRCVFQMLVVIPCLIYRKTGFIGPKGQRIFLILRGVLGSTAMMLIYYAYQTMSLADATVITFSSPVFTSIFAWICLKEKYSPWDALFTVFTITGVILIVRPPFLFGSDTSGMEESYSGHLKGTFAAIGSAVFAASTLVILRKMGKSVDYFLSIWYYVVLGLVESVIILSVLGEWSLPYCGLDRLFLIFIGLFGLGGQIFITKALQIEKAGPVAIMKTMDVVFAFIFQIIFFNNVPTWWTVGGALCVVASNVGAAIRKWYQSSK

SEQ ID NO: 81439 - protein, 365 aa, Homo sapiens
  Payload ID: 16235
  Gene Symbol: SLC35G1
  Gene Name: solute carrier family 35, member G1
  Uniprot ID: Q2M3R5
  ENSP ID: ENSP00000400932
MRPQDSTGVAELQEPGLPLTDDAPPGATEEPAAAEAAGAPDRGRCWLCLSSPCCSRTEPEAKKKAPCPGLGLFYTLLSAFLFSVGSLFVKKVQDVHAVEISAFRCVFQMLVVIPCLIYRKTGFIGPKGQRIFLILRGVLGSTAMMLIYYAYQTMSLADATVITFSSPVFTSIFAWICLKEKYSPWDALFTVFTITGVILIVRPPFLFGSDTSGMEESYSGHLKGTFAAIGSAVFAASTLVILRKMGKSVDYFLSIWYYVVLGLVESVIILSVLGEWSLPYCGLDRLFLIFIGLFGLGGQIFITKALQIEKAGPVAIMKTMDVVFAFIFQIIFFNNVPTWWTVGGALCVVASNVGAAIRKWYQSSK

SEQ ID NO: 81440 - protein, 46 aa, Homo sapiens
  Payload ID: 16235
  Gene Symbol: SLC35G1
  Gene Name: solute carrier family 35, member G1
  ENSP ID: ENSP00000473766
MRPQDSTGVAELQEPGLPLTDDAPPGATEEPAAAEAAGAPDRATLL

SEQ ID NO: 81441 - protein, 63 aa, Homo sapiens
  Payload ID: 16235
  Gene Symbol: SLC35G1
  Gene Name: solute carrier family 35, member G1
  ENSP ID: ENSP00000473862
MRPQDSTGVAELQEPGLPLTDDAPPGATEEPAAAEAAGAPDRGRCWLCLSSPCCSRTEPATLL

SEQ ID NO: 81442 - protein, 63 aa, Homo sapiens; identical to SEQ ID NO: 81441
  Payload ID: 16235
  Gene Symbol: SLC35G1
  Gene Name: solute carrier family 35, member G1
  ENSP ID: ENSP00000474294

SEQ ID NO: 81443 - protein, 63 aa, Homo sapiens; identical to SEQ ID NO: 81441
  Payload ID: 16235
  Gene Symbol: SLC35G1
  Gene Name: solute carrier family 35, member G1
  ENSP ID: ENSP00000474890

SEQ ID NO: 81444 - protein, 412 aa, Homo sapiens
  Payload ID: 16236
  Gene Symbol: SLC35G2
  Gene Name: solute carrier family 35, member G2
  Uniprot ID: Q8TBE7
  ENSP ID: ENSP00000376794
MDTSPSRKYPVKKRVKIHPNTVMVKYTSHYPQPGDDGYEEINEGYGNFMEENPKKGLLSEMKKKGRAFFGTMDTLPPPTEDPMINEIGQFQSFAEKNIFQSRKMWIVLFGSALAHGCVALITRLVSDRSKVPSLELIFIRSVFQVLSVLVVCYYQEAPFGPSGYRLRLFFYGVCNVISITCAYTSFSIVPPSNGTTMWRATTTVFSAILAFLLVDEKMAYVDMATVVCSILGVCLVMIPNIVDEDNSLLNAWKEAFGYTMTVMAGLTTALSMIVYRSIKEKISMWTALFTFGWTGTIWGISTMFILQEPIIPLDGETWSYLIAICVCSTAAFLGVYYALDKFHPALVSTVQHLEIVVAMVLQLLVLHIFPSIYDVFGGVIIMISVFVLAGYKLYWRNLRKQDYQEILDSPIK

SEQ ID NO: 81445 - protein, 412 aa, Homo sapiens; identical to SEQ ID NO: 81444
  Payload ID: 16236
  Gene Symbol: SLC35G2
  Gene Name: solute carrier family 35, member G2
  Uniprot ID: Q8TBE7
  ENSP ID: ENSP00000400839

SEQ ID NO: 81446 - protein, 338 aa, Homo sapiens
  Payload ID: 16237
  Gene Symbol: SLC35G3
  Gene Name: solute carrier family 35, member G3
  Uniprot ID: Q8N808
  ENSP ID: ENSP00000297307
MAGSHPYFNQPDSTHPSPPSAPPSLRWYQRCQPSDATSGLLVALLGGGLPAGFVGPLSRMAYQASNLPSLELLIWRCLFHLPIALLLKLRGDPLLGTPDIRSRAFFCALLNILSIGCAYSAVQVVPAGNAATVRKGSSTVCSAVLTLCLESQGLSGYDWCGLLGCILGLIIIVGPGLWTLQEGTTGVYTALGYVEAFLGGLALSLRLLVYRSLHFPPCLPTVAFLSGLVGLLGSVPGLFVLQAPVLPSDLLSWSCVGAVGILALVSFTCVGYAVTKAHPALVCAVLHSEVVVALILQYYMLHETVAPSDIVAAGVVLGSIAIITAQNLSCERTGRVEE

SEQ ID NO: 81447 - protein, 338 aa, Homo sapiens
  Payload ID: 16238
  Gene Symbol: SLC35G5
  Gene Name: solute carrier family 35, member G5
  Uniprot ID: Q96KT7
  ENSP ID: ENSP00000371872
MAGSHPYFNLPDSTHPSPPSAPPSLRWHQRCQPSGATNGLLVALLGGGLPAGFVGPLSRMAYQGSNLPSLELLICRCLFHLPIALLLKLRGDPLLGPPDIRGWACFCALLNVLSIGCAYSAVQVVPAGNAATVRKGSSTVCSAVLTLCLESQGLGGYEWCGLLGSILGLIIILGPGLWTLQEGTTGVYTTLGYVQAFLGGLALSLGLLVYRSLHFPSCLPTVAFLSGLVGLLGCVPGLFVLQTPVLPSDLLSWSCVGAEGILALVSFTCVGYAVTKAHPALVCAVLHSEVVVALILQYYMLHETVALSDIMGAGVVLGSIAIITARNLSCERTGKVEE

SEQ ID NO: 81448 - protein, 338 aa, Homo sapiens
  Payload ID: 16239
  Gene Symbol: SLC35G6
  Gene Name: solute carrier family 35, member G6
  Uniprot ID: P0C7Q6
  ENSP ID: ENSP00000396523
MAGSHPYLNPPDSTHPSPPSAPPSLRWHQCCQPSDATNGLLVALLGGGLPAGFVGPLSHMAYQASNLPSLELLICRCLFHLPIALLLKLRGDPLLGPPDIRGRAYFYALLNVLSIGCAYSAVQVVPAGNAATVRKGSSTVCSAVLTLCLESQGLSGYDWCGLLGSILGLIIIVGPGLWTLQEGITGVYTALGYGQAFVGGLALSLGLLVYRSLHFPSCLPTVAFLSGLVGLLGSVPGLFVLQPPVLPSDLPSWSCVGAVGILALVSFTCVSYAVTKAHPALVCAVLHSEVVVALILQYYMLHETVAPSDIVGAGVVLGSIAIITAWNLSCEREGKVEE

SEQ ID NO: 81449 - protein, 476 aa, Homo sapiens
  Payload ID: 16240
  Gene Symbol: SLC36A1
  Gene Name: solute carrier family 36 (proton/amino acid symporter), member 1
  Uniprot ID: Q7Z2H8
  ENSP ID: ENSP00000243389
MSTQRLRNEDYHDYSSTDVSPEESPSEGLNNLSSPGSYQRFGQSNSTTWFQTLIHLLKGNIGTGLLGLPLAVKNAGIVMGPISLLIIGIVAVHCMGILVKCAHHFCRRLNKSFVDYGDTVMYGLESSPCSWLRNHAHWGRRVVDFFLIVTQLGFCCVYFVFLADNFKQVIEAANGTTNNCHNNETVILTPTMDSRLYMLSFLPFLVLLVFIRNLRALSIFSLLANITMLVSLVMIYQFIVQRIPDPSHLPLVAPWKTYPLFFGTAIFSFEGIGMVLPLENKMKDPRKFPLILYLGMVIVTILYISLGCLGYLQFGANIQGSITLNLPNCWLYQSVKLLYSIGIFFTYALQFYVPAEIIIPFFVSRAPEHCELVVDLFVRTVLVCLTCILAILIPRLDLVISLVGSVSSSALALIIPPLLEVTTFYSEGMSPLTIFKDALISILGFVGFVVGTYEALYELIQPSNAPIFINSTCAFI

SEQ ID NO: 81450 - protein, 243 aa, Homo sapiens
  Payload ID: 16240
  Gene Symbol: SLC36A1
  Gene Name: solute carrier family 36 (proton/amino acid symporter), member 1
  Uniprot ID: Q7Z2H8
  ENSP ID: ENSP00000395640
MSTQRLRNEDYHDYSSTDVSPEESPSEGLNNLSSPGSYQRFGQSNSTTWFQTLIHLLKGNIGTGLLGLPLAVKNAGIVMGPISLLIIGIVAVHCMGILVKCAHHFCRRLNKSFVDYGDTVMYGLESSPCSWLRNHAHWGRRVVDFFLIVTQLGFCCVYFVFLADNFKQVIEAANGTTNNCHNNETVILTPTMDSRLYMLSFLPFLVLLVFIRNLRALSIFSLLANITMLVSLVMIYQFIVQIL

SEQ ID NO: 81451 - protein, 70 aa, Homo sapiens
  Payload ID: 16240
  Gene Symbol: SLC36A1
  Gene Name: solute carrier family 36 (proton/amino acid symporter), member 1
  ENSP ID: ENSP00000427804
MSTQRLRNEDYHDYSSTDVSPEESPSEGLNNLSSPGSYQRFGQSNSTTWFQTLIHLLKGNIGTGLLGLPL

SEQ ID NO: 81452 - protein, 476 aa, Homo sapiens; identical to SEQ ID NO: 81449
  Payload ID: 16240
  Gene Symbol: SLC36A1
  Gene Name: solute carrier family 36 (proton/amino acid symporter), member 1
  Uniprot ID: Q7Z2H8
  ENSP ID: ENSP00000428140

SEQ ID NO: 81453 - protein, 71 aa, Homo sapiens
  Payload ID: 16240
  Gene Symbol: SLC36A1
  Gene Name: solute carrier family 36 (proton/amino acid symporter), member 1
  ENSP ID: ENSP00000428471
MSTQRLRNEDYHDYSSTDVSPEESPSEGLNNLSSPGSYQRFGQSNSTTWFQTLIHLLKGNIGTGLLGLPLA

SEQ ID NO: 81454 - protein, 145 aa, Homo sapiens
  Payload ID: 16240
  Gene Symbol: SLC36A1
  Gene Name: solute carrier family 36 (proton/amino acid symporter), member 1
  ENSP ID: ENSP00000428738
RIPDPSHLPLVAPWKTYPLFFGTAIFSFEGIGMVLPLENKMKDPRKFPLILYLGMVIVTILYISLGCLGYLQFGANIQGSITLNLPNCWLYQSVKLLYSIGIFFTYALQFYVPAEIIIPFFVSRAPEHCELVVDLFVRTVLVCLT

SEQ ID NO: 81455 - protein, 99 aa, Homo sapiens
  Payload ID: 16240
  Gene Symbol: SLC36A1
  Gene Name: solute carrier family 36 (proton/amino acid symporter), member 1
  ENSP ID: ENSP00000429796
MSTQRLRNEDYHDYSSTDVSPEESPSEGLNNLSSPGSYQRFGQSNSTTWFQTLIHLLKGNIGTGLLGLPLAVKNAGIVMGPISLLIIGIVAVHCMGILV

SEQ ID NO: 81456 - protein, 89 aa, Homo sapiens
  Payload ID: 16240
  Gene Symbol: SLC36A1
  Gene Name: solute carrier family 36 (proton/amino acid symporter), member 1
  ENSP ID: ENSP00000430181
  MOD_RES (1)..(1): Any amino acid
XVLPLENKMKDPRKFPLILYLGMVIVTILYISLGCLGYLQFGANIQGSITLNLPNCCPLHSSPPSPATASPHWLPWTAFCLGNSCRAFC

SEQ ID NO: 81457 - protein, 388 aa, Homo sapiens
  Payload ID: 16240
  Gene Symbol: SLC36A1
  Gene Name: solute carrier family 36 (proton/amino acid symporter), member 1
  ENSP ID: ENSP00000430305
MSTQRLRNEDYHDYSSTDVSPEESPSEGLNNLSSPGSYQRFGQSNSTTWFQTLIHLLKGNIGTGLLGLPLAVKNAGIVMGPISLLIIGIVAVHCMGILVKCAHHFCRRLNKSFVDYGDTVMYGLESSPCSWLRNHAHWGRRVVDFFLIVTQLGFCCVYFVFLADNFKQVIEAANGTTNNCHNNETVILTPTMDSRLYMLSFLPFLVLLVFIRNLRALSIFSLLANITMLVSLVMIYQFIVQRIPDPSHLPLVAPWKTYPLFFGTAIFSFEGIGMVLPLENKMKDPRKFPLILYLGMVIVTILYISLGCLGYLQFGANIQGSITLNLPNCWLYQSVKLLYSIGIFFTYALQFYVPAEIIIPFFVSRAPEHCELVVDLFVRTVLVCLTCE

SEQ ID NO: 81458 - protein, 386 aa, Homo sapiens
  Payload ID: 16240
  Gene Symbol: SLC36A1
  Gene Name: solute carrier family 36 (proton/amino acid symporter), member 1
  Uniprot ID: Q7Z2H8
  ENSP ID: ENSP00000480948
MSTQRLRNEDYHDYSSTDVSPEESPSEGLNNLSSPGSYQRFGQSNSTTWFQTLIHLLKGNIGTGLLGLPLAVKNAGIVMGPISLLIIGIVAVHCMGILVKCAHHFCRRLNKSFVDYGDTVMYGLESSPCSWLRNHAHWGRRVVDFFLIVTQLGFCCVYFVFLADNFKQVIEAANGTTNNCHNNETVILTPTMDSRLYMLSFLPFLVLLVFIRNLRALSIFSLLANITMLVSLVMIYQFIVQRIPDPSHLPLVAPWKTYPLFFGTAIFSFEGIGMVLPLENKMKDPRKFPLILYLGMVIVTILYISLGCLGYLQFGANIQGSITLNLPNCWLYQSVKLLYSIGIFFTYALQFYVPAEIIIPFFVSRAPEHCELVVDLFVRTVLVCLT

SEQ ID NO: 81459 - protein, 483 aa, Homo sapiens
  Payload ID: 16241
  Gene Symbol: SLC36A2
  Gene Name: solute carrier family 36 (proton/amino acid symporter), member 2
  Uniprot ID: Q495M3
  ENSP ID: ENSP00000334223
MSVTKSTEGPQGAVAIKLDLMSPPESAKKLENKDSTFLDESPSESAGLKKTKGITVFQALIHLVKGNMGTGILGLPLAVKNAGILMGPLSLLVMGFIACHCMHILVKCAQRFCKRLNKPFMDYGDTVMHGLEANPNAWLQNHAHWGRHIVSFFLIITQLGFCCVYIVFLADNLKQVVEAVNSTTNNCYSNETVILTPTMDSRLYMLSFLPFLVLLVLIRNLRILTIFSMLANISMLVSLVIIIQYITQEIPDPSRLPLVASWKTYPLFFGTAIFSFESIGVVLPLENKMKNARHFPAILSLGMSIVTSLYIGMAALGYLRFGDDIKASISLNLPNCWLYQSVKLLYIAGILCTYALQFYVPAEIIIPFAISRVSTRWALPLDLSIRLVMVCLTCLLAILIPRLDLVISLVGSVSGTALALIIPPLLEVTTFYSEGMSPLTIFKDALISILGFVGFVVGTYQALDELLKSEDSHPFSNSTTFVR

SEQ ID NO: 81460 - protein, 147 aa, Homo sapiens
  Payload ID: 16241
  Gene Symbol: SLC36A2
  Gene Name: solute carrier family 36 (proton/amino acid symporter), member 2
  ENSP ID: ENSP00000428453
MSVTKSTEGPQGAVAIKLDLMSPPESAKKLENKDSTFLDESPSESAGLKKTKGITVFQALIHLVKGNMGTGILGLPLAVKNAGILMGPLSLLVMGFIACHCMHILVKCAQRFCKRLNKPFMDYGDTVMHGLEANPNAWLQNHAHWGR

SEQ ID NO: 81461 - protein, 107 aa, Homo sapiens
  Payload ID: 16241
  Gene Symbol: SLC36A2
  Gene Name: solute carrier family 36 (proton/amino acid symporter), member 2
  ENSP ID: ENSP00000428634
  MOD_RES (1)..(1): Any amino acid
XEIPDPSRLPLVASWKTYPLFFGTAIFSFESIGVVLPLENKMKNARHFPAILSLGMSIVTSLYIGMAALGYLRFGDDIKASISLNLPNCWYLHGLSGGGDSGMGGNV

SEQ ID NO: 81462 - protein, 147 aa, Homo sapiens; identical to SEQ ID NO: 81460
  Payload ID: 16241
  Gene Symbol: SLC36A2
  Gene Name: solute carrier family 36 (proton/amino acid symporter), member 2
  ENSP ID: ENSP00000430149

SEQ ID NO: 81463 - protein, 395 aa, Homo sapiens
  Payload ID: 16241
  Gene Symbol: SLC36A2
  Gene Name: solute carrier family 36 (proton/amino acid symporter), member 2
  ENSP ID: ENSP00000430535
MSVTKSTEGPQGAVAIKLDLMSPPESAKKLENKDSTFLDESPSESAGLKKTKGITVFQALIHLVKGNMGTGILGLPLAVKNAGILMGPLSLLVMGFIACHCMHILVKCAQRFCKRLNKPFMDYGDTVMHGLEANPNAWLQNHAHWGRHIVSFFLIITQLGFCCVYIVFLADNLKQVVEAVNSTTNNCYSNETVILTPTMDSRLYMLSFLPFLVLLVLIRNLRILTIFSMLANISMLVSLVIIIQYITQEIPDPSRLPLVASWKTYPLFFGTAIFSFESIGVVLPLENKMKNARHFPAILSLGMSIVTSLYIGMAALGYLRFGDDIKASISLNLPNCWLYQSVKLLYIAGILCTYALQFYVPAEIIIPFAISRVSTRWALPLDLSIRLVMVCLTCE

SEQ ID NO: 81464 - protein, 504 aa, Homo sapiens
  Payload ID: 16242
  Gene Symbol: SLC36A4
  Gene Name: solute carrier family 36 (proton/amino acid symporter), member 4
  Uniprot ID: Q6YBV0
  ENSP ID: ENSP00000317382
MEAAATPAAAGAARREELDMDVMRPLINEQNFDGTSDEEHEQELLPVQKHYQLDDQEGISFVQTLMHLLKGNIGTGLLGLPLAIKNAGIVLGPISLVFIGIISVHCMHILVRCSHFLCLRFKKSTLGYSDTVSFAMEVSPWSCLQKQAAWGRSVVDFFLVITQLGFCSVYIVFLAENVKQVHEGFLESKVFISNSTNSSNPCERRSVDLRIYMLCFLPFIILLVFIRELKNLFVLSFLANVSMAVSLVIIYQYVVRNMPDPHNLPIVAGWKKYPLFFGTAVFAFEGIGVVLPLENQMKESKRFPQALNIGMGIVTTLYVTLATLGYMCFHDEIKGSITLNLPQDVWLYQSVKILYSFGIFVTYSIQFYVPAEIIIPGITSKFHTKWKQICEFGIRSFLVSITCAGAILIPRLDIVISFVGAVSSSTLALILPPLVEILTFSKEHYNIWMVLKNISIAFTGVVGFLLGTYITVEEIIYPTPKVVAGTPQSPFLNLNSTCLTSGLK

SEQ ID NO: 81465 - protein, 280 aa, Homo sapiens
  Payload ID: 16242
  Gene Symbol: SLC36A4
  Gene Name: solute carrier family 36 (proton/amino acid symporter), member 4
  ENSP ID: ENSP00000432061
MHILVRCSHFLCLRFKKSTLGYSDTVSFAMEVSPWSCLQKQAAWGRSVVDFFLVITQLGFCSVYIVFLAENVKQVHEGFLESKVFISNSTNSSNPCERRSVDLRIYMLCFLPFIILLVFIRELKNLFVLSFLANVSMAVSLVIIYQYVVRNMPDPHNLPIVAGWKKYPLFFGTAVFAFEGIGVVLPLENQMKESKRFPQALNIGMGIVTTLYVTLATLGYMCFHDEIKGSITLNLPQDVWLYQSVKILYSFGIFVTYSIQFYVPAEIIIPGITSKFHTKW

SEQ ID NO: 81466 - protein, 111 aa, Homo sapiens
  Payload ID: 16242
  Gene Symbol: SLC36A4
  Gene Name: solute carrier family 36 (proton/amino acid symporter), member 4
  ENSP ID: ENSP00000434879
MEAAATPAAAGAARREELDMDVMRPLINEQNFDGTSDEEHEQELLPVQKHYQLDDQEGISFVQTLMHLLKGNIGTGLLGLPLAIKNAGIVLGPISLVFIGIISVHCMHILV

SEQ ID NO: 81467 - protein, 369 aa, Homo sapiens
  Payload ID: 16242
  Gene Symbol: SLC36A4
  Gene Name: solute carrier family 36 (proton/amino acid symporter), member 4
  Uniprot ID: Q6YBV0
  ENSP ID: ENSP00000436570
MEVSPWSCLQKQAAWGRSVVDFFLVITQLGFCSVYIVFLAENVKQVHEGFLESKVFISNSTNSSNPCERRSVDLRIYMLCFLPFIILLVFIRELKNLFVLSFLANVSMAVSLVIIYQYVVRNMPDPHNLPIVAGWKKYPLFFGTAVFAFEGIGVVLPLENQMKESKRFPQALNIGMGIVTTLYVTLATLGYMCFHDEIKGSITLNLPQDVWLYQSVKILYSFGIFVTYSIQFYVPAEIIIPGITSKFHTKWKQICEFGIRSFLVSITCAGAILIPRLDIVISFVGAVSSSTLALILPPLVEILTFSKEHYNIWMVLKNISIAFTGVVGFLLGTYITVEEIIYPTPKVVAGTPQSPFLNLNSTCLTSGLK

SEQ ID NO: 81468 - protein, 470 aa, Homo sapiens
  Payload ID: 16243
  Gene Symbol: SLC36A3
  Gene Name: solute carrier family 36, member 3
  Uniprot ID: Q495N2
  ENSP ID: ENSP00000334750
MSLLGRDYNSELNSLDNGPQSPSESSSSITSENVHPAGEAGLSMMQTLIHLLKCNIGTGLLGLPLAIKNAGLLVGPVSLLAIGVLTVHCMVILLNCAQHLSQRLQKTFVNYGEATMYGLETCPNTWLRAHAVWGRYTVSFLLVITQLGFCSVYFMFMADNLQQMVEKAHVTSNICQPREILTLTPILDIRFYMLIILPFLILLVFIQNLKVLSVFSTLANITTLGSMALIFEYIMEGIPYPSNLPLMANWKTFLLFFGTAIFTFEGVGMVLPLKNQMKHPQQFSFVLYLGMSIVIILYILLGTLGYMKFGSDTQASITLNLPNCWLYQSVKLMYSIGIFFTYALQFHVPAEIIIPFAISQVSESWALFVDLSVRSALVCLTCVSAILIPRLDLVISLVGSVSSSALALIIPALLEIVIFYSEDMSCVTIAKDIMISIVGLLGCIFGTYQALYELPQPISHSMANSTGVHA

SEQ ID NO: 81469 - protein, 511 aa, Homo sapiens
  Payload ID: 16243
  Gene Symbol: SLC36A3
  Gene Name: solute carrier family 36, member 3
  Uniprot ID: Q495N2
  ENSP ID: ENSP00000366942
MSLLGRDYNSELNSLDNGPQSPSESSSSITSENVHPAGEAGLSMMQTLIHLLKCNIGTGLLGLPLAIKNAGLLVGPVSLLAIGVLTVHCMVILLNCAQHLSQRLQKTFVNYGEATMYGLETCPNTWLRAHAVWGRWNLALSPRLECSGKISAHCNPHLQGSSNSPAQASRVAGIYRYTVSFLLVITQLGFCSVYFMFMADNLQQMVEKAHVTSNICQPREILTLTPILDIRFYMLIILPFLILLVFIQNLKVLSVFSTLANITTLGSMALIFEYIMEGIPYPSNLPLMANWKTFLLFFGTAIFTFEGVGMVLPLKNQMKHPQQFSFVLYLGMSIVIILYILLGTLGYMKFGSDTQASITLNLPNCWLYQSVKLMYSIGIFFTYALQFHVPAEIIIPFAISQVSESWALFVDLSVRSALVCLTCVSAILIPRLDLVISLVGSVSSSALALIIPALLEIVIFYSEDMSCVTIAKDIMISIVGLLGCIFGTYQALYELPQPISHSMANSTGVHA

SEQ ID NO: 81470 - protein, 533 aa, Homo sapiens
  Payload ID: 16244
  Gene Symbol: SLC37A1
  Gene Name: solute carrier family 37 (glucose-6-phosphate transporter), member 1
  Uniprot ID: P57057
  ENSP ID: ENSP00000344648
MARLPAGIRFIISFSRDQWYRAFIFILTFLLYASFHLSRKPISIVKGELHKYCTAWDEADVRFSSQNRKSGSAAPHQLPDNETDCGWAPFDKNNYQQLLGALDYSFLCAYAVGMYLSGIIGERLPIRYYLTFGMLASGAFTALFGLGYFYNIHSFGFYVVTQVINGLVQTTGWPSVVTCLGNWFGKGRRGLIMGVWNSHTSVGNILGSLIAGYWVSTCWGLSFVVPGAIVAAMGIVCFLFLIEHPNDVRCSSTLVTHSKGYENGTNRLRLQKQILKSEKNKPLDPEMQCLLLSDGKGSIHPNHVVILPGDGGSGTAAISFTGALKIPGVIEFSLCLLFAKLVSYTFLFWLPLYITNVDHLDAKKAGELSTLFDVGGIFGGILAGVISDRLEKRASTCGLMLLLAAPTLYIFSTVSKMGLEATIAMLLLSGALVSGPYTLITTAVSADLGTHKSLKGNAHALSTVTAIIDGTGSVGAALGPLLAGLLSPSGWSNVFYMLMFADACALLFLIRLIHKELSCPGSATGDQVPFKEQ

SEQ ID NO: 81471 - protein, 533 aa, Homo sapiens; identical to SEQ ID NO: 81470
  Payload ID: 16244
  Gene Symbol: SLC37A1
  Gene Name: solute carrier family 37 (glucose-6-phosphate transporter), member 1
  Uniprot ID: P57057
  ENSP ID: ENSP00000381383

SEQ ID NO: 81472 - protein, 18 aa, Homo sapiens
  Payload ID: 16244
  Gene Symbol: SLC37A1
  Gene Name: solute carrier family 37 (glucose-6-phosphate transporter), member 1
  ENSP ID: ENSP00000381385
MARLPAGIRFIISFSRDQ

SEQ ID NO: 81473 - protein, 18 aa, Homo sapiens
  Payload ID: 16244
  Gene Symbol: SLC37A1
  Gene Name: solute carrier family 37 (glucose-6-phosphate transporter), member 1
  ENSP ID: ENSP00000410129
MARLPAGIRFIISFSRDQ

SEQ ID NO: 81474 - protein, 505 aa, Homo sapiens
  Payload ID: 16245
  Gene Symbol: SLC37A2
  Gene Name: solute carrier family 37 (glucose-6-phosphate transporter), member 2
  Uniprot ID: Q8TED4
  ENSP ID: ENSP00000311833
MRSSLAPGVWFFRAFSRDSWFRGLILLLTFLIYACYHMSRKPISIVKSRLHQNCSEQIKPINDTHSLNDTMWCSWAPFDKDNYKELLGGVDNAFLIAYAIGMFISGVFGERLPLRYYLSAGMLLSGLFTSLFGLGYFWNIHELWYFVVIQVCNGLVQTTGWPSVVTCVGNWFGKGKRGFIMGIWNSHTSVGNILGSLIAGIWVNGQWGLSFIVPGIITAVMGVITFLFLIEHPEDVDCAPPQHHGEPAENQDNPEDPGNSPCSIRESGLETVAKCSKGPCEEPAAISFFGALRIPGVVEFSLCLLFAKLVSYTFLYWLPLYIANVAHFSAKEAGDLSTLFDVGGIIGGIVAGLVSDYTNGRATTCCVMLILAAPMMFLYNYIGQDGIASSIVMLIICGGLVNGPYALITTAVSADLGTHKSLKGNAKALSTVTAIIDGTGSIGAALGPLLAGLISPTGWNNVFYMLISADVLACLLLCRLVYKEILAWKVSLSRGSGSSMVLTHQ

SEQ ID NO: 81475 - protein, 501 aa, Homo sapiens
  Payload ID: 16245
  Gene Symbol: SLC37A2
  Gene Name: solute carrier family 37 (glucose-6-phosphate transporter), member 2
  Uniprot ID: Q8TED4
  ENSP ID: ENSP00000384407
MRSSLAPGVWFFRAFSRDSWFRGLILLLTFLIYACYHMSRKPISIVKSRLHQNCSEQIKPINDTHSLNDTMWCSWAPFDKDNYKELLGGVDNAFLIAYAIGMFISGVFGERLPLRYYLSAGMLLSGLFTSLFGLGYFWNIHELWYFVVIQVCNGLVQTTGWPSVVTCVGNWFGKGKRGFIMGIWNSHTSVGNILGSLIAGIWVNGQWGLSFIVPGIITAVMGVITFLFLIEHPEDVDCAPPQHHGEPAENQDNPEDPGNSPCSIRESGLETVAKCSKGPCEEPAAISFFGALRIPGVVEFSLCLLFAKLVSYTFLYWLPLYIANVAHFSAKEAGDLSTLFDVGGIIGGIVAGLVSDYTNGRATTCCVMLILAAPMMFLYNYIGQDGIASSIVMLIICGGLVNGPYALITTAVSADLGTHKSLKGNAKALSTVTAIIDGTGSIGAALGPLLAGLISPTGWNNVFYMLISADVLACLLLCRLVYKEILAWKVSLSRGSGYKEI

SEQ ID NO: 81476 - protein, 150 aa, Homo sapiens
  Payload ID: 16245
  Gene Symbol: SLC37A2
  Gene Name: solute carrier family 37 (glucose-6-phosphate transporter), member 2
  ENSP ID: ENSP00000432254
MSRKPISIVKSRLHQNCSEQIKPINDTHSLNDTMWCSWAPFDKDNYKELLGGVDNAFLIAYAIGMFISGVFGERLPLRYYLSAGMLLSGLFTSLFGLGYFWNIHELWYFVVIQVCNGLVQTTGWPSVVTCVGNWFGKGKRGFIMGIWNSH

SEQ ID NO: 81477 - protein, 429 aa, Homo sapiens
  Payload ID: 16246
  Gene Symbol: SLC37A4
  Gene Name: solute carrier family 37 (glucose-6-phosphate transporter), member 4
  ENSP ID: ENSP00000475241
MAAQGYGYYRTVIFSAMFGGYSLYYFNRKTFSFVMPSLVEEIPLDKDDLGFITSSQSAAYAISKFVSGVLSDQMSARWLFSSGLLLVGLVNIFFAWSSTVPVFAALWFLNGLAQGLGWPPCGKVLRKWFEPSQFGTWWAILSTSMNLAGGLGPILATILAQSYSWRSTLALSGALWVVVSFLCLLLIHNEPADVGLRNLDPMPSEGKKGSLKEESTLQELLLSPYLWVLSTGYLVVFGVKTCCTDWGQFFLIQEKGQSALVGSSYMSALEVGGLVGSIAAGYLSDRAMAKAGLSNYGNPRHGLLLFMMAGMTVSMYLFRVTVTSDSPKLWILVLGAVFGFSSYGPIALFGVIANESAPPNLCGTSHAIVGLMANVGGFLAGLPFSTIAKHYSWSTAFWVAEVICAASTAAFFLLRNIRTKMGRVSKKAE

SEQ ID NO: 81478 - protein, 356 aa, Homo sapiens
  Payload ID: 16246
  Gene Symbol: SLC37A4
  Gene Name: solute carrier family 37 (glucose-6-phosphate transporter), member 4
  ENSP ID: ENSP00000475991
MSARWLFSSGLLLVGLVNIFFAWSSTVPVFAALWFLNGLAQGLGWPPCGKVLRKWFEPSQFGTWWAILSTSMNLAGGLGPILATILAQSYSWRSTLALSGALWVVVSFLCLLLIHNEPADVGLRNLDPMPSEGKKGSLKEESTLQELLLSPYLWVLSTGYLVVFGVKTCCTDWGQFFLIQEKGQSALVGSSYMSALEVGGLVGSIAAGYLSDRAMAKAGLSNYGNPRHGLLLFMMAGMTVSMYLFRVTVTSDSPKLWILVLGAVFGFSSYGPIALFGVIANESAPPNLCGTSHAIVGLMANVGGFLAGLPFSTIAKHYSWSTAFWVAEVICAASTAAFFLLRNIRTKMGRVSKKAE

SEQ ID NO: 81479 - protein, 451 aa, Homo sapiens
  Payload ID: 16246
  Gene Symbol: SLC37A4
  Gene Name: solute carrier family 37 (glucose-6-phosphate transporter), member 4
  ENSP ID: ENSP00000476176
MAAQGYGYYRTVIFSAMFGGYSLYYFNRKTFSFVMPSLVEEIPLDKDDLGFITSSQSAAYAISKFVSGVLSDQMSARWLFSSGLLLVGLVNIFFAWSSTVPVFAALWFLNGLAQGLGWPPCGKVLRKWFEPSQFGTWWAILSTSMNLAGGLGPILATILAQSYSWRSTLALSGALWVVVSFLCLLLIHNEPADVGLRNLDPMPSEGKKGSLKEESTLQELLLSPYLWVLSTGYLVVFGVKTCCTDWGQFFLIQEKGQSALVGSSYMSALEVGGLVGSIAAGYLSDRAMAKAGLSNYGNPRHGLLLFMMAGMTVSMYLFRVTVTSDSPKDVAFWTLALHPLAELTGFTEHELWILVLGAVFGFSSYGPIALFGVIANESAPPNLCGTSHAIVGLMANVGGFLAGLPFSTIAKHYSWSTAFWVAEVICAASTAAFFLLRNIRTKMGRVSKKAE

SEQ ID NO: 81480 - protein, 429 aa, Homo sapiens; identical to SEQ ID NO: 81477
  Payload ID: 16246
  Gene Symbol: SLC37A4
  Gene Name: solute carrier family 37 (glucose-6-phosphate transporter), member 4
  ENSP ID: ENSP00000476242

SEQ ID NO: 81481 - protein, 494 aa, Homo sapiens
  Payload ID: 16247
  Gene Symbol: SLC37A3
  Gene Name: solute carrier family 37, member 3
  Uniprot ID: Q8NCC5
  ENSP ID: ENSP00000321498
MAWPNVFQRGSLLSQFSHHHVVVFLLTFFSYSLLHASRKTFSNVKVSISEQWTPSAFNTSVELPVEIWSSNHLFPSAEKATLFLGTLDTIFLFSYAVGLFISGIVGDRLNLRWVLSFGMCSSALVVFVFGALTEWLRFYNKWLYCCLWIVNGLLQSTGWPCVVAVMGNWFGKAGRGVVFGLWSACASVGNILGACLASSVLQYGYEYAFLVTASVQFAGGIVIFFGLLVSPEEIGLSGIEAEENFEEDSHRPLINGGENEDEYEPNYSIQDDSSVAQVKAISFYQACCLPGVIPYSLAYACLKLVNYSFFFWLPFYLSNNFGWKEAEADKLSIWYDVGGIIGGTLQGFISDVLQKRAPVLALSLLLAVGSLIGYSRSPNDKSINALLMTVTGFFIGGPSNMISSAISADLGRQELIQRSSEALATVTGIVDGSGSIGAAVGQYLVSLIRDKLGWMWVFYFFILMTSCTIVFISPLIVREIFSLVLRRQAHILRE

SEQ ID NO: 81482 - protein, 443 aa, Homo sapiens
  Payload ID: 16247
  Gene Symbol: SLC37A3
  Gene Name: solute carrier family 37, member 3
  Uniprot ID: Q8NCC5
  ENSP ID: ENSP00000343358
MAWPNVFQRGSLLSQFSHHHVVVFLLTFFSYSLLHASRKTFSNVKVSISEQWTPSAFNTSVELPVEIWSSNHLFPSAEKATLFLGTLDTIFLFSYAVGLFISGIVGDRLNLRWVLSFGMCSSALVVFVFGALTEWLRFYNKWLYCCLWIVNGLLQSTGWPCVVAVMGNWFGKAGRGVVFGLWSACASVGNILGACLASSVLQYGYEYAFLVTASVQFAGGIVIFFGLLVSPEEIGLSGIEAEENFEEDSHRPLINGGENEDEYEPNYSIQDDSSVAQVKAISFYQACCLPGVIPYSLAYACLKLVNYSFFFWLPFYLSNNFGWKEAEADKLSIWYDVGGIIVFSVSDPGQARMDVGFLLFHSHDKLYNCVYLAINSEGNILSRAKETGSHIEGVTGARETERTMSATSGPLGLRVCPNLGLSRSSSLILDCQASLNTASHLRC

SEQ ID NO: 81483 - protein, 478 aa, Homo sapiens
  Payload ID: 16247
  Gene Symbol: SLC37A3
  Gene Name: solute carrier family 37, member 3
  Uniprot ID: Q8NCC5
  ENSP ID: ENSP00000397481
MAWPNVFQRGSLLSQFSHHHVVVFLLTFFSYSLLHASRKTFSNVKVSISEQWTPSAFNTSVELPVEIWSSNHLFPSAEKATLFLGTLDTIFLFSYAVGLFISGIVGDRLNLRWVLSFGMCSSALVVFVFGALTEWLRFYNKWLYCCLWIVNGLLQSTGWPCVVAVMGNWFGKAGRGVVFGLWSACASVGNILGACLASSVLQYGYEYAFLVTASVQFAGGIVIFFGLLVSPEEIGLSGIEAEENFEEDSHRPLINGGENEDEYEPNYSIQDDSSVAQVKAISFYQACCLPGVIPYSLAYACLKLVNYSFFFWLPFYLSNNFGWKEAEADKLSIWYDVGGIIGGTLQGFISDVLQKRAPVLALSLLLAVGSLIGYSRFFIGGPSNMISSAISADLGRQELIQRSSEALATVTGIVDGSGSIGAAVGQYLVSLIRDKLGWMWVFYFFILMTSCTIVFISPLIVREIFSLVLRRQAHILRE

SEQ ID NO: 81484 - protein, 14 aa, Homo sapiens
  Payload ID: 16247
  Gene Symbol: SLC37A3
  Gene Name: solute carrier family 37, member 3
  ENSP ID: ENSP00000417181
MAWPNVFQRGSLLS

SEQ ID NO: 81485 - protein, 224 aa, Homo sapiens
  Payload ID: 16247
  Gene Symbol: SLC37A3
  Gene Name: solute carrier family 37, member 3
  ENSP ID: ENSP00000417365
MAWPNVFQRGSLLSQFSHHHVVVFLLTFFSYSLLHASRKTFSNVKVSISEQWTPSAFNTSVELPVEIWSSNHLFPSAEKATLFLGTLDTIFLFSYAVGLFISGIVGDRLNLRWVLSFGMCSSALVVFVFGALTEWLRFYNKWLYCCLWIVNGLLQSTGWPCVVAVMGNWFGKAGRGVVFGLWSACASVGNILGACLASSVLQYGYEVSRVLRQKKTLKKTHTGH

SEQ ID NO: 81486 - protein, 98 aa, Homo sapiens
  Payload ID: 16247
  Gene Symbol: SLC37A3
  Gene Name: solute carrier family 37, member 3
  ENSP ID: ENSP00000417380
  MOD_RES (1)..(1): Any amino acid
XSAISADLGRQELIQRSSEALATVTGIVDGSGSIGAAVGQETGSHIEGVTGARETERTMSATSGPLGLRVCPNLGLSRSSSLILDCQASLNTASHLRC

SEQ ID NO: 81487 - protein, 81 aa, Homo sapiens
  Payload ID: 16247
  Gene Symbol: SLC37A3
  Gene Name: solute carrier family 37, member 3
  ENSP ID: ENSP00000417447
  MOD_RES (1)..(1): Any amino acid
XYSIQDDSSVAQVKAISFYQACCLPGVIPYLVSLIRDKLGWMWVFYFFILMTSCTIVFISPLIVREIFSLVLRRQAHILRE

SEQ ID NO: 81488 - protein, 150 aa, Homo sapiens
  Payload ID: 16247
  Gene Symbol: SLC37A3
  Gene Name: solute carrier family 37, member 3
  ENSP ID: ENSP00000417449
  MOD_RES (1)..(1): Any amino acid
XFPSAEKATLFLGTLDTIFLFSYAVGLFISGIVGDRLNLRWVLSFGMCSSALVVFVFGALTEWLRFYNKWLYCCLWIVNGLLQSTGWPCVVAVMGNWFGKAGRGVVFGLWSACASVGNILGACLASSVLQYGYEICKDHLSPLSSSMPFW

SEQ ID NO: 81489 - protein, 151 aa, Homo sapiens
  Payload ID: 16247
  Gene Symbol: SLC37A3
  Gene Name: solute carrier family 37, member 3
  ENSP ID: ENSP00000417461
  MOD_RES (1)..(1): Any amino acid
XLLLAVGSLIGYSRSPNDKSINALLMTVTGFFIGGPSNMISSAISADLGRQELIQRSSEALATVTGIVDGSGSIGAAVGQYLVSLIRDKLGWMWVFYFFILMTGSHIEGVTGARETERTMSATSGPLGLRVCPNLGLSRSSSLILDCQASL

SEQ ID NO: 81490 - protein, 122 aa, Homo sapiens
  Payload ID: 16247
  Gene Symbol: SLC37A3
  Gene Name: solute carrier family 37, member 3
  ENSP ID: ENSP00000418136
GWKEAEADKLSIWYDVGGIIVFSVSDPGQARMDVGFLLFHSHDKLYNCVYLAINSEGNILSRAKETGSHIEGVTGARETERTMSATSGPLGLRVCPNLGLSRSSSLILDCQASLNTASHLRC

SEQ ID NO: 81491 - protein, 161 aa, Homo sapiens
  Payload ID: 16247
  Gene Symbol: SLC37A3
  Gene Name: solute carrier family 37, member 3
  ENSP ID: ENSP00000418158
LSLLLAVGSLIGYSRSPNDKSINALLMTVTGFFIGGPSNMISSAISADLGRQELIQRSSEALATVTGIVDGSGSIGAAVGQYLVSLIRDKLGWMWVFYFFILMETGSHIEGVTGARETERTMSATSGPLGLRVCPNLGLSRSSSLILDCQASLNTASHLRC

SEQ ID NO: 81492 - protein, 54 aa, Homo sapiens
  Payload ID: 16247
  Gene Symbol: SLC37A3
  Gene Name: solute carrier family 37, member 3
  ENSP ID: ENSP00000418585
MAWPNVFQRGSLLSQFSHHHVVVFLLTFFRCLSLVRSQNGCVSTTNGCTAACGL

SEQ ID NO: 81493 - protein, 56 aa, Homo sapiens
  Payload ID: 16247
  Gene Symbol: SLC37A3
  Gene Name: solute carrier family 37, member 3
  ENSP ID: ENSP00000418610
QRSSEALATVTGIVDGSGSIGAAVGQTSCTIVFISPLIVREIFSLVLRRQAHILRE

SEQ ID NO: 81494 - protein, 153 aa, Homo sapiens
  Payload ID: 16247
  Gene Symbol: SLC37A3
  Gene Name: solute carrier family 37, member 3
  ENSP ID: ENSP00000419024
MAWPNVFQRGSLLSQFSHHHVVVFLLTFFSYSLLHASRKTFSNVKVSISEQWTPSAFNTSVELPVEIWSSNHLFPSAEKATLFLGTLDTIFLFSYAVGLFISGIVGDRLNLRWVLSFGMCSSALVYAFLVTASVQFAGGIVIFFGLLVSPEEI

SEQ ID NO: 81495 - protein, 193 aa, Homo sapiens
  Payload ID: 16247
  Gene Symbol: SLC37A3
  Gene Name: solute carrier family 37, member 3
  ENSP ID: ENSP00000419285
  MOD_RES (1)..(1): Any amino acid
XIFFGLLVSPEEIGLSGIEAEENFEEDSHRPLINGGENEDEYEPNYSIQDDSSVAQVKAISFYQACCLPGVIPYSLAYACLKLVNYSFFFWLPFYLSNNFGWKEAEADKLSIWYDVGGIIGGTLQGFISDVLQKRAPVLALSLLLAVGSLIGYSLFSVSDPGQARMDVGFLLFHSHDKLYNCVYLAINSEGNI

SEQ ID NO: 81496 - protein, 66 aa, Homo sapiens
  Payload ID: 16247
  Gene Symbol: SLC37A3
  Gene Name: solute carrier family 37, member 3
  ENSP ID: ENSP00000419410
MAWPNVFQRGSLLSQFSHHHVVVFLLTFFSYSLLHASRKTFSNVKVSISEQWTPSAFNTSVELPVE

SEQ ID NO: 81497 - protein, 125 aa, Homo sapiens
  Payload ID: 16247
  Gene Symbol: SLC37A3
  Gene Name: solute carrier family 37, member 3
  ENSP ID: ENSP00000419701
GLFISGIVGDRLNLRWVLSFGMCSSALVVFVFGALTEWLRFYNKWLYCCLWIVNGLLQSTGWPCVVAVMGNWFGKAGRGVVFGLWSACASVGNILGACLASSVLQYGYEICKDHLSPLSSSMPFW

SEQ ID NO: 81498 - protein, 178 aa, Homo sapiens
  Payload ID: 16247
  Gene Symbol: SLC37A3
  Gene Name: solute carrier family 37, member 3
  ENSP ID: ENSP00000420771
  MOD_RES (1)..(1): Any amino acid
XAEKATLFLGTLDTIFLFSYAVGLFISGIVGDRLNLRWVLSFGMCSSALVVFVFGALTEWLRFYNKWLYCCLWIVNGLLQSTGWPCVVAVMGNWFGKAGRGVVFGLWSACASVGNILGACLASSVLQYGYEYSLAYACLKLVNYSFFFWLPFYLSNNFGWKEAEADKLSIWYDVGGII

SEQ ID NO: 81499 - protein, 487 aa, Homo sapiens
  Payload ID: 16248
  Gene Symbol: SLC38A1
  Gene Name: solute carrier family 38, member 1
  Uniprot ID: Q9H2H9
  ENSP ID: ENSP00000381634
MMHFKSGLELTELQNMTVPEDDNISNDSNDFTEVENGQINSKFISDRESRRSLTNSHLEKKKCDEYIPGTTSLGMSVFNLSNAIMGSGILGLAFALANTGILLFLVLLTSVTLLSIYSINLLLICSKETGCMVYEKLGEQVFGTTGKFVIFGATSLQNTGAMLSYLFIVKNELPSAIKFLMGKEETFSAWYVDGRVLVVIVTFGIILPLCLLKNLGYLGYTSGFSLSCMVFFLIVVIYKKFQIPCIVPELNSTISANSTNADTCTPKYVTFNSKTVYALPTIAFAFVCHPSVLPIYSELKDRSQKKMQMVSNISFFAMFVMYFLTAIFGYLTFYDNVQSDLLHKYQSKDDILILTVRLAVIVAVILTVPVLFFTVRSSLFELAKKTKFNLCRHTVVTCILLVVINLLVIFIPSMKDIFGVVGVTSANMLIFILPSSLYLKITDQDGDKGTQRIWAALFLGLGVLFSLVSIPLVIYDWACSSSSDEGH

SEQ ID NO: 81500 - protein, 487 aa, Homo sapiens; identical to SEQ ID NO: 81499
  Payload ID: 16248
  Gene Symbol: SLC38A1
  Gene Name: solute carrier family 38, member 1
  Uniprot ID: Q9H2H9
  ENSP ID: ENSP00000398142

SEQ ID NO: 81501 - protein, 487 aa, Homo sapiens; identical to SEQ ID NO: 81499
  Payload ID: 16248
  Gene Symbol: SLC38A1
  Gene Name: solute carrier family 38, member 1
  Uniprot ID: Q9H2H9
  ENSP ID: ENSP00000447853

SEQ ID NO: 81502 - protein, 487 aa, Homo sapiens; identical to SEQ ID NO: 81499
  Payload ID: 16248
  Gene Symbol: SLC38A1
  Gene Name: solute carrier family 38, member 1
  Uniprot ID: Q9H2H9
  ENSP ID: ENSP00000449607

SEQ ID NO: 81503 - protein, 78 aa, Homo sapiens
  Payload ID: 16248
  Gene Symbol: SLC38A1
  Gene Name: solute carrier family 38, member 1
  ENSP ID: ENSP00000449744
MMHFKSGLELTELQNMTVPEDDNISNDSNDFTEVENGQINSKFISDRESRRSLTNSHLEKKKCDEYIPGTTSLGMSVF

SEQ ID NO: 81504 - protein, 503 aa, Homo sapiens
  Payload ID: 16248
  Gene Symbol: SLC38A1
  Gene Name: solute carrier family 38, member 1
  ENSP ID: ENSP00000449756
MMHFKSGLELTELQNMTVPEDDNISNDSNDFTEVENGQINSKFISDRESRRSLTNSHLEKKKCDEYIPGTTSLGMSVFNLSNAIMGSGILGLAFALANTGILLFLVLLTSVTLLSIYSINLLLICSKETGCMVYEKLGEQVFGTTGKFVIFGATSLQNTGAMLSYLFIVKNELPSAIKFLMGKEETFSAWYVDGRVLVVIVTFGIILPLCLLKNLGYLGYTSGFSLSCMVFFLIVVIYKKFQIPCIVPELNSTISANSTNADTCTPKYVTFNSKTVYALPTIAFAFVCHPSVLPIYSELKDRSQKKMQMVSNISFFAMFVMYFLTAIFGYLTFYDNVQSDLLHKYQSKDDILILTVRLAVIVAVILTVPVLFFTVRSSLFELAKKTKFNLCRHTVVTCILLVVINLLVIFIPSMKDIFGVVGVTSANMLIFILPSSLYLKITDQDGDKGTQRIWLFLFLQFPVQPCWLSECIILLPAALSLNMLKRKELIILCSLDSGFSNLY

SEQ ID NO: 81505 - protein, 503 aa, Homo sapiens; identical to SEQ ID NO: 81504
  Payload ID: 16248
  Gene Symbol: SLC38A1
  Gene Name: solute carrier family 38, member 1
  ENSP ID: ENSP00000478907

SEQ ID NO: 81506 - protein, 780 aa, Homo sapiens
  Payload ID: 16249
  Gene Symbol: SLC38A10
  Gene Name: solute carrier family 38, member 10
  Uniprot ID: Q9HBR0
  ENSP ID: ENSP00000288439
MTAAAASNWGLITNIVNSIVGVSVLTMPFCFKQCGIVLGALLLVFCSWMTHQSCMFLVKSASLSKRRTYAGLAFHAYGKAGKMLVETSMIGLMLGTCIAFYVVIGDLGSNFFARLFGFQVGGTFRMFLLFAVSLCIVLPLSLQRNMMASIQSFSAMALLFYTVFMFVIVLSSLKHGLFSGQWLRRVSYVRWEGVFRCIPIFGMSFACQSQVLPTYDSLDEPSVKTMSSIFASSLNVVTTFYVMVGFFGYVSFTEATAGNVLMHFPSNLVTEMLRVGFMMSVAVGFPMMILPCRQALSTLLCEQQQKDGTFAAGGYMPPLRFKALTLSVVFGTMVGGILIPNVETILGLTGATMGSLICFICPALIYKKIHKNALSSQVVLWVGLGVLVVSTVTTLSVSEEVPEDLAEEAPGGRLGEAEGLMKVEAARLSAQDPVVAVAEDGREKPKLPKEREELEQAQIKGPVDVPGREDGKEAPEEAQLDRPGQGIAVPVGEAHRHEPPVPHDKVVVDEGQDREVPEENKPPSRHAGGKAPGVQGQMAPPLPDSEREKQEPEQGEVGKRPGQAQALEEAGDLPEDPQKVPEADGQPAVQPAKEDLGPGDRGLHPRPQAVLSEQQNGLAVGGGEKAKGGPPPGNAAGDTGQPAEDSDHGGKPPLPAEKPAPGPGLPPEPREQRDVERAGGNQAASQLEGKASALQPPASGPGSGSPLPQPWGDAQVILGSPARPPFSFQPPAEQTPRRAFCSLPISSLLSGNLLSALLPFKHLRHRHMACDYRFISLAPL

SEQ ID NO: 81507 - protein, 1119 aa, Homo sapiens
  Payload ID: 16249
  Gene Symbol: SLC38A10
  Gene Name: solute carrier family 38, member 10
  Uniprot ID: Q9HBR0
  ENSP ID: ENSP00000363891
MTAAAASNWGLITNIVNSIVGVSVLTMPFCFKQCGIVLGALLLVFCSWMTHQSCMFLVKSASLSKRRTYAGLAFHAYGKAGKMLVETSMIGLMLGTCIAFYVVIGDLGSNFFARLFGFQVGGTFRMFLLFAVSLCIVLPLSLQRNMMASIQSFSAMALLFYTVFMFVIVLSSLKHGLFSGQWLRRVSYVRWEGVFRCIPIFGMSFACQSQVLPTYDSLDEPSVKTMSSIFASSLNVVTTFYVMVGFFGYVSFTEATAGNVLMHFPSNLVTEMLRVGFMMSVAVGFPMMILPCRQALSTLLCEQQQKDGTFAAGGYMPPLRFKALTLSVVFGTMVGGILIPNVETILGLTGATMGSLICFICPALIYKKIHKNALSSQVVLWVGLGVLVVSTVTTLSVSEEVPEDLAEEAPGGRLGEAEGLMKVEAARLSAQDPVVAVAEDGREKPKLPKEREELEQAQIKGPVDVPGREDGKEAPEEAQLDRPGQGIAVPVGEAHRHEPPVPHDKVVVDEGQDREVPEENKPPSRHAGGKAPGVQGQMAPPLPDSEREKQEPEQGEVGKRPGQAQALEEAGDLPEDPQKVPEADGQPAVQPAKEDLGPGDRGLHPRPQAVLSEQQNGLAVGGGEKAKGGPPPGNAAGDTGQPAEDSDHGGKPPLPAEKPAPGPGLPPEPREQRDVERAGGNQAASQLEEAGRAEMLDHAVLLQVIKEQQVQQKRLLDQQEKLLAVIEEQHKEIHQQRQEDEEDKPRQVEVHQEPGAAVPRGQEAPEGKARETVENLPPLPLDPVLRAPGGRPAPSQDLNQRSLEHSEGPVGRDPAGPPDGGPDTEPRAAQAKLRDGQKDAAPRAAGTVKELPKGPEQVPVPDPAREAGGPEERLAEEFPGQSQDVTGGSQDRKKPGKEVAATGTSILKEANWLVAGPGAETGDPRMKPKQVSRDLGLAADLPGGAEGAAAQPQAVLRQPELRVISDGEQGGQQGHRLDHGGHLEMRKARGGDHVPVSHEQPRGGEDAAVQEPRQRPEPELGLKRAVPGGQRPDNAKPNRDLKLQAGSDLRRRRRDLGPHAEGQLAPRDGVIIGLNPLPDVQVNDLRGALDAQLRQAAGGALQVVHSRQLRQAPGPPEES

SEQ ID NO: 81508 - protein, 298 aa, Homo sapiens
  Payload ID: 16249
  Gene Symbol: SLC38A10
  Gene Name: solute carrier family 38, member 10
  ENSP ID: ENSP00000437601
GEKAKGGPPPGNAAGDTGQPAEDSDHGGKPPLPAEKPAPGPGLPPEPREQRDVERAGGNQAASQLEAEIKKIVAEAGRAEMLDHAVLLQVIKEQQVQQKRLLDQQEKLLAVIEEQHKEIHQQRQEDEEDKPRQVEVHQEPGAAVPRGQEAPEGKARETVENLPPLPLDPVLRAPGGRPAPSQDLNQRSLEHSEGPVGRDPAGPPDGGPDTEPRAAQAKLRDGQKDAAPRAAGTVKELPKGPEQVPVPDPAREAGGPEERLAEEFPGQSQDVTGGSQDRKKPGKEVAATGTSILKEANW

SEQ ID NO: 81509 - protein, 119 aa, Homo sapiens
  Payload ID: 16249
  Gene Symbol: SLC38A10
  Gene Name: solute carrier family 38, member 10
  ENSP ID: ENSP00000439115
MTHQSCMFLVKSASLSKRRTYAGLAFHAYGKAGKMLVETSMIGLMLGTCIAFYVVIGDLGSNFFARLFGFQVGGTFRMFLLFAVSLCIVLPLSLQRNMMASIQSFSAMALLFYTVFMFV

SEQ ID NO: 81510 - protein, 70 aa, Homo sapiens
  Payload ID: 16249
  Gene Symbol: SLC38A10
  Gene Name: solute carrier family 38, member 10
  ENSP ID: ENSP00000444523
  MOD_RES (1)..(1): Any amino acid
XQRNMMASIQSFSAMALLFYTVFMFVIVLSSLKHGLFSGQWLRRVSYVRWEGVFRCIPIFGMSFACQSAL

SEQ ID NO: 81511 - protein, 258 aa, Homo sapiens
  Payload ID: 16249
  Gene Symbol: SLC38A10
  Gene Name: solute carrier family 38, member 10
  ENSP ID: ENSP00000458273
  MOD_RES (1)..(1): Any amino acid
XEKAKGGPPPGNAAGDTGQPAEDSDHGGKPPLPAEKPAPGPGLPPEPREQRDVERAGGNQAASQLEAGRAEMLDHAVLLQVIKEQQVQQKRLLDQQEKLLAVIEEQHKEIHQQRQEDEEDKPRQVEVHQEPGAAVPRGQEAPEGKARETVENLPPLPLDPVLRAPGGRPAPSQDLNQRSLEHSEGPVGRDPAGPPDGGPDTEPRAAQAKLRDGQKDAAPRAAGTVKELPKGPEQVPVPDPAREAGGPEERLAEEFPGQ

SEQ ID NO: 81512 - protein, 384 aa, Homo sapiens
  Payload ID: 16250
  Gene Symbol: SLC38A11
  Gene Name: solute carrier family 38, member 11
  Uniprot ID: Q08AI6
  ENSP ID: ENSP00000306178
MKQAGFPLGILLLFWVSYVTDFSLVLLIKGGALSGTDTYQSLVNKTFGFPGYLLLSVLQFLYPFIVDPENVFIGRHFIIGLSTVTFTLPLSLYRNIAKLGKVSLISTGLTTLILGIVMARAISLGPHIPKTEDAWVFAKPNAIQAVGVMSFAFICHHNSFLVYSSLEEPTVAKWSRLIHMSIVISVFICIFFATCGYLTFTGFTQGDLFENYCRNDDLVTFGRFCYGVTVILTYPMECFVTREVIANVFFGGNLSSVFHIVVTVMVITVATLVSLLIDCLGIVLELNGVLCATPLIFIIPSACYLKLSEEPRTHSDKIMSCVMLPIGAVVMVFGFVMAITNTQDCTHGQEMFYCFPDNFSLTNTSESHVQQTTQLSTLNISIFQ

SEQ ID NO: 81513 - protein, 406 aa, Homo sapiens
  Payload ID: 16250
  Gene Symbol: SLC38A11
  Gene Name: solute carrier family 38, member 11
  Uniprot ID: Q08AI6
  ENSP ID: ENSP00000386272
MKQAGFPLGILLLFWVSYVTDFSLVLLIKGGALSGTDTYQSLVNKTFGFPGYLLLSVLQFLYPFIAMISYNIIAGDTLSKVFQRIPGVDPENVFIGRHFIIGLSTVTFTLPLSLYRNIAKLGKVSLISTGLTTLILGIVMARAISLGPHIPKTEDAWVFAKPNAIQAVGVMSFAFICHHNSFLVYSSLEEPTVAKWSRLIHMSIVISVFICIFFATCGYLTFTGFTQGDLFENYCRNDDLVTFGRFCYGVTVILTYPMECFVTREVIANVFFGGNLSSVFHIVVTVMVITVATLVSLLIDCLGIVLELNGVLCATPLIFIIPSACYLKLSEEPRTHSDKIMSCVMLPIGAVVMVFGFVMAITNTQDCTHGQEMFYCFPDNFSLTNTSESHVQQTTQLSTLNISIFQ

SEQ ID NO: 81514 - protein, 406 aa, Homo sapiens; identical to SEQ ID NO: 81513
  Payload ID: 16250
  Gene Symbol: SLC38A11
  Gene Name: solute carrier family 38, member 11
  Uniprot ID: Q08AI6
  ENSP ID: ENSP00000386774

SEQ ID NO: 81515 - protein, 437 aa, Homo sapiens
  Payload ID: 16250
  Gene Symbol: SLC38A11
  Gene Name: solute carrier family 38, member 11
  ENSP ID: ENSP00000387345
MGYQRQEPVIPPQRDLDDRETLVSEHEYKEKTCQSAALFNVVNSIIGSGIIDFSLVLLIKGGALSGTDTYQSLVNKTFGFPGYLLLSVLQFLYPFIAMISYNIIAGDTLSKVFQRIPGVDPENVFIGRHFIIGLSTVTFTLPLSLYRNIAKLGKVSLISTGLTTLILGIVMARAISLGPHIPKTEDAWVFAKPNAIQAVGVMSFAFICHHNSFLVYSSLEEPTVAKWSRLIHMSIVISVFICIFFATCGYLTFTGFTQGDLFENYCRNDDLVTFGRFCYGVTVILTYPMECFVTREVIANVFFGGNLSSVFHIVVTVMVITVATLVSLLIDCLGIVLELNGVLCATPLIFIIPSACYLKLSEEPRTHSDKIMSCVMLPIGAVVMVFGFVMAITNTQDCTHGQEMFYCFPDNFSLTNTSESHVQQTTQLSTLNISIFQ

SEQ ID NO: 81516 - protein, 150 aa, Homo sapiens
  Payload ID: 16250
  Gene Symbol: SLC38A11
  Gene Name: solute carrier family 38, member 11
  ENSP ID: ENSP00000401448
LISTGLTTLILGIVMARAISLGPHIPKTEDAWVFAKPNAIQAVGVMSFGDLFENYCRNDDLVTFGRFCYGVTVILTYPMECFVTREVIANVFFGGNLSSVFHIVVTVMVITVATLVSLLIDCLGIVLELNGVLCATPLIFIIPSACYLKL

SEQ ID NO: 81517 - protein, 506 aa, Homo sapiens
  Payload ID: 16251
  Gene Symbol: SLC38A2
  Gene Name: solute carrier family 38, member 2
  Uniprot ID: Q96QD8
  ENSP ID: ENSP00000256689
MKKAEMGRFSISPDEDSSSYSSNSDFNYSYPTKQAALKSHYADVDPENQNFLLESNLGKKKYETEFHPGTTSFGMSVFNLSNAIVGSGILGLSYAMANTGIALFIILLTFVSIFSLYSVHLLLKTANEGGSLLYEQLGYKAFGLVGKLAASGSITMQNIGAMSSYLFIVKYELPLVIQALTNIEDKTGLWYLNGNYLVLLVSLVVILPLSLFRNLGYLGYTSGLSLLCMVFFLIVVICKKFQVPCPVEAALIINETINTTLTQPTALVPALSHNVTENDSCRPHYFIFNSQTVYAVPILIFSFVCHPAVLPIYEELKDRSRRRMMNVSKISFFAMFLMYLLAALFGYLTFYEHVESELLHTYSSILGTDILLLIVRLAVLMAVTLTVPVVIFPIRSSVTHLLCASKDFSWWRHSLITVSILAFTNLLVIFVPTIRDIFGFIGASAASMLIFILPSAFYIKLVKKEPMKSVQKIGALFFLLSGVLVMTGSMALIVLDWVHNAPGGGH

SEQ ID NO: 81518 - protein, 88 aa, Homo sapiens
  Payload ID: 16251
  Gene Symbol: SLC38A2
  Gene Name: solute carrier family 38, member 2
  ENSP ID: ENSP00000449695
MKKAEMGRFSISPDEDSSSYSSNSDFNYSYPTKQAALKSHYADVDPENQNFLLESNLGKKKYETEFNSLDICVNIFPVFCSSPFEDCQ

SEQ ID NO: 81519 - protein, 344 aa, Homo sapiens
  Payload ID: 16251
  Gene Symbol: SLC38A2
  Gene Name: solute carrier family 38, member 2
  ENSP ID: ENSP00000450406
MSPVRRCVYFSEDICDCFDLVSVFFRLWYLNGNYLVLLVSLVVILPLSLFRNLGYLGYTSGLSLLCMVFFLIVVICKKFQVPCPVEAALIINETINTTLTQPTALVPALSHNVTENDSCRPHYFIFNSQTVYAVPILIFSFVCHPAVLPIYEELKDRSRRRMMNVSKISFFAMFLMYLLAALFGYLTFYEHVESELLHTYSSILGTDILLLIVRLAVLMAVTLTVPVVIFPIRSSVTHLLCASKDFSWWRHSLITVSILAFTNLLVIFVPTIRDIFGFIGASAASMLIFILPSAFYIKLVKKEPMKSVQKIGALFFLLSGVLVMTGSMALIVLDWVHNAPGGGH

SEQ ID NO: 81520 - protein, 406 aa, Homo sapiens
  Payload ID: 16251
  Gene Symbol: SLC38A2
  Gene Name: solute carrier family 38, member 2
  Uniprot ID: Q96QD8
  ENSP ID: ENSP00000482873
MKQNLILLTFVSIFSLYSVHLLLKTANEGGSLLYEQLGYKAFGLVGKLAASGSITMQNIGAMSSYLFIVKYELPLVIQALTNIEDKTGLWYLNGNYLVLLVSLVVILPLSLFRNLGYLGYTSGLSLLCMVFFLIVVICKKFQVPCPVEAALIINETINTTLTQPTALVPALSHNVTENDSCRPHYFIFNSQTVYAVPILIFSFVCHPAVLPIYEELKDRSRRRMMNVSKISFFAMFLMYLLAALFGYLTFYEHVESELLHTYSSILGTDILLLIVRLAVLMAVTLTVPVVIFPIRSSVTHLLCASKDFSWWRHSLITVSILAFTNLLVIFVPTIRDIFGFIGASAASMLIFILPSAFYIKLVKKEPMKSVQKIGALFFLLSGVLVMTGSMALIVLDWVHNAPGGGH

SEQ ID NO: 81521 - protein, 96 aa, Homo sapiens
  Payload ID: 16252
  Gene Symbol: SLC38A3
  Gene Name: solute carrier family 38, member 3
  ENSP ID: ENSP00000479737
MEAPLQTEMVELVPNGKHSEGLLPVITPMAGNQRVEDPARSCMEGKSFLQKSPSKEPHFTDFEGKTSFGMSVFNLSNAIMGSGILGLAYAMANTGI

SEQ ID NO: 81522 - protein, 216 aa, Homo sapiens
  Payload ID: 16252
  Gene Symbol: SLC38A3
  Gene Name: solute carrier family 38, member 3
  ENSP ID: ENSP00000480466
MSSYLYIIKSELPLVIQTFLNLEEKTSDWYMNGNYLVILVSVTIILPLALMRQLGYLGYSSGFSLSCMVFFLIAVIYKKFHVPCPLPPNFNNTTGNFSHVEIVKEKVQLQVEPEASAFCTPSYFTLNSQTAYTIPIMAFAFVCHPEVLPIYTELKDPSKKKMQHISNLSIAVMYIMYFLAALFGYLTFYNGVESELLHTYSKVDPFDVLILCVRVA

SEQ ID NO: 81523 - protein, 504 aa, Homo sapiens
  Payload ID: 16252
  Gene Symbol: SLC38A3
  Gene Name: solute carrier family 38, member 3
  Uniprot ID: Q99624
  ENSP ID: ENSP00000481301
MEAPLQTEMVELVPNGKHSEGLLPVITPMAGNQRVEDPARSCMEGKSFLQKSPSKEPHFTDFEGKTSFGMSVFNLSNAIMGSGILGLAYAMANTGIILFLFLLTAVALLSSYSIHLLLKSSGVVGIRAYEQLGYRAFGTPGKLAAALAITLQNIGAMSSYLYIIKSELPLVIQTFLNLEEKTSDWYMNGNYLVILVSVTIILPLALMRQLGYLGYSSGFSLSCMVFFLIAVIYKKFHVPCPLPPNFNNTTGNFSHVEIVKEKVQLQVEPEASAFCTPSYFTLNSQTAYTIPIMAFAFVCHPEVLPIYTELKDPSKKKMQHISNLSIAVMYIMYFLAALFGYLTFYNGVESELLHTYSKVDPFDVLILCVRVAVLTAVTLTVPIVLFPVRRAIQQMLFPNQEFSWLRHVLIAVGLLTCINLLVIFAPNILGIFGVIGATSAPFLIFIFPAIFYFRIMPTEKEPARSTPKILALCFAMLGFLLMTMSLSFIIIDWASGTSRHGGNH

SEQ ID NO: 81524 - protein, 104 aa, Homo sapiens
  Payload ID: 16252
  Gene Symbol: SLC38A3
  Gene Name: solute carrier family 38, member 3
  ENSP ID: ENSP00000483959
MEAPLQTEMVELVPNGKHSEGLLPVITPMAGNQRVEDPARSCMEGKSFLQKSPSKEPHFTDFEGKTSFGMSVFNLSNAIMGSGILGLAYAMANTGIILFLHPCL

SEQ ID NO: 81525 - protein, 99 aa, Homo sapiens
  Payload ID: 16252
  Gene Symbol: SLC38A3
  Gene Name: solute carrier family 38, member 3
  ENSP ID: ENSP00000484379
MEAPLQTEMVELVPNGKHSEGLLPVITPMAGNQRVEDPARSCMEGKSFLQKSPSKEPHFTDFEGKTSFGMSVFNLSNAIMGSGILGLAYAMANTGIILF

SEQ ID NO: 81526 - protein, 547 aa, Homo sapiens
  Payload ID: 16253
  Gene Symbol: SLC38A4
  Gene Name: solute carrier family 38, member 4
  Uniprot ID: Q969I6
  ENSP ID: ENSP00000266579
MDPMELRNVNIEPDDESSSGESAPDSYIGIGNSEKAAMSSQFANEDTESQKFLTNGFLGKKKLADYADEHHPGTTSFGMSSFNLSNAIMGSGILGLSYAMANTGIILFIIMLLAVAILSLYSVHLLLKTAKEGGSLIYEKLGEKAFGWPGKIGAFVSITMQNIGAMSSYLFIIKYELPEVIRAFMGLEENTGEWYLNGNYLIIFVSVGIILPLSLLKNLGYLGYTSGFSLTCMVFFVSVVIYKKFQIPCPLPVLDHSVGNLSFNNTLPMHVVMLPNNSESSDVNFMMDYTHRNPAGLDENQAKGSLHDSGVEYEAHSDDKCEPKYFVFNSRTAYAIPILVFAFVCHPEVLPIYSELKDRSRRKMQTVSNISITGMLVMYLLAALFGYLTFYGEVEDELLHAYSKVYTLDIPLLMVRLAVLVAVTLTVPIVLFPIRTSVITLLFPKRPFSWIRHFLIAAVLIALNNVLVILVPTIKYIFGFIGASSATMLIFILPAVFYLKLVKKETFRSPQKVGALIFLVVGIFFMIGSMALIIIDWIYDPPNSKHH

SEQ ID NO: 81527 - protein, 547 aa, Homo sapiens; identical to SEQ ID NO: 81526
  Payload ID: 16253
  Gene Symbol: SLC38A4
  Gene Name: solute carrier family 38, member 4
  Uniprot ID: Q969I6
  ENSP ID: ENSP00000389843

SEQ ID NO: 81528 - protein, 141 aa, Homo sapiens
  Payload ID: 16253
  Gene Symbol: SLC38A4
  Gene Name: solute carrier family 38, member 4
  ENSP ID: ENSP00000448186
  MOD_RES (1)..(1): Any amino acid
XYIFGFIGASSATMLIFILPAVFYLKLVKKETFRSPQKVGEITGRFQRRLPVISPGTCRRGKSLFLSRMVVYVFKIKPVVHISTQVLLEQCEMMKVYFCCFTSRIRVTACNNHQIVLFPLPSPHPAPPKKVPNICILRTSN

SEQ ID NO: 81529 - protein, 191 aa, Homo sapiens
  Payload ID: 16253
  Gene Symbol: SLC38A4
  Gene Name: solute carrier family 38, member 4
  ENSP ID: ENSP00000448543
MDPMELRNVNIEPDDESSSGESAPDSYIGIGNSEKAAMSSQFANEDTESQKFLTNGFLGKKKLADYADEHHPGTTSFGMSSFNLSNAIMGSGILGLSYAMANTGIILFIIMLLAVAILSLYSVHLLLKTAKEGGSLIYEKLGEKAFGWPGKIGAFVSITMQNIGAMSSYLFIIKYELPEVIRAFMGLEENT

SEQ ID NO: 81530 - protein, 219 aa, Homo sapiens
  Payload ID: 16253
  Gene Symbol: SLC38A4
  Gene Name: solute carrier family 38, member 4
  ENSP ID: ENSP00000450071
MDPMELRNVNIEPDDESSSGESAPDSYIGIGNSEKAAMSSQFANEDTESQKFLTNGFLGKKKLADYADEHHPGTTSFGMSSFNLSNAIMGSGILGLSYAMANTGIILFIIMLLAVAILSLYSVHLLLKTAKEGGSLIYEKLGEKAFGWPGKIGAFVSITMQNIGAMSSYLFIIKYELPEVIRAFMGLEENTGEWYLNGNYLIIFVSVGIILPLSLLKNL

SEQ ID NO: 81531 - protein, 191 aa, Homo sapiens
  Payload ID: 16254
  Gene Symbol: SLC38A5
  Gene Name: solute carrier family 38, member 5
  ENSP ID: ENSP00000389644
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHL

SEQ ID NO: 81532 - protein, 279 aa, Homo sapiens
  Payload ID: 16254
  Gene Symbol: SLC38A5
  Gene Name: solute carrier family 38, member 5
  ENSP ID: ENSP00000402988
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCHPEVLPIY

SEQ ID NO: 81533 - protein, 218 aa, Homo sapiens
  Payload ID: 16254
  Gene Symbol: SLC38A5
  Gene Name: solute carrier family 38, member 5
  ENSP ID: ENSP00000403976
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQ

SEQ ID NO: 81534 - protein, 272 aa, Homo sapiens
  Payload ID: 16254
  Gene Symbol: SLC38A5
  Gene Name: solute carrier family 38, member 5
  ENSP ID: ENSP00000407258
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCH

SEQ ID NO: 81535 - protein, 163 aa, Homo sapiens
  Payload ID: 16254
  Gene Symbol: SLC38A5
  Gene Name: solute carrier family 38, member 5
  ENSP ID: ENSP00000416948
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPE

SEQ ID NO: 81536 - protein, 472 aa, Homo sapiens
  Payload ID: 16254
  Gene Symbol: SLC38A5
  Gene Name: solute carrier family 38, member 5
  Uniprot ID: Q8WUX1
  ENSP ID: ENSP00000471683
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCHPEVLPIYTELCRPSKRRMQAVANVSIGAMFCMYGLTATFGYLTFYSSVKAEMLHMYSQKDPLILCVRLAVLLAVTLTVPVVLFPIRRALQQLLFPGKAFSWPRHVAIALILLVLVNVLVICVPTIRDIFGVIGSTSAPSLIFILPSIFYLRIVPSEVEPFLSWPKIQALCFGVLGVLFMAVSLGFMFANWATGQSRMSGH

SEQ ID NO: 81537 - protein, 421 aa, Homo sapiens
  Payload ID: 16254
  Gene Symbol: SLC38A5
  Gene Name: solute carrier family 38, member 5
  Uniprot ID: Q8WUX1
  ENSP ID: ENSP00000478807
MSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCHPEVLPIYTELCRPSKRRMQAVANVSIGAMFCMYGLTATFGYLTFYSSVKAEMLHMYSQKDPLILCVRLAVLLAVTLTVPVVLFPIRRALQQLLFPGKAFSWPRHVAIALILLVLVNVLVICVPTIRDIFGVIGSTSAPSLIFILPSIFYLRIVPSEVEPFLSWPKIQALCFGVLGVLFMAVSLGFMFANWATGQSRMSGH

SEQ ID NO: 81538 - protein, 472 aa, Homo sapiens; identical to SEQ ID NO: 81536
  Payload ID: 16254
  Gene Symbol: SLC38A5
  Gene Name: solute carrier family 38, member 5
  Uniprot ID: Q8WUX1
  ENSP ID: ENSP00000481291

SEQ ID NO: 81539 - protein, 29 aa, Homo sapiens
  Payload ID: 16254
  Gene Symbol: SLC38A5
  Gene Name: solute carrier family 38, member 5
  ENSP ID: ENSP00000482638
  MOD_RES (1)..(1): Any amino acid
XALLLCIALLSSYSIHLLLTCAGIAGTGS

SEQ ID NO: 81540 - protein, 163 aa, Homo sapiens; identical to SEQ ID NO: 81535
  Payload ID: 16254
  Gene Symbol: SLC38A5
  Gene Name: solute carrier family 38, member 5
  ENSP ID: ENSP00000483716

SEQ ID NO: 81541 - protein, 403 aa, Homo sapiens
  Payload ID: 16254
  Gene Symbol: SLC38A5
  Gene Name: solute carrier family 38, member 5
  ENSP ID: ENSP00000484236
MLGPCPVTCSSSNLSSPWLSAPSCTWTPRGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCHPEVLPIYTELCRPSKRRMQAVANVSIGAMFCMYGLTATFGYLTFYSSVKAEMLHMYSQKDPLILCVRLAVLLAVTLTVPVVLFPIRRALQQLLFPGKAFSWPRHVAIALILLVLVNVLVICVPTIRDIFGVIGSTSAPSLIFILPSIFYLRIVPSEVEPFLSWPKIQALCFGVLGVLFMAVSLGFMFANWATGRAACLDTDQALLAQVPVRMHMEGSGPLPRVPPAQHVEVAGSHERGCQRRGTAEAADWPTSLLPRDAKLGSWP

SEQ ID NO: 81542 - protein, 456 aa, Homo sapiens
  Payload ID: 16255
  Gene Symbol: SLC38A6
  Gene Name: solute carrier family 38, member 6
  Uniprot ID: Q8IZM9
  ENSP ID: ENSP00000267488
MEASWGSFNAERGWYVSVQQPEEAEAEELSPLLSNELHRQRSPGVSFGLSVFNLMNAIMGSGILGLAYVLANTGVFGFSFLLLTVALLASYSVHLLLSMCIQTAVTSYEDLGLFAFGLPGKLVVAGTIIIQNIGAMSSYLLIIKTELPAAIAEFLTGDYSRYWYLDGQTLLIIICVGIVFPLALLPKIGFLGYTSSLSFFFMMFFALVVIIKKWSIPCPLTLNYVEKGFQISNVTDDCKPKLFHFSKESAYALPTMAFSFLCHTSILPIYCELQSPSKKRMQNVTNTAIALSFLIYFISALFGYLTFYDKVESELLKGYSKYLSHDVVVMTVKLCILFAVLLTVPLIHFPARKAVTMMFFSNFPFSWIRHFLITLALNIIIVLLAIYVPDIRNVFGVVGASTSTCLIFIFPGLFYLKLSREDFLSWKKLGAFVLLIFGILVGNFSLALIIFDWINK

SEQ ID NO: 81543 - protein, 521 aa, Homo sapiens
  Payload ID: 16255
  Gene Symbol: SLC38A6
  Gene Name: solute carrier family 38, member 6
  Uniprot ID: Q8IZM9
  ENSP ID: ENSP00000346959
MEASWGSFNAERGWYVSVQQPEEAEAEELSPLLSNELHRQRSPGVSFGLSVFNLMNAIMGSGILGLAYVLANTGVFGFSFLLLTVALLASYSVHLLLSMCIQTAVTSYEDLGLFAFGLPGKLVVAGTIIIQNIGAMSSYLLIIKTELPAAIAEFLTGDYSRYWYLDGQTLLIIICVGIVFPLALLPKIGFLGYTSSLSFFFMMFFALVVIIKKWSIPCPLTLNYVEKGFQISNVTDDCKPKLFHFSKESAYALPTMAFSFLCHTSILPIYCELQSPSKKRMQNVTNTAIALSFLIYFISALFGYLTFYDKVESELLKGYSKYLSHDVVVMTVKLCILFAVLLTVPLIHFPARKAVTMMFFSNFPFSWIRHFLITLALNIIIVLLAIYVPDIRNVFGVVGASTSTCLIFIFPGLFYLKLSREDFLSWKKLGGLILSHRLACSGVISAHCNLCLPDSSNPPTSASRVAETTGRDTMEMCTQRKGHARTQQEGNCLQAKGRGLRRTKRVHTLILHFPTSRTVSK

SEQ ID NO: 81544 - protein, 516 aa, Homo sapiens
  Payload ID: 16255
  Gene Symbol: SLC38A6
  Gene Name: solute carrier family 38, member 6
  ENSP ID: ENSP00000395851
GSFNAERGWYVSVQQPEEAEAEELSPLLSNELHRQRSPGVSFGLSVFNLMNAIMGSGILGLAYVLANTGVFGFSFLLLTVALLASYSVHLLLSMCIQTAVTSYEDLGLFAFGLPGKLVVAGTIIIQNIGAMSSYLLIIKTELPAAIAEFLTGDYSRYWYLDGQTLLIIICVGIVFPLALLPKIGFLGYTSSLSFFFMMFFALVVIIKKWSIPCPLTLNYVEKGFQISNVTDDCKPKLFHFSKESAYALPTMAFSFLCHTSILPIYCELQSPSKKRMQNVTNTAIALSFLIYFISALFGYLTFYDKVESELLKGYSKYLSHDVVVMTVKLCILFAVLLTVPLIHFPARKAVTMMFFSNFPFSWIRHFLITLALNIIIVLLAIYVPDIRNVFGVVGASTSTCLIFIFPGLFYLKLSREDFLSWKKLGGLILSHRLACSGVISAHCNLCLPDSSNPPTSASRVAETTGRDTMEMCTQRKGHARTQQEGNCLQAKGRGLRRTKRVHTLILHFPTSRTVSK

SEQ ID NO: 81545 - protein, 108 aa, Homo sapiens
  Payload ID: 16255
  Gene Symbol: SLC38A6
  Gene Name: solute carrier family 38, member 6
  ENSP ID: ENSP00000431212
MEASWGSFNAERGWYVSVQQPEEAEAEELSPLLSNELHRQRSPGVSFGLSVFNLMNAIMGSGILGLAYVLANTGVFGFSFLLLTVALLASYSVHLLLSMCIQTAYLGP

SEQ ID NO: 81546 - protein, 73 aa, Homo sapiens
  Payload ID: 16255
  Gene Symbol: SLC38A6
  Gene Name: solute carrier family 38, member 6
  ENSP ID: ENSP00000431260
MEASWGSFNAERGWYVSVQQPEEAEAEELSPLLSNVSGLCSLPRADALRLPSSACQIRPRKGGPHRDRGDAGA

SEQ ID NO: 81547 - protein, 194 aa, Homo sapiens
  Payload ID: 16255
  Gene Symbol: SLC38A6
  Gene Name: solute carrier family 38, member 6
  ENSP ID: ENSP00000434543
  MOD_RES (1)..(1): Any amino acid
XNLMNAIMGSGILGLAYVLANTGVFGFSFLLLTVALLASYSVHLLLSMCIQTAMSSYLLIIKTELPAAIAEFLTGDYSRYWYLDGQTLLIIICVGIVFPLALLPKIGFLGYTSSLSFFFMMFFALVVIIKKWSIPCPLTLNYVEKGFQISNVTDDCKPKLFHFSKESAYALPTMAFSFLCHTSILPIYCELQSP

SEQ ID NO: 81548 - protein, 20 aa, Homo sapiens
  Payload ID: 16255
  Gene Symbol: SLC38A6
  Gene Name: solute carrier family 38, member 6
  ENSP ID: ENSP00000434737
ACQIRPRKGGPHRDRGDAGA

SEQ ID NO: 81549 - protein, 18 aa, Homo sapiens
  Payload ID: 16255
  Gene Symbol: SLC38A6
  Gene Name: solute carrier family 38, member 6
  ENSP ID: ENSP00000435833
  MOD_RES (1)..(1): Any amino acid
XIRPRKGGPHRDRGDAGA

SEQ ID NO: 81550 - protein, 229 aa, Homo sapiens
  Payload ID: 16255
  Gene Symbol: SLC38A6
  Gene Name: solute carrier family 38, member 6
  ENSP ID: ENSP00000437190
IIKKWSIPCPLTLNYVEKGFQSAYALPTMAFSFLCHTSILPIYCELQSPSKKRMQNVTNTAIALSFLIYFISALFGYLTFYDKVESELLKGYSKYLSHDVVVMTVKLCILFAVLLTVPLIHFPARKAVTMMFFSNFPFSWIRHFLITLALNIIIVLLAIYVPDIRNVFGVVGASTSTCLIFIFPGLFYLKLSREDFLSWKKLGAFVLLIFGILVGNFSLALIIFDWINK

SEQ ID NO: 81551 - protein, 21 aa, Homo sapiens
  Payload ID: 16255
  Gene Symbol: SLC38A6
  Gene Name: solute carrier family 38, member 6
  ENSP ID: ENSP00000450996
IALSFLIYFISALFGYLTFYG

SEQ ID NO: 81552 - protein, 126 aa, Homo sapiens
  Payload ID: 16255
  Gene Symbol: SLC38A6
  Gene Name: solute carrier family 38, member 6
  ENSP ID: ENSP00000451244
MNAIMGSGILGLAYVLANTGVFGFSFLLLTVALLASYSVHLLLSMCIQTAVTSYEDLGLFAFGLPGKLVVAGTIIIQNIGAMSSYLLIIKTELPAAIAEFLTGDYSRYWYLDGQTLLIIICVGIVF

SEQ ID NO: 81553 - protein, 89 aa, Homo sapiens
  Payload ID: 16255
  Gene Symbol: SLC38A6
  Gene Name: solute carrier family 38, member 6
  ENSP ID: ENSP00000451434
LSPLHSHPIFISCSHKELHRQRSPGVSFGLSVFNLMNAIMGSGILGLAYVLANTGVFGFSFLLLTVALLASYSVHLLLSMCIQTAYLGP

SEQ ID NO: 81554 - protein, 57 aa, Homo sapiens
  Payload ID: 16255
  Gene Symbol: SLC38A6
  Gene Name: solute carrier family 38, member 6
  ENSP ID: ENSP00000452125
  MOD_RES (1)..(1): Any amino acid
XNLMNAIMGSGILGLAYVLANTGVFGFSFLLLTVALLASYSVHLLLSMCIQTAYLGP

SEQ ID NO: 81555 - protein, 42 aa, Homo sapiens
  Payload ID: 16255
  Gene Symbol: SLC38A6
  Gene Name: solute carrier family 38, member 6
  ENSP ID: ENSP00000482800
  MOD_RES (1)..(1): Any amino acid
XQLVVAGTIIIQNIGAMSSYLLIIKTELPAAIAEFLTGDYSR

SEQ ID NO: 81556 - protein, 462 aa, Homo sapiens
  Payload ID: 16256
  Gene Symbol: SLC38A7
  Gene Name: solute carrier family 38, member 7
  Uniprot ID: Q9NVC3
  ENSP ID: ENSP00000219320
MAQVSINNDYSEWDLSTDAGERARLLQSPCVDTAPKSEWEASPGGLDRGTTSTLGAIFIVVNACLGAGLLNFPAAFSTAGGVAAGIALQMGMLVFIISGLVILAYCSQASNERTYQEVVWAVCGKLTGVLCEVAIAVYTFGTCIAFLIIIGDQQDKIIAVMAKEPEGASGPWYTDRKFTISLTAFLFILPLSIPREIGFQKYASFLSVVGTWYVTAIVIIKYIWPDKEMTPGNILTRPASWMAVFNAMPTICFGFQCHVSSVPVFNSMQQPEVKTWGGVVTAAMVIALAVYMGTGICGFLTFGAAVDPDVLLSYPSEDMAVAVARAFIILSVLTSYPILHFCGRAVVEGLWLRYQGVPVEEDVGRERRRRVLQTLVWFLLTLLLALFIPDIGKVISVIGGLAACFIFVFPGLCLIQAKLSEMEEVKPASWWVLVSYGVLLVTLGAFIFGQTTANAIFVDLLA

SEQ ID NO: 81557 - protein, 354 aa, Homo sapiens
  Payload ID: 16256
  Gene Symbol: SLC38A7
  Gene Name: solute carrier family 38, member 7
  ENSP ID: ENSP00000454325
MAQVSINNDYSEWDLSTDAGERARLLQSPCVDTAPKSEWEASPGGLDRGTTSTLGAIFIVVNACLGAGLLNFPAAFSTAGGVAAGIALQMGMLVFIISGLVILAYCSQASNERTYQEVVWAVCGKLTGVLCEVAIAVYTFGTCIAFLIIIGDQQDKIIAVMAKEPEGASGPWYTDRKFTISLTAFLFILPLSIPREIGFQKYASFLSVVGTWYVTAIVIIKYIWPDKEMTPGNILTRPASWMAVFNAMPTICFGFQCHVSSVPVFNSMQQPEVKTWGGVVTAAMVIALAVYMGTAGGCWSATESSWSPWEPSSSARPQPTPSLWISWHNHCLPGNTRPLPLVAGTHLLELWGHS

SEQ ID NO: 81558 - protein, 462 aa, Homo sapiens; identical to SEQ ID NO: 81556
  Payload ID: 16256
  Gene Symbol: SLC38A7
  Gene Name: solute carrier family 38, member 7
  Uniprot ID: Q9NVC3
  ENSP ID: ENSP00000454646

SEQ ID NO: 81559 - protein, 94 aa, Homo sapiens
  Payload ID: 16256
  Gene Symbol: SLC38A7
  Gene Name: solute carrier family 38, member 7
  ENSP ID: ENSP00000454734
MAQVSINNDYSEWDLSTDAGERARLLQSPCVDTAPKSEWEASPGGLDRGTTSTLGAIFIVVNACLGAGLLNFPAAFSTAGGVAAGIALQMGMLV

SEQ ID NO: 81560 - protein, 260 aa, Homo sapiens
  Payload ID: 16256
  Gene Symbol: SLC38A7
  Gene Name: solute carrier family 38, member 7
  ENSP ID: ENSP00000455119
MAQVSINNDYSEWDLSTDAGERARLLQSPCVDTAPKSEWEASPGGLDRGTTSTLGAIFIVVNACLGAGLLNFPAAFSTAGGVAAGIALQMGMLVFIISGLVILAYCSQASNERTYQEVVWAVCGKLTGVLCEVAIAVYTFGTCIAFLIIIGDQQDKIIAVMAKEPEGASGPWYTDRKFTISLTAFLFILPLSIPREIGFQKYASFLSVVGTWYVTAIVIIKYIWPDKEMTPGNILTRPASWMAVFNAMPTICFGFQHAAA

SEQ ID NO: 81561 - protein, 373 aa, Homo sapiens
  Payload ID: 16256
  Gene Symbol: SLC38A7
  Gene Name: solute carrier family 38, member 7
  ENSP ID: ENSP00000455362
MGMLVFIISGLVILAYCSQASNERTYQEVVWAVCGKLTGVLCEVAIAVYTFGTCIAFLIIIGDQQDKIIAVMAKEPEGASGPWYTDRKFTISLTAFLFILPLSIPREIGFQKYASFLSVVGTWYVTAIVIIKYIWPDKEMTPGNILTRPASWMAVFNAMPTICFGFQCHVSSVPVFNSMQQPEVKTWGGVVTAAMVIALAVYMGTGICGFLTFGAAVDPDVLLSYPSEDMAVAVARAFIILSVLTSYPILHFCGRAVVEGLWLRYQGVPVEEDVGRERRRRVLQTLVWFLLTLLLALFIPDIGKVISVIGGLAACFIFVFPGLCLIQAKLSEMEEVKPASWWVLVSYGVLLVTLGAFIFGQTTANAIFVDLLA

SEQ ID NO: 81562 - protein, 140 aa, Homo sapiens
  Payload ID: 16256
  Gene Symbol: SLC38A7
  Gene Name: solute carrier family 38, member 7
  ENSP ID: ENSP00000455490
MAQVSINNDYSEWDLSTDAGERARLLQSPCVDTAPKSEWEASPGGLDRGTTSTLGAIFIVVNACLGAGLLNFPAAFSTAGGVAAGIALQMGMLVFIISGLVILAYCSQASNERTYQEVVWAVCGKLTGVLCEVAIAVYTF

SEQ ID NO: 81563 - protein, 65 aa, Homo sapiens
  Payload ID: 16256
  Gene Symbol: SLC38A7
  Gene Name: solute carrier family 38, member 7
  ENSP ID: ENSP00000456464
MTPGNILTRPASWMAVFNAMPTICFGFQCHVSSVPVFNSMQQPEVKTWGGVVTAAMVIALAVYMG

SEQ ID NO: 81564 - protein, 135 aa, Homo sapiens
  Payload ID: 16256
  Gene Symbol: SLC38A7
  Gene Name: solute carrier family 38, member 7
  ENSP ID: ENSP00000457462
MAQVSINNDYSEWDLSTDAGERARLLQSPCVDTAPKSEWEASPGGLDRGTTSTLGAIFIVVNACLGAGLLNFPAAFSTAGGVAAGIALQMVSALAGRAEVQFSWALCLKREASGQGWPVSDTRTALPSLTHGRHD

SEQ ID NO: 81565 - protein, 170 aa, Homo sapiens
  Payload ID: 16256
  Gene Symbol: SLC38A7
  Gene Name: solute carrier family 38, member 7
  ENSP ID: ENSP00000457988
  MOD_RES (1)..(1): Any amino acid
XIAVYTFGTCIAFLIIIGDQQDKIIAVMAKEPEGASGPWYTDRKFTISLTAFLFILPLSIPREIGFQKYASFLSVVGTWYVTAIVIIKYIWPDKEMTPGNILTRPASWMAVFNAMPTICFGFQCHVSSVPVFNSMQQPEVKTWGGVVTAAMVIALAVYMGTAETRSHYVA

SEQ ID NO: 81566 - protein, 435 aa, Homo sapiens
  Payload ID: 16257
  Gene Symbol: SLC38A8
  Gene Name: solute carrier family 38, member 8
  Uniprot ID: A6NNN8
  ENSP ID: ENSP00000299709
MEGQTPGSRGLPEKPHPATAAATLSSMGAVFILMKSALGAGLLNFPWAFSKAGGVVPAFLVELVSLVFLISGLVILGYAAAVSGQATYQGVVRGLCGPAIGKLCEACFLLNLLMISVAFLRVIGDQLEKLCDSLLSGTPPAPQPWYADQRFTLPLLSVLVILPLSAPREIAFQKYTSILGTLAACYLALVITVQYYLWPQGLVRESHPSLSPASWTSVFSVFPTICFGFQCHEAAVSIYCSMRKRSLSHWALVSVLSLLACCLIYSLTGVYGFLTFGTEVSADVLMSYPGNDMVIIVARVLFAVSIVTVYPIVLFLGRSVMQDFWRRSCLGGWGPSALADPSGLWVRMPLTILWVTVTLAMALFMPDLSEIVSIIGGISSFFIFIFPGLCLICAMGVEPIGPRVKCCLEVWGVVSVLVGTFIFGQSTAAAVWEMF

SEQ ID NO: 81567 - protein, 46 aa, Homo sapiens
  Payload ID: 16257
  Gene Symbol: SLC38A8
  Gene Name: solute carrier family 38, member 8
  ENSP ID: ENSP00000455085
MISVAFLRVIGDQLEKLCDSLLSGTPPAPQPWYADQRFTLPLLSVL

SEQ ID NO: 81568 - protein, 262 aa, Homo sapiens
  Payload ID: 16257
  Gene Symbol: SLC38A8
  Gene Name: solute carrier family 38, member 8
  ENSP ID: ENSP00000457737
MEGQTPGSRGLPEKPHPATAAATLSSMGAVFILMKSALGAGLLNFPWAFSKAGGVVPAFLVELVSLVFLISGLVILGYAAAVSGQATYQGVVRGLCGPAIGKLCEACFLLNLLMISVAFLRVIGDQLEKLCDSLLSGTPPAPQPWYADQRFTLPLLSVLVILPLSAPREIAFQKYTSILGTLAACYLALVITVQYYLWPQGLVRESHPSLSPASWTSVFSVFPTICFGFQCHEAAVSIYCSMRKRSLSHWALVSVLSLLACC

SEQ ID NO: 81569 - protein, 561 aa, Homo sapiens
  Payload ID: 16258
  Gene Symbol: SLC38A9
  Gene Name: solute carrier family 38, member 9
  Uniprot ID: Q8NBW4
  ENSP ID: ENSP00000316596
MANMNSDSRHLGTSEVDHERDPGPMNIQFEPSDLRSKRPFCIEPTNIVNVNHVIQRVSDHASAMNKRIHYYSRLTTPADKALIAPDHVVPAPEECYVYSPLGSAYKLQSYTEGYGKNTSLVTIFMIWNTMMGTSILSIPWGIKQAGFTTGMCVIILMGLLTLYCCYRVVKSRTMMFSLDTTSWEYPDVCRHYFGSFGQWSSLLFSLVSLIGAMIVYWVLMSNFLFNTGKFIFNFIHHINDTDTILSTNNSNPVICPSAGSGGHPDNSSMIFYANDTGAQQFEKWWDKSRTVPFYLVGLLLPLLNFKSPSFFSKFNILGTVSVLYLIFLVTFKAVRLGFHLEFHWFIPTEFFVPEIRFQFPQLTGVLTLAFFIHNCIITLLKNNKKQENNVRDLCIAYMLVTLTYLYIGVLVFASFPSPPLSKDCIEQNFLDNFPSSDTLSFIARIFLLFQMMTVYPLLGYLARVQLLGHIFGDIYPSIFHVLILNLIIVGAGVIMACFYPNIGGIIRYSGAACGLAFVFIYPSLIYIISLHQEERLTWPKLIFHVFIIILGVANLIVQFFM

SEQ ID NO: 81570 - protein, 561 aa, Homo sapiens; identical to SEQ ID NO: 81569
  Payload ID: 16258
  Gene Symbol: SLC38A9
  Gene Name: solute carrier family 38, member 9
  Uniprot ID: Q8NBW4
  ENSP ID: ENSP00000380074

SEQ ID NO: 81571 - protein, 437 aa, Homo sapiens
  Payload ID: 16258
  Gene Symbol: SLC38A9
  Gene Name: solute carrier family 38, member 9
  ENSP ID: ENSP00000397429
MIWNTMMGTSILSIPWGIKQAGFTTGMCVIILMGLLTLYCCYRVVKSRTMMFSLDTTSWEYPDVCRHYFGSFGQWSSLLFSLVSLIGAMIVYWVLMSNFLFNTGKFIFNFIHHINDTDTILSTNNSNPVICPSAGSGGHPDNSSMIFYANDTGAQQFEKWWDKSRTVPFYLVGLLLPLLNFKSPSFFSKFNILGTVSVLYLIFLVTFKAVRLGFHLEFHWFIPTEFFVPEIRFQFPQLTGVLTLAFFIHNCIITLLKNNKKQENNVRDLCIAYMLVTLTYLYIGVLVFASFPSPPLSKDCIEQNFLDNFPSSDTLSFIARIFLLFQMMTVYPLLGYLARVQLLGHIFGDIYPSIFHVLILNLIIVGAGVIMACFYPNIGGIIRYSGAACGLAFVFIYPSLIYIISLHQEERLTWPKLIFHVFIIILGVANLIVQFFM

SEQ ID NO: 81572 - protein, 498 aa, Homo sapiens
  Payload ID: 16258
  Gene Symbol: SLC38A9
  Gene Name: solute carrier family 38, member 9
  Uniprot ID: Q8NBW4
  ENSP ID: ENSP00000420934
MNKRIHYYSRLTTPADKALIAPDHVVPAPEECYVYSPLGSAYKLQSYTEGYGKNTSLVTIFMIWNTMMGTSILSIPWGIKQAGFTTGMCVIILMGLLTLYCCYRVVKSRTMMFSLDTTSWEYPDVCRHYFGSFGQWSSLLFSLVSLIGAMIVYWVLMSNFLFNTGKFIFNFIHHINDTDTILSTNNSNPVICPSAGSGGHPDNSSMIFYANDTGAQQFEKWWDKSRTVPFYLVGLLLPLLNFKSPSFFSKFNILGTVSVLYLIFLVTFKAVRLGFHLEFHWFIPTEFFVPEIRFQFPQLTGVLTLAFFIHNCIITLLKNNKKQENNVRDLCIAYMLVTLTYLYIGVLVFASFPSPPLSKDCIEQNFLDNFPSSDTLSFIARIFLLFQMMTVYPLLGYLARVQLLGHIFGDIYPSIFHVLILNLIIVGAGVIMACFYPNIGGIIRYSGAACGLAFVFIYPSLIYIISLHQEERLTWPKLIFHVFIIILGVANLIVQFFM

SEQ ID NO: 81573 - protein, 37 aa, Homo sapiens
  Payload ID: 16258
  Gene Symbol: SLC38A9
  Gene Name: solute carrier family 38, member 9
  ENSP ID: ENSP00000420950
MANMNSDSRHLGTSEVDHERDPGPMNIQFEPSDLRSK

SEQ ID NO: 81574 - protein, 96 aa, Homo sapiens
  Payload ID: 16258
  Gene Symbol: SLC38A9
  Gene Name: solute carrier family 38, member 9
  ENSP ID: ENSP00000422843
MANMNSDSRHLGTSEVDHERDPGPMNIQFEPSDLRSKRPFCIEPTNIVNVNHVIQRVSDHASAMNKRIHYYSRLTTPADKALIAPDHVVPAPEECY

SEQ ID NO: 81575 - protein, 455 aa, Homo sapiens
  Payload ID: 16258
  Gene Symbol: SLC38A9
  Gene Name: solute carrier family 38, member 9
  ENSP ID: ENSP00000423219
MANMNSDSRHLGTSEVDHERDPGPMNIQFEPSDLRSKRPFCIEPTNIVNVNHVIQRVSDHASAMNKRIHYYSRLTTPADKALIAPDHVVPAPEECYVYSPLGSAYKLQSYTEGYGKNTSLVTIFMIWNTMMGTSILSIPWGIKQAGFTTGMCVIILMGLLTLYCCYRVVKSRTMMFSLDTTSWEYPDVCRHYFGSFGQWSSLLFSLVSLIGAMIVYWVLMSNFLFNTGKFIFSTVSVLYLIFLVTFKAVRLGFHLEFHWFIPTEFFVPEIRFQFPQLTGVLTLAFFIHNCIITLLKNNKKQENNVRDLCIAYMLVTLTYLYIGVLVFASFPSPPLSKDCIEQNFLDNFPSSDTLSFIARIFLLFQMMTVYPLLGYLARVQLLGHIFGDIYPSIFHVLILNLIIVGAGVIMACFYPNIGGIIRYSGAACGLAFVFIYPSLIYIISLHQEERLTWPK

SEQ ID NO: 81576 - protein, 43 aa, Homo sapiens
  Payload ID: 16258
  Gene Symbol: SLC38A9
  Gene Name: solute carrier family 38, member 9
  ENSP ID: ENSP00000424271
MANMNSDSRHLGTSEVDHERDPGPMNIQFEPSDLRSKRQGLTL

SEQ ID NO: 81577 - protein, 102 aa, Homo sapiens
  Payload ID: 16258
  Gene Symbol: SLC38A9
  Gene Name: solute carrier family 38, member 9
  ENSP ID: ENSP00000424918
MNKRIHYYSRLTTPADKALIAPDHVVPAPEECYVYSPLGSAYKLQSYTEGYGKNTSLVTIFMIWNTMMGTSILSIPWGIKQAGFTTGMCVIILMGLLTLYCC

SEQ ID NO: 81578 - protein, 131 aa, Homo sapiens
  Payload ID: 16258
  Gene Symbol: SLC38A9
  Gene Name: solute carrier family 38, member 9
  ENSP ID: ENSP00000425055
MANMNSDSRHLGTSEVDHERDPGPMNIQFEPSDLRSKRPFCIEPTNIVNVNHVIQRVSDHASAMNKRIHYYSRLTTPADKALIAPDHVVPAPEECYVYSPLGSAYKLQSYTEGYGKNTSLVTIFMIWNTMM

SEQ ID NO: 81579 - protein, 37 aa, Homo sapiens; identical to SEQ ID NO: 81573
  Payload ID: 16258
  Gene Symbol: SLC38A9
  Gene Name: solute carrier family 38, member 9
  ENSP ID: ENSP00000425259

SEQ ID NO: 81580 - protein, 26 aa, Homo sapiens
  Payload ID: 16258
  Gene Symbol: SLC38A9
  Gene Name: solute carrier family 38, member 9
  ENSP ID: ENSP00000425842
MANMNSDSRHLGTSEVDHERDPGPMN

SEQ ID NO: 81581 - protein, 187 aa, Homo sapiens
  Payload ID: 16258
  Gene Symbol: SLC38A9
  Gene Name: solute carrier family 38, member 9
  ENSP ID: ENSP00000426413
MNKRIHYYSRLTTPADKALIAPDHVVPAPEECYVYSPLGSAYKLQSYTEGYGKNTSLVTIFMIWNTMMGTSILSIPWGIKQAGFTTGMCVIILMGLLTLYCCYRVVKSRTMMFSLDTTSWEYPDVCRHYFGSFGQWSSLLFSLVSLIGAMIVYWVLMSNFLFNTGKFIFNFIHHINDTDTILSTNNS

SEQ ID NO: 81582 - protein, 43 aa, Homo sapiens
  Payload ID: 16258
  Gene Symbol: SLC38A9
  Gene Name: solute carrier family 38, member 9
  ENSP ID: ENSP00000426925
MANMNSDSRHLGTSEVDHERDPGPMNIQFEPSDLRSKRLPQTM

SEQ ID NO: 81583 - protein, 498 aa, Homo sapiens
  Payload ID: 16258
  Gene Symbol: SLC38A9
  Gene Name: solute carrier family 38, member 9
  Uniprot ID: Q8NBW4
  ENSP ID: ENSP00000427335
MAICILTWRIRPFCIEPTNIVNVNHVIQRVSDHASAMNKRIHYYSRLTTPADKALIAPDHVVPAPEECYVYSPLGSAYKLQSYTEGYGKNTSLVTIFMIWNTMMGTSILSIPWGIKQAGFTTGMCVIILMGLLTLYCCYRVVKSRTMMFSLDTTSWEYPDVCRHYFGSFGQWSSLLFSLVSLIGAMIVYWVLMSNFLFNTGKFIFNFIHHINDTDTILSTNNSNPVICPSAGSGGHPDNSSMIFYANDTGAQQFEKWWDKSRTVPFYLVGLLLPLLNFKSPSFFSKFNILEIRFQFPQLTGVLTLAFFIHNCIITLLKNNKKQENNVRDLCIAYMLVTLTYLYIGVLVFASFPSPPLSKDCIEQNFLDNFPSSDTLSFIARIFLLFQMMTVYPLLGYLARVQLLGHIFGDIYPSIFHVLILNLIIVGAGVIMACFYPNIGGIIRYSGAACGLAFVFIYPSLIYIISLHQEERLTWPKLIFHVFIIILGVANLIVQFFM

SEQ ID NO: 81584 - protein, 36 aa, Homo sapiens
  Payload ID: 16258
  Gene Symbol: SLC38A9
  Gene Name: solute carrier family 38, member 9
  ENSP ID: ENSP00000427624
MNKRIHYYSRLTTPADKALIAPDHVVPAPEECYVYS

SEQ ID NO: 81585 - protein, 397 aa, Homo sapiens
  Payload ID: 16258
  Gene Symbol: SLC38A9
  Gene Name: solute carrier family 38, member 9
  ENSP ID: ENSP00000427707
MNKRIHYYSRLTTPADKALIAPDHVVPAPEECYVYSPLGSAYKLQSYTEGYGKNTSLVTIFMIWNTMMGTSILSIPWGIKQAGFTTGMCVIILMGLLTLYCCYRVVKSRTMMFSLDTTSWEYPDVCRHYFGSFGQWSSLLFSLVSLIGAMIVYWVLMSNFLFNTGKFIFNFIHHINDTDTILSTNNSNPVICPSAGSGGHPDNSSMIFYANDTGAQQFEKWWDKSRTVPFYLVGLLLPLLNFKSPSFFSKFNILGTVSVLYLIFLVTFKAVRLGFHLEFHWFIPTEFFVPEIRFQFPQLTGVLTLAFFIHNCIITLLKNNKKQENNVRDLCIAYMLVTLTYLYIGVLVFASFPSPPLSKDCIEQATWLVSSFWAISSVTFILGKGSSLDQQDVPSNK

SEQ ID NO: 81586 - protein, 324 aa, Homo sapiens
  Payload ID: 16259
  Gene Symbol: SLC39A1
  Gene Name: solute carrier family 39 (zinc transporter), member 1
  Uniprot ID: Q9NY26
  ENSP ID: ENSP00000309710
MGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQASGAPATPSALRACVLVFSLALHSVFEGLAVGLQRDRARAMELCLALLLHKGILAVSLSLRLLQSHLRAQVVAGCGILFSCMTPLGIGLGAALAESAGPLHQLAQSVLEGMAAGTFLYITFLEILPQELASSEQRILKVILLLAGFALLTGLLFIQI

SEQ ID NO: 81587 - protein, 324 aa, Homo sapiens; identical to SEQ ID NO: 81586
  Payload ID: 16259
  Gene Symbol: SLC39A1
  Gene Name: solute carrier family 39 (zinc transporter), member 1
  Uniprot ID: Q9NY26
  ENSP ID: ENSP00000348535

SEQ ID NO: 81588 - protein, 324 aa, Homo sapiens; identical to SEQ ID NO: 81586
  Payload ID: 16259
  Gene Symbol: SLC39A1
  Gene Name: solute carrier family 39 (zinc transporter), member 1
  Uniprot ID: Q9NY26
  ENSP ID: ENSP00000357610

SEQ ID NO: 81589 - protein, 324 aa, Homo sapiens; identical to SEQ ID NO: 81586
  Payload ID: 16259
  Gene Symbol: SLC39A1
  Gene Name: solute carrier family 39 (zinc transporter), member 1
  Uniprot ID: Q9NY26
  ENSP ID: ENSP00000357612

SEQ ID NO: 81590 - protein, 240 aa, Homo sapiens
  Payload ID: 16259
  Gene Symbol: SLC39A1
  Gene Name: solute carrier family 39 (zinc transporter), member 1
  ENSP ID: ENSP00000392229
MGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQASGAPATPSALRACVLVFSLALHSVFEGLAVGLQRDRARAMELCLALLLHKGILAVSLSLRLLQSHLRAQVVA

SEQ ID NO: 81591 - protein, 321 aa, Homo sapiens
  Payload ID: 16259
  Gene Symbol: SLC39A1
  Gene Name: solute carrier family 39 (zinc transporter), member 1
  ENSP ID: ENSP00000392950
MGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQASGAPATPSALRACVLVFSLALHSVFEGLAVGLQRDRARAMELCLALLLHKGILAVSLSLRLLQSHLRAQVVAGCGILFSCMTPLGIGLGAALAESAGPLHQLAQSVLEGMAAGTFLYITFLEILPQELASSEQRILKVILLLAGFALLTGLLF

SEQ ID NO: 81592 - protein, 206 aa, Homo sapiens
  Payload ID: 16259
  Gene Symbol: SLC39A1
  Gene Name: solute carrier family 39 (zinc transporter), member 1
  ENSP ID: ENSP00000407717
MGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQASGAPATPSALRACVLVFSLALHSVFEGLAVGLQRDRAR

SEQ ID NO: 81593 - protein, 116 aa, Homo sapiens
  Payload ID: 16259
  Gene Symbol: SLC39A1
  Gene Name: solute carrier family 39 (zinc transporter), member 1
  ENSP ID: ENSP00000443632
MGPWGEPELLVWRPEAVASEPPVPVGLEVKLGALVLLLVLTLLCSLVPICVLRRPGANHEGSAPVPTARVHPGHGLLPGPGDGADHTGLQGAVRAVTSGGNKGSAGNSEWWAAALA

SEQ ID NO: 81594 - protein, 324 aa, Homo sapiens; identical to SEQ ID NO: 81586
  Payload ID: 16259
  Gene Symbol: SLC39A1
  Gene Name: solute carrier family 39 (zinc transporter), member 1
  Uniprot ID: Q9NY26
  ENSP ID: ENSP00000479421

SEQ ID NO: 81595 - protein, 324 aa, Homo sapiens; identical to SEQ ID NO: 81586
  Payload ID: 16259
  Gene Symbol: SLC39A1
  Gene Name: solute carrier family 39 (zinc transporter), member 1
  Uniprot ID: Q9NY26
  ENSP ID: ENSP00000484182

SEQ ID NO: 81596 - protein, 831 aa, Homo sapiens
  Payload ID: 16260
  Gene Symbol: SLC39A10
  Gene Name: solute carrier family 39 (zinc transporter), member 10
  Uniprot ID: Q9ULF5
  ENSP ID: ENSP00000352655
MKVHMHTKFCLICLLTFIFHHCNHCHEEHDHGPEALHRQHRGMTELEPSKFSKQAAENEKKYYIEKLFERYGENGRLSFFGLEKLLTNLGLGERKVVEINHEDLGHDHVSHLDILAVQEGKHFHSHNHQHSHNHLNSENQTVTSVSTKRNHKCDPEKETVEVSVKSDDKHMHDHNHRLRHHHRLHHHLDHNNTHHFHNDSITPSERGEPSNEPSTETNKTQEQSDVKLPKGKRKKKGRKSNENSEVITPGFPPNHDQGEQYEHNRVHKPDRVHNPGHSHVHLPERNGHDPGRGHQDLDPDNEGELRHTRKREAPHVKNNAIISLRKDLNEDDHHHECLNVTQLLKYYGHGANSPISTDLFTYLCPALLYQIDSRLCIEHFDKLLVEDINKDKNLVPEDEANIGASAWICGIISITVISLLSLLGVILVPIINQGCFKFLLTFLVALAVGTMSGDALLHLLPHSQGGHDHSHQHAHGHGHSHGHESNKFLEEYDAVLKGLVALGGIYLLFIIEHCIRMFKHYKQQRGKQKWFMKQNTEESTIGRKLSDHKLNNTPDSDWLQLKPLAGTDDSVVSEDRLNETELTDLEGQQESPPKNYLCIEEEKIIDHSHSDGLHTIHEHDLHAAAHNHHGENKTVLRKHNHQWHHKHSHHSHGPCHSGSDLKETGIANIAWMVIMGDGIHNFSDGLAIGAAFSAGLTGGISTSIAVFCHELPHELGDFAVLLKAGMTVKQAIVYNLLSAMMAYIGMLIGTAVGQYANNITLWIFAVTAGMFLYVALVDMLPEMLHGDGDNEEHGFCPVGQFILQNLGLLFGFAIMLVIALYEDKIVFDIQF

SEQ ID NO: 81597 - protein, 831 aa, Homo sapiens; identical to SEQ ID NO: 81596
  Payload ID: 16260
  Gene Symbol: SLC39A10
  Gene Name: solute carrier family 39 (zinc transporter), member 10
  Uniprot ID: Q9ULF5
  ENSP ID: ENSP00000386766

SEQ ID NO: 81598 - protein, 126 aa, Homo sapiens
  Payload ID: 16260
  Gene Symbol: SLC39A10
  Gene Name: solute carrier family 39 (zinc transporter), member 10
  ENSP ID: ENSP00000389640
MKVHMHTKFCLICLLTFIFHHCNHCHEEHDHGPEALHRQHRGMTELEPSKFSKQAAENEKKYYIEKLFERYGENGRLSFFGLEKLLTNLGLGERKVVEINHEDLGHDHVSHLDILAVQEGKHFHSH

SEQ ID NO: 81599 - protein, 39 aa, Homo sapiens
  Payload ID: 16260
  Gene Symbol: SLC39A10
  Gene Name: solute carrier family 39 (zinc transporter), member 10
  ENSP ID: ENSP00000394469
MKNVMVMILVVDTKILILIMKVNFDILEREKHHMLKIMQ

SEQ ID NO: 81600 - protein, 39 aa, Homo sapiens; identical to SEQ ID NO: 81599
  Payload ID: 16260
  Gene Symbol: SLC39A10
  Gene Name: solute carrier family 39 (zinc transporter), member 10
  ENSP ID: ENSP00000394995

SEQ ID NO: 81601 - protein, 38 aa, Homo sapiens
  Payload ID: 16260
  Gene Symbol: SLC39A10
  Gene Name: solute carrier family 39 (zinc transporter), member 10
  ENSP ID: ENSP00000406590
MKVHMHTKFCLICLLTFIFHHCNHCHEEHDHGPEALHR

SEQ ID NO: 81602 - protein, 130 aa, Homo sapiens
  Payload ID: 16260
  Gene Symbol: SLC39A10
  Gene Name: solute carrier family 39 (zinc transporter), member 10
  ENSP ID: ENSP00000409272
MKVHMHTKFCLICLLTFIFHHCNHCHEEHDHGPEALHRQHRGMTELEPSKFSKQAAENEKKYYIEKLFERYGENGRLSFFGLEKLLTNLGLGERKVVEINHEDLGHDHVSHLDILAVQEGKHFHSHNHQH

SEQ ID NO: 81603 - protein, 691 aa, Homo sapiens
  Payload ID: 16261
  Gene Symbol: SLC39A12
  Gene Name: solute carrier family 39 (zinc transporter), member 12
  Uniprot ID: Q504Y0
  ENSP ID: ENSP00000366586
MCFRTKLSVSWVPLFLLLSRVFSTETDKPSAQDSRSRGSSGQPADLLQVLSAGDHPPHNHSRSLIKTLLEKTGCPRRRNGMQGDCNLCFEPDALLLIAGGNFEDQLREEVVQRVSLLLLYYIIHQEEICSSKLNMSNKEYKFYLHSLLSLRQDEDSSFLSQNETEDILAFTRQYFDTSQSQCMETKTLQKKSGIVSSEGANESTLPQLAAMIITLSLQGVCLGQGNLPSPDYFTEYIFSSLNRTNTLRLSELDQLLNTLWTRSTCIKNEKIHQFQRKQNNIITHDQDYSNFSSSMEKESEDGPVSWDQTCFSARQLVEIFLQKGLSLISKEDFKQMSPGIIQQLLSCSCHLPKDQQAKLPPTTLEKYGYSTVAVTLLTLGSMLGTALVLFHSCEENYRLILQLFVGLAVGTLSGDALLHLIPQVLGLHKQEAPEFGHFHESKGHIWKLMGLIGGIHGFFLIEKCFILLVSPNDKQGLSLVNGHVGHSHHLALNSELSDQAGRGKSASTIQLKSPEDSQAAEMPIGSMTASNRKCKAISLLAIMILVGDSLHNFADGLAIGAAFSSSSESGVTTTIAILCHEIPHEMGDFAVLLSSGLSMKTAILMNFISSLTAFMGLYIGLSVSADPCVQDWIFTVTAGMFLYLSLVEMLPEMTHVQTQRPWMMFLLQNFGLILGWLSLLLLAIYEQNIKI

SEQ ID NO: 81604 - protein, 690 aa, Homo sapiens
  Payload ID: 16261
  Gene Symbol: SLC39A12
  Gene Name: solute carrier family 39 (zinc transporter), member 12
  Uniprot ID: Q504Y0
  ENSP ID: ENSP00000366588
MCFRTKLSVSWVPLFLLLSRVFSTETDKPSAQDSRSRGSSGQPADLLQVLSAGDHPPHNHSRSLIKTLLEKTGCPRRRNGMQGDCNLCFEPDALLLIAGGNFEDQLREEVVQRVSLLLLYYIIHQEEICSSKLNMSNKEYKFYLHSLLSLRQDEDSSFLSQNETEDILAFTRQYFDTSQSQCMETKTLQKKSGIVSSEGANESTLPQLAAMIITLSLQGVCLGQGNLPSPDYFTEYIFSSLNRTNTLRLSELDQLLNTLWTRSTCIKNEKIHQFQRKQNNIITHDQDYSNFSSSMEKESEDGPVSWDQTCFSARQLVEIFLQKGLSLISKEDFKQMSPGIIQQLLSCSCHLPKDQQAKLPPTTLEKYGYSTVAVTLLTLGSMLGTALVLFHSCEENYRLILQLFVGLAVGTLSGDALLHLIPQVLGLHKQEAPEFGHFHESKGHIWKLMGLIGGIHGFFLIEKCFILLVSPNDKGLSLVNGHVGHSHHLALNSELSDQAGRGKSASTIQLKSPEDSQAAEMPIGSMTASNRKCKAISLLAIMILVGDSLHNFADGLAIGAAFSSSSESGVTTTIAILCHEIPHEMGDFAVLLSSGLSMKTAILMNFISSLTAFMGLYIGLSVSADPCVQDWIFTVTAGMFLYLSLVEMLPEMTHVQTQRPWMMFLLQNFGLILGWLSLLLLAIYEQNIKI

SEQ ID NO: 81605 - protein, 654 aa, Homo sapiens
  Payload ID: 16261
  Gene Symbol: SLC39A12
  Gene Name: solute carrier family 39 (zinc transporter), member 12
  Uniprot ID: Q504Y0
  ENSP ID: ENSP00000366591
MCFRTKLSVSWVPLFLLLSRVFSTETDKPSAQDSRSRGSSGQPADLLQVLSAGDHPPHNHSRSLIKTLLEKTGCPRRRNGMQGDCNLCFEPDALLLIAGGNFEDQLREEVVQRVSLLLLYYIIHQEEICSSKLNMSNKEYKFYLHSLLSLRQDEDSSFLSQNETEDILAFTRQYFDTSQSQCMETKTLQKKSGIVSSEGANESTLPQLAAMIITLSLQGVCLGQGNLPSPDYFTEYIFSSLNRTNTLRLSELDQLLNTLWTRSTCIKNEKIHQFQRKQNNIITHDQDYSNFSSSMEKESEDGPVSWDQTCFSARQLVEIFLQKGLSLISKEDFKQMSPGIIQQLLSCSCHLPKDQQAKLPPTTLEKYGYSTVAVTLLTLGSMLGTALVLFHSCEENYRLILQLFVGLAVGTLSGDALLHLIPQVLGLHKQEAPEFGHFHESKGHIWKLMGLIGGIHGFFLIEKCFILLVSPNDKKSPEDSQAAEMPIGSMTASNRKCKAISLLAIMILVGDSLHNFADGLAIGAAFSSSSESGVTTTIAILCHEIPHEMGDFAVLLSSGLSMKTAILMNFISSLTAFMGLYIGLSVSADPCVQDWIFTVTAGMFLYLSLVEMLPEMTHVQTQRPWMMFLLQNFGLILGWLSLLLLAIYEQNIKI

SEQ ID NO: 81606 - protein, 557 aa, Homo sapiens
  Payload ID: 16261
  Gene Symbol: SLC39A12
  Gene Name: solute carrier family 39 (zinc transporter), member 12
  Uniprot ID: Q504Y0
  ENSP ID: ENSP00000440445
MSNKEYKFYLHSLLSLRQDEDSSFLSQNETEDILAFTRQYFDTSQSQCMETKTLQKKSGIVSSEGANESTLPQLAAMIITLSLQGVCLGQGNLPSPDYFTEYIFSSLNRTNTLRLSELDQLLNTLWTRSTCIKNEKIHQFQRKQNNIITHDQDYSNFSSSMEKESEDGPVSWDQTCFSARQLVEIFLQKGLSLISKEDFKQMSPGIIQQLLSCSCHLPKDQQAKLPPTTLEKYGYSTVAVTLLTLGSMLGTALVLFHSCEENYRLILQLFVGLAVGTLSGDALLHLIPQVLGLHKQEAPEFGHFHESKGHIWKLMGLIGGIHGFFLIEKCFILLVSPNDKQGLSLVNGHVGHSHHLALNSELSDQAGRGKSASTIQLKSPEDSQAAEMPIGSMTASNRKCKAISLLAIMILVGDSLHNFADGLAIGAAFSSSSESGVTTTIAILCHEIPHEMGDFAVLLSSGLSMKTAILMNFISSLTAFMGLYIGLSVSADPCVQDWIFTVTAGMFLYLSLVEMLPEMTHVQTQRPWMMFLLQNFGLILGWLSLLLLAIYEQNIKI

SEQ ID NO: 81607 - protein, 364 aa, Homo sapiens
  Payload ID: 16262
  Gene Symbol: SLC39A13
  Gene Name: solute carrier family 39 (zinc transporter), member 13
  Uniprot ID: Q96H72
  ENSP ID: ENSP00000346956
MPGCPCPGCGMAGPRLLFLTALALELLERAGGSQPALRSRGTATACRLDNKESESWGALLSGERLDTWICSLLGSLMVGLSGVFPLLVIPLEMGTMLRSEAGAWRLKQLLSFALGGLLGNVFLHLLPEAWAYTCSASPGGEGQSLQQQQQLGLWVIAGILTFLALEKMFLDSKEEGTSQAPNKDPTAAAAALNGGHCLAQPAAEPGLGAVVRSIKVSGYLNLLANTIDNFTHGLAVAASFLVSKKIGLLTTMAILLHEIPHEVGDFAILLRAGFDRWSAAKLQLSTALGGLLGAGFAICTQSPKGVEETAAWVLPFTSGGFLYIALVNVLPDLLEEEDPWRSLQQLLLLCAGIVVMVLFSLFVD

SEQ ID NO: 81608 - protein, 371 aa, Homo sapiens
  Payload ID: 16262
  Gene Symbol: SLC39A13
  Gene Name: solute carrier family 39 (zinc transporter), member 13
  Uniprot ID: Q96H72
  ENSP ID: ENSP00000354689
MPGCPCPGCGMAGPRLLFLTALALELLERAGGSQPALRSRGTATACRLDNKESESWGALLSGERLDTWICSLLGSLMVGLSGVFPLLVIPLEMGTMLRSEAGAWRLKQLLSFALGGLLGNVFLHLLPEAWAYTCSASPGGEGQSLQQQQQLGLWVIAGILTFLALEKMFLDSKEEGTSQAPNKDPTAAAAALNGGHCLAQPAAEPGLGAVVRSIKVSGYLNLLANTIDNFTHGLAVAASFLVSKKIGLLTTMAILLHEIPHEVGDFAILLRAGFDRWSAAKLQLSTALGGLLGAGFAICTQSPKGVVGCSPAAEETAAWVLPFTSGGFLYIALVNVLPDLLEEEDPWRSLQQLLLLCAGIVVMVLFSLFVD

SEQ ID NO: 81609 - protein, 218 aa, Homo sapiens
  Payload ID: 16262
  Gene Symbol: SLC39A13
  Gene Name: solute carrier family 39 (zinc transporter), member 13
  ENSP ID: ENSP00000432302
MPGCPCPGCGMAGPRLLFLTALALELLERAGGSQPALRSRGTATACRLDNKESESWGALLSGERLDTWICSLLGSLMVGLSGVFPLLVIPLEMGTMLRSEAGAWRLKQLLSFALGGLLGNVFLHLLPEAWAYTCSASPGGEGQSLQQQQQLGLWVIAGILTFLALEKMFLDSKEEGTSQVSGYLNLLANTIDNFTHGLAVAASFLVSKKVRGLGPVGL

SEQ ID NO: 81610 - protein, 248 aa, Homo sapiens
  Payload ID: 16262
  Gene Symbol: SLC39A13
  Gene Name: solute carrier family 39 (zinc transporter), member 13
  ENSP ID: ENSP00000432499
MPGCPCPGCGMAGPRLLFLTALALELLERAGGSQPALRSRGTATACRLDNKESESWGALLSGERLDTWICSLLGSLMVGLSGVFPLLVIPLEMGTMLRSEAGAWRLKQLLSFALGGLLGNVFLHLLPEAWAYTCSASPGGEGQSLQQQQQLGLWVIAGILTFLALEKMFLDSKEEGTSQAPNKDPTAAAAALNGGHCLAQPAAEPGLGAVVRSIKVSGYLNLLANTIDNFTHGLAVAASFLVSKKVRG

SEQ ID NO: 81611 - protein, 325 aa, Homo sapiens
  Payload ID: 16262
  Gene Symbol: SLC39A13
  Gene Name: solute carrier family 39 (zinc transporter), member 13
  ENSP ID: ENSP00000434290
MPGCPCPGCGMAGPRLLFLTALALELLERAGGSQPALRSRGTATACRLDNKESESWGALLSGERLDTWICSLLGSLMVGLSGVFPLLVIPLEMGTMLRSEAGAWRLKQLLSFALGGLLGNVFLHLLPEAWAYTCSASPGGEGQSLQQQQQLGLWVIAGILTFLALEKMFLDSKEEGTSQAPNKDPTAAAAALNGGHCLAQPAAEPGLGAVVRSIKVSGYLNLLANTIDNFTHGLAVAASFLVSKKIGLLTTMAILLHEIPHEVGDFAILLRAGFDRWSAAKLQLSTALGGLLGAGFAICTQSPKGRRRQPGSCPSPLAAFSTSPW

SEQ ID NO: 81612 - protein, 258 aa, Homo sapiens
  Payload ID: 16262
  Gene Symbol: SLC39A13
  Gene Name: solute carrier family 39 (zinc transporter), member 13
  ENSP ID: ENSP00000434684
MPGCPCPGCGMAGPRLLFLTALALELLERAGGSQPALRSRGTATACRLDNKESESWGALLSGERLDTWICSLLGSLMVGLSGVFPLLVIPLEMGTMLRSEAGAWRLKQLLSFALGGLLGNVFLHLLPEAWAYTCSASPGGEGQSLQQQQQLGLWVIAGILTFLALEKMFLDSKEEGTSQVSGYLNLLANTIDNFTHGLAVAASFLVSKKIGLLTTMAILLHEIPHEVGDFAILLRAGFDRWSAAKLQLSTALGGLLGA

SEQ ID NO: 81613 - protein, 138 aa, Homo sapiens
  Payload ID: 16262
  Gene Symbol: SLC39A13
  Gene Name: solute carrier family 39 (zinc transporter), member 13
  ENSP ID: ENSP00000435076
MPGCPCPGCGMAGPRLLFLTALALELLERAGGSQPALRSRGTATACRLDNKESESWGALLSGERLDTWICSLLGSLMVGLSGVFPLLVIPLEMGTMLRSEAGAWRLKQLLSFALGGLLGNVFLHLLPEAWAYTCSASP

SEQ ID NO: 81614 - protein, 140 aa, Homo sapiens
  Payload ID: 16262
  Gene Symbol: SLC39A13
  Gene Name: solute carrier family 39 (zinc transporter), member 13
  ENSP ID: ENSP00000435845
MPGCPCPGCGMAGPRLLFLTALALELLERAGGSQPALRSRGTATACRLDNKESESWGALLSGERLDTWICSLLGSLMVGLSGVFPLLVIPLEMGTMLRSEAGAWRLKQLLSFALGGLLGNVFLHLLPEAWAYTCSASPGK

SEQ ID NO: 81615 - protein, 321 aa, Homo sapiens
  Payload ID: 16262
  Gene Symbol: SLC39A13
  Gene Name: solute carrier family 39 (zinc transporter), member 13
  ENSP ID: ENSP00000437186
MPGCPCPGCGMAGPRLLFLTALALELLERAGGSQPALRSRGTATACRLDNKESESWGALLSGERLDTWICSLLGSLMVGLSGVFPLLVIPLEMGTMLRSEAGAWRLKQLLSFALGGLLGNVFLHLLPEAWAYTCSASPGGEGQSLQQQQQLGLWVIAGILTFLALEKMFLDSKEEGTSQAPNKDPTAAAAALNGGHCLAQPAAEPGLGAVVRSIKVSGYLNLLANTIDNFTHGLAVAASFLVSKKVRGLGPVGLWRFQWQPCGFHLCLESLLLAPPLPAPSSKALIPHPPCCCPGRHCSLILSPWSVPVPSTPCWVPLSSC

SEQ ID NO: 81616 - protein, 481 aa, Homo sapiens
  Payload ID: 16263
  Gene Symbol: SLC39A14
  Gene Name: solute carrier family 39 (zinc transporter), member 14
  Uniprot ID: Q15043
  ENSP ID: ENSP00000240095
MKLLLLHPAFQSCLLLTLLGLWRTTPEAHASSLGAPAISAASFLQDLIHRYGEGDSLTLQQLKALLNHLDVGVGRGNVTQHVQGHRNLSTCFSSGDLFTAHNFSEQSRIGSSELQEFCPTILQQLDSRACTSENQENEENEQTEEGRPSAVEVWGYGLLCVTVISLCSLLGASVVPFMKKTFYKRLLLYFIALAIGTLYSNALFQLIPEAFGFNPLEDYYVSKSAVVFGGFYLFFFTEKILKILLKQKNEHHHGHSHYASESLPSKKDQEEGVMEKLQNGDLDHMIPQHCSSELDGKAPMVDEKVIVGSLSVQDLQASQSACYWLKGVRYSDIGTLAWMITLSDGLHNFIDGLAIGASFTVSVFQGISTSVAILCEEFPHELGDFVILLNAGMSIQQALFFNFLSACCCYLGLAFGILAGSHFSANWIFALAGGMFLYISLADMMEFCSVAQAGVQWCHLSSLQPLPLGLKRLSCLSLPSN

SEQ ID NO: 81617 - protein, 492 aa, Homo sapiens
  Payload ID: 16263
  Gene Symbol: SLC39A14
  Gene Name: solute carrier family 39 (zinc transporter), member 14
  Uniprot ID: Q15043
  ENSP ID: ENSP00000289952
MKLLLLHPAFQSCLLLTLLGLWRTTPEAHASSLGAPAISAASFLQDLIHRYGEGDSLTLQQLKALLNHLDVGVGRGNVTQHVQGHRNLSTCFSSGDLFTAHNFSEQSRIGSSELQEFCPTILQQLDSRACTSENQENEENEQTEEGRPSAVEVWGYGLLCVTVISLCSLLGASVVPFMKKTFYKRLLLYFIALAIGTLYSNALFQLIPEAFGFNPLEDYYVSKSAVVFGGFYLFFFTEKILKILLKQKNEHHHGHSHYASESLPSKKDQEEGVMEKLQNGDLDHMIPQHCSSELDGKAPMVDEKVIVGSLSVQDLQASQSACYWLKGVRYSDIGTLAWMITLSDGLHNFIDGLAIGASFTVSVFQGISTSVAILCEEFPHELGDFVILLNAGMSIQQALFFNFLSACCCYLGLAFGILAGSHFSANWIFALAGGMFLYISLADMFPEMNEVCQEDERKGSILIPFIIQNLGLLTGFTIMVVLTMYSGQIQIG

SEQ ID NO: 81618 - protein, 492 aa, Homo sapiens
  Payload ID: 16263
  Gene Symbol: SLC39A14
  Gene Name: solute carrier family 39 (zinc transporter), member 14
  Uniprot ID: Q15043
  ENSP ID: ENSP00000352779
MKLLLLHPAFQSCLLLTLLGLWRTTPEAHASSLGAPAISAASFLQDLIHRYGEGDSLTLQQLKALLNHLDVGVGRGNVTQHVQGHRNLSTCFSSGDLFTAHNFSEQSRIGSSELQEFCPTILQQLDSRACTSENQENEENEQTEEGRPSAVEVWGFGFLSVSLINLASLLGVLVLPCTEKAFFSRVLTYFIALSIGTLLSNALFQLIPEAFGFNPLEDYYVSKSAVVFGGFYLFFFTEKILKILLKQKNEHHHGHSHYASESLPSKKDQEEGVMEKLQNGDLDHMIPQHCSSELDGKAPMVDEKVIVGSLSVQDLQASQSACYWLKGVRYSDIGTLAWMITLSDGLHNFIDGLAIGASFTVSVFQGISTSVAILCEEFPHELGDFVILLNAGMSIQQALFFNFLSACCCYLGLAFGILAGSHFSANWIFALAGGMFLYISLADMFPEMNEVCQEDERKGSILIPFIIQNLGLLTGFTIMVVLTMYSGQIQIG

SEQ ID NO: 81619 - protein, 492 aa, Homo sapiens; identical to SEQ ID NO: 81617
  Payload ID: 16263
  Gene Symbol: SLC39A14
  Gene Name: solute carrier family 39 (zinc transporter), member 14
  Uniprot ID: Q15043
  ENSP ID: ENSP00000370635

SEQ ID NO: 81620 - protein, 201 aa, Homo sapiens
  Payload ID: 16263
  Gene Symbol: SLC39A14
  Gene Name: solute carrier family 39 (zinc transporter), member 14
  ENSP ID: ENSP00000427981
MKKTFYKRLLLYFIALAIGTLYSNALFQLIPEAFGFNPLEDYYVSKSAVVFGGFYLFFFTEKILKILLKQKNEHHHGHSHYASESLPSKKDQEEGVMEKLQNGDLDHMIPQHCSSELDGKAPMVDEKVIVGSLSVQDLQASQSACYWLKGVRYSDIGTLAWMITLSDGLHNFIDGLAIGASFTVSVFQGISTSVAILCEEF

SEQ ID NO: 81621 - protein, 90 aa, Homo sapiens
  Payload ID: 16263
  Gene Symbol: SLC39A14
  Gene Name: solute carrier family 39 (zinc transporter), member 14
  ENSP ID: ENSP00000428789
MKLLLLHPAFQSCLLLTLLGLWRTTPEAHASSLGAPAISAASFLQDLIHRYGEGDSLTLQQLKALLNHLDVGVGRGNVTQHVQGHRNLST

SEQ ID NO: 81622 - protein, 53 aa, Homo sapiens
  Payload ID: 16263
  Gene Symbol: SLC39A14
  Gene Name: solute carrier family 39 (zinc transporter), member 14
  ENSP ID: ENSP00000428905
MKLLLLHPAFQSCLLLTLLGLWRTTPEAHASSLGAPAISAASFLQDLIHRYGE

SEQ ID NO: 81623 - protein, 155 aa, Homo sapiens
  Payload ID: 16263
  Gene Symbol: SLC39A14
  Gene Name: solute carrier family 39 (zinc transporter), member 14
  ENSP ID: ENSP00000429328
MKLLLLHPAFQSCLLLTLLGLWRTTPEAHASSLGAPAISAASFLQDLIHRYGEGDSLTLQQLKALLNHLDVGVGRGNVTQHVQGHRNLSTCFSSGDLFTAHNFSEQSRIGSSELQEFCPTILQQLDSRACTSENQENEENEQTEEGRPSAVEVWG

SEQ ID NO: 81624 - protein, 89 aa, Homo sapiens
  Payload ID: 16263
  Gene Symbol: SLC39A14
  Gene Name: solute carrier family 39 (zinc transporter), member 14
  ENSP ID: ENSP00000430315
MKLLLLHPAFQSCLLLTLLGLWRTTPEAHASSLGAPAISAASFLQDLIHRYGEGDSLTLQQLKALLNHLDVGVGRGNVTQHVQGHRNLS

SEQ ID NO: 81625 - protein, 127 aa, Homo sapiens
  Payload ID: 16263
  Gene Symbol: SLC39A14
  Gene Name: solute carrier family 39 (zinc transporter), member 14
  ENSP ID: ENSP00000430564
MKLLLLHPAFQSCLLLTLLGLWRTTPEAHASSLGAPAISAASFLQDLIHRYGEGDSLTLQQLKALLNHLDVGVGRGNVTQHVQGHRNLSTCFSSGDLFTAHNFSEQSRIGSSELQEFCPTILQQLDS

SEQ ID NO: 81626 - protein, 122 aa, Homo sapiens
  Payload ID: 16263
  Gene Symbol: SLC39A14
  Gene Name: solute carrier family 39 (zinc transporter), member 14
  ENSP ID: ENSP00000430629
MKLLLLHPAFQSCLLLTLLGLWRTTPEAHASSLGAPAISAASFLQDLIHRYGEGDSLTLQQLKALLNHLDVGVGRGNVTQHVQGHRNLSTCFSSGDLFTAHNFSEQSRIGSSELQEFCPTIL

SEQ ID NO: 81627 - protein, 309 aa, Homo sapiens
  Payload ID: 16264
  Gene Symbol: SLC39A2
  Gene Name: solute carrier family 39 (zinc transporter), member 2
  Uniprot ID: Q9NP94
  ENSP ID: ENSP00000298681
MEQLLGIKLGCLFALLALTLGCGLTPICFKWFQIDAARGHHRLVLRLLGCISAGVFLGAGFMHMTAEALEEIESQIQKFMVQNRSASERNSSGDADSAHMEYPYGELIISLGFFFVFFLESLALQCCPGAAGGSTVQDEEWGGAHIFELHSHGHLPSPSKGPLRALVLLLSLSFHSVFEGLAVGLQPTVAATVQLCLAVLAHKGLVVFGVGMRLVHLGTSSRWAVFSILLLALMSPLGLAVGLAVTGGDSEGGRGLAQAVLEGVAAGTFLYVTFLEILPRELASPEAPLAKWSCVAAGFAFMAFIALWA

SEQ ID NO: 81628 - protein, 85 aa, Homo sapiens
  Payload ID: 16264
  Gene Symbol: SLC39A2
  Gene Name: solute carrier family 39 (zinc transporter), member 2
  Uniprot ID: Q9NP94
  ENSP ID: ENSP00000452568
MEQLLGIKLGCLFALLALTLGCGLTPICFKWFQIDAARGHHRLVLRLLGCISAGVFLGAGFMHMTAEALEEIESQIQKFMVQISK

SEQ ID NO: 81629 - protein, 314 aa, Homo sapiens
  Payload ID: 16265
  Gene Symbol: SLC39A3
  Gene Name: solute carrier family 39 (zinc transporter), member 3
  Uniprot ID: Q9BRY0
  ENSP ID: ENSP00000269740
MVKLLVAKILCMVGVFFFMLLGSLLPVKIIETDFEKAHRSKKILSLCNTFGGGVFLATCFNALLPAVREKLQKVLSLGHISTDYPLAETILLLGFFMTVFLEQLILTFRKEKPSFIDLETFNAGSDVGSDSEYESPFMGGARGHALYVEPHGHGPSLSVQGLSRASPVRLLSLAFALSAHSVFEGLALGLQEEGEKVVSLFVGVAVHETLVAVALGISMARSAMPLRDAAKLAVTVSAMIPLGIGLGLGIESAQGVPGSVASVLLQGLAGGTFLFITFLEILAKELEEKSDRLLKVLFLVLGYTVLAGMVFLKW

SEQ ID NO: 81630 - protein, 105 aa, Homo sapiens
  Payload ID: 16265
  Gene Symbol: SLC39A3
  Gene Name: solute carrier family 39 (zinc transporter), member 3
  Uniprot ID: Q9BRY0
  ENSP ID: ENSP00000393715
MVKLLVAKILCMVGVFFFMLLGSLLPVKIIETDFEKAHRSKKILSLCNTFGGGVFLATCFNALLPAVREKVRAPWALAAALGTLWPRDSDAFSTLMPSSVKALML

SEQ ID NO: 81631 - protein, 323 aa, Homo sapiens
  Payload ID: 16265
  Gene Symbol: SLC39A3
  Gene Name: solute carrier family 39 (zinc transporter), member 3
  ENSP ID: ENSP00000445345
MVKLLVAKILCMVGVFFFMLLGSLLPVKIIETDFEKAHRSKKILSLCNTFGGGVFLATCFNALLPAVREKLQKVLSLGHISTDYPLAETILLLGFFMTVFLEQLILTFRKEKPSFIDLETFNAGSDVGSDSEYESPFMGGARGHALYVEPHGHGPSLSVQGLSRASPVRLLSLAFALSAHSVFEGLALGLQEEGEKVVSLFVGVAVHETLVAVALGISMARSAMPLRDAAKLAVTVSAMIPLGIGLGLGIESAQGVPGSVASVLLQGLAGGTFLFITFLEILAKELEEKSDRLLKVLFLVLGYTVLAGMVFLKWISPPEPRVS

SEQ ID NO: 81632 - protein, 136 aa, Homo sapiens
  Payload ID: 16265
  Gene Symbol: SLC39A3
  Gene Name: solute carrier family 39 (zinc transporter), member 3
  ENSP ID: ENSP00000465383
MVKLLVAKILCMVGVFFFMLLGSLLPVKIIETDFEKAHRSKKILSLCNTFGGGVFLATCFNALLPAVREKLQKVLSLGHISTDYPLAETILLLGFFMTVFLEQLILTFRKEKPSFIDLETFNAGSDVGSDSEYESP

SEQ ID NO: 81633 - protein, 107 aa, Homo sapiens
  Payload ID: 16265
  Gene Symbol: SLC39A3
  Gene Name: solute carrier family 39 (zinc transporter), member 3
  ENSP ID: ENSP00000466969
MVKLLVAKILCMVGVFFFMLLGSLLPVKIIETDFEKAHRSKKILSLCNTFGGGVFLATCFNALLPAVREKLQKVLSLGHISTDYPLAETILLLGFFMTVFLEQLILT

SEQ ID NO: 81634 - protein, 622 aa, Homo sapiens
  Payload ID: 16266
  Gene Symbol: SLC39A4
  Gene Name: solute carrier family 39 (zinc transporter), member 4
  ENSP ID: ENSP00000276833
MVDVVGLERETGPRGSPWPGLPLPSLVGPAPLLTCLCPQCLSVEDALGLGEPEGSGLPPGPVLEARYVARLSAAAVLYLSNPEGTCEDARAGLWASHADHLLALLESPKALTPGLSWLLQRMQARAAGQTPKMACVDIPQLLEEAVGAGAPGSAGGVLAALLDHVRSGSCFHALPSPQYFVDFVFQQHSSEVPMTLAELSALMQRLGVGREAHSDHSHRHRGASSRDPVPLISSSNSSSVWDTVCLSARDVMAAYGLSEQAGVTPEAWAQLSPALLQQQLSGACTSQSRPPVQDQLSQSERYLYGSLATLLICLCAVFGLLLLTCTGCRGVTHYILQTFLSLAVGAVTGDAVLHLTPKVLGLHTHSEEGLSPQPTWRLLAMLAGLYAFFLFENLFNLLLPRDPEDLEDGPCGHSSHSHGGHSHGVSLQLAPSELRQPKPPHEGSRADLVAEESPELLNPEPRRLSPELRLLPYMITLGDAVHNFADGLAVGAAFASSWKTGLATSLAVFCHELPHELGDFAALLHAGLSVRQALLLNLASALTAFAGLYVALAVGVSEESEAWILAVATGLFLYVALCDMLPAMLKVRDPRPWLLFLLHNVGLLGGWTVLLLLSLYEDDITF

SEQ ID NO: 81635 - protein, 647 aa, Homo sapiens
  Payload ID: 16266
  Gene Symbol: SLC39A4
  Gene Name: solute carrier family 39 (zinc transporter), member 4
  Uniprot ID: Q6P5W5
  ENSP ID: ENSP00000301305
MASLVSLELGLLLAVLVVTATASPPAGLLSLLTSGQGALDQEALGGLLNTLADRVHCANGPCGKCLSVEDALGLGEPEGSGLPPGPVLEARYVARLSAAAVLYLSNPEGTCEDARAGLWASHADHLLALLESPKALTPGLSWLLQRMQARAAGQTPKMACVDIPQLLEEAVGAGAPGSAGGVLAALLDHVRSGSCFHALPSPQYFVDFVFQQHSSEVPMTLAELSALMQRLGVGREAHSDHSHRHRGASSRDPVPLISSSNSSSVWDTVCLSARDVMAAYGLSEQAGVTPEAWAQLSPALLQQQLSGACTSQSRPPVQDQLSQSERYLYGSLATLLICLCAVFGLLLLTCTGCRGVTHYILQTFLSLAVGAVTGDAVLHLTPKVLGLHTHSEEGLSPQPTWRLLAMLAGLYAFFLFENLFNLLLPRDPEDLEDGPCGHSSHSHGGHSHGVSLQLAPSELRQPKPPHEGSRADLVAEESPELLNPEPRRLSPELRLLPYMITLGDAVHNFADGLAVGAAFASSWKTGLATSLAVFCHELPHELGDFAALLHAGLSVRQALLLNLASALTAFAGLYVALAVGVSEESEAWILAVATGLFLYVALCDMLPAMLKVRDPRPWLLFLLHNVGLLGGWTVLLLLSLYEDDITF

SEQ ID NO: 81636 - protein, 184 aa, Homo sapiens
  Payload ID: 16266
  Gene Symbol: SLC39A4
  Gene Name: solute carrier family 39 (zinc transporter), member 4
  ENSP ID: ENSP00000434512
MASLVSLELGLLLAVLVVTATASPPAGLLSLLTSGQGALDQEALGGLLNTLADRVHCANGPCGKACVDIPQLLEEAVGAGAPGSAGGVLAALLDHVRSGSCFHALPSPQYFVDFVFQQHSSEVPMTLAELSALMQRLGVGREAHSDHSHRHRGASSRDPVPLISSSNSSSVWDTVCLSARDVMA

SEQ ID NO: 81637 - protein, 540 aa, Homo sapiens
  Payload ID: 16267
  Gene Symbol: SLC39A5
  Gene Name: solute carrier family 39 (zinc transporter), member 5
  Uniprot ID: Q6ZMH5
  ENSP ID: ENSP00000266980
MMGSPVSHLLAGFCVWVVLGWVGGSVPNLGPAEQEQNHYLAQLFGLYGENGTLTAGGLARLLHSLGLGRVQGLRLGQHGPLTGRAASPAADNSTHRPQNPELSVDVWAGMPLGPSGWGDLEESKAPHLPRGPAPSGLDLLHRLLLLDHSLADHLNEDCLNGSQLLVNFGLSPAAPLTPRQFALLCPALLYQIDSRVCIGAPAPAPPGDLLSALLQSALAVLLLSLPSPLSLLLLRLLGPRLLRPLLGFLGALAVGTLCGDALLHLLPHAQEGRHAGPGGLPEKDLGPGLSVLGGLFLLFVLENMLGLLRHRGLRPRCCRRKRRNLETRNLDPENGSGMALQPLQAAPEPGAQGQREKNSQHPPALAPPGHQGHSHGHQGGTDITWMVLLGDGLHNLTDGLAIGAAFSDGFSSGLSTTLAVFCHELPHELGDFAMLLQSGLSFRRLLLLSLVSGALGLGGAVLGVGLSLGPVPLTPWVFGVTAGVFLYVALVDMLPALLRPPEPLPTPHVLLQGLGLLLGGGLMLAITLLEERLLPVTTEG

SEQ ID NO: 81638 - protein, 239 aa, Homo sapiens
  Payload ID: 16267
  Gene Symbol: SLC39A5
  Gene Name: solute carrier family 39 (zinc transporter), member 5
  ENSP ID: ENSP00000391711
MMGSPEQNHYLAQLFGLYGENGTLTAGGLARLLHSLGLGRVQGLRLGQHGPLTGRAASPAADNSTHRPQNPELSVDVWAGMPLGPSGWGDLEESKAPHLPRGPAPSGLDLLHRLLLLDHSLADHLNEDCLNGSQLLVNFGLSPAAPLTPRQFALLCPALLYQIDSRVCIGAPAPAPPGDLLSALLQSALAVLLLSLPSPLSLLLLRLLGPRLLRPLLGFLGALAVGTLCGDALLHLLPH

SEQ ID NO: 81639 - protein, 156 aa, Homo sapiens
  Payload ID: 16267
  Gene Symbol: SLC39A5
  Gene Name: solute carrier family 39 (zinc transporter), member 5
  ENSP ID: ENSP00000402891
MMGSPVSHLLAGFCVWVVLGWVGGSVPNLGPAEQEQNHYLAQLFGLYGENGTLTAGGLARLLHSLGLGRVQGLRLGQHGPLTGRAASPAADNSTHRPQNPELSVDVWAGMPLGPSGWGDLEESKAPHLPRGPAPSGLDLLHRLLLLDHSLADHLNE

SEQ ID NO: 81640 - protein, 123 aa, Homo sapiens
  Payload ID: 16267
  Gene Symbol: SLC39A5
  Gene Name: solute carrier family 39 (zinc transporter), member 5
  ENSP ID: ENSP00000404155
MMGSPVSHLLAGFCVWVVLGWVGGSVPNLGPAEQEQNHYLAQLFGLYGENGTLTAGGLARLLHSLGLGRVQGLRLGQHGPLTGRAASPAADNSTHRPQNPELSVDVWAGMPLGPSGWGDLEES

SEQ ID NO: 81641 - protein, 540 aa, Homo sapiens; identical to SEQ ID NO: 81637
  Payload ID: 16267
  Gene Symbol: SLC39A5
  Gene Name: solute carrier family 39 (zinc transporter), member 5
  Uniprot ID: Q6ZMH5
  ENSP ID: ENSP00000405360

SEQ ID NO: 81642 - protein, 126 aa, Homo sapiens
  Payload ID: 16267
  Gene Symbol: SLC39A5
  Gene Name: solute carrier family 39 (zinc transporter), member 5
  ENSP ID: ENSP00000407399
MMGSPVSHLLAGFCVWVVLGWVGGSVPNLGPAEQEQNHYLAQLFGLYGENGTLTAGGLARLLHSLGLGRVQGLRLGQHGPLTGRAASPAADNSTHRPQNPELSVDVWAGMPLGPSGWGDLEESKAP

SEQ ID NO: 81643 - protein, 128 aa, Homo sapiens
  Payload ID: 16267
  Gene Symbol: SLC39A5
  Gene Name: solute carrier family 39 (zinc transporter), member 5
  ENSP ID: ENSP00000414868
MMGSPVSHLLAGFCVWVVLGWVGGSVPNLGPAEQEQNHYLAQLFGLYGENGTLTAGGLARLLHSLGLGRVQGLRLGQHGPLTGRAASPAADNSTHRPQNPELSVDVWAGMPLGPSGWGDLEESKAPHL

SEQ ID NO: 81644 - protein, 755 aa, Homo sapiens
  Payload ID: 16268
  Gene Symbol: SLC39A6
  Gene Name: solute carrier family 39 (zinc transporter), member 6
  Uniprot ID: Q13433
  ENSP ID: ENSP00000269187
MARKLSVILILTFALSVTNPLHELKAAAFPQTTEKISPNWESGINVDLAISTRQYHLQQLFYRYGENNSLSVEGFRKLLQNIGIDKIKRIHIHHDHDHHSDHEHHSDHERHSDHEHHSEHEHHSDHDHHSHHNHAASGKNKRKALCPDHDSDSSGKDPRNSQGKGAHRPEHASGRRNVKDSVSASEVTSTVYNTVSEGTHFLETIETPRPGKLFPKDVSSSTPPSVTSKSRVSRLAGRKTNESVSEPRKGFMYSRNTNENPQECFNASKLLTSHGMGIQVPLNATEFNYLCPAIINQIDARSCLIHTSEKKAEIPPKTYSLQIAWVGGFIAISIISFLSLLGVILVPLMNRVFFKFLLSFLVALAVGTLSGDAFLHLLPHSHASHHHSHSHEEPAMEMKRGPLFSHLSSQNIEESAYFDSTWKGLTALGGLYFMFLVEHVLTLIKQFKDKKKKNQKKPENDDDVEIKKQLSKYESQLSTNEEKVDTDDRTEGYLRADSQEPSHFDSQQPAVLEEEEVMIAHAHPQEVYNEYVPRGCKNKCHSHFHDTLGQSDDLIHHHHDYHHILHHHHHQNHHPHSHSQRYSREELKDAGVATLAWMVIMGDGLHNFSDGLAIGAAFTEGLSSGLSTSVAVFCHELPHELGDFAVLLKAGMTVKQAVLYNALSAMLAYLGMATGIFIGHYAENVSMWIFALTAGLFMYVALVDMVPEMLHNDASDHGCSRWGYFFLQNAGMLLGFGIMLLISIFEHKIVFRINF

SEQ ID NO: 81645 - protein, 433 aa, Homo sapiens
  Payload ID: 16268
  Gene Symbol: SLC39A6
  Gene Name: solute carrier family 39 (zinc transporter), member 6
  Uniprot ID: Q13433
  ENSP ID: ENSP00000401139
MGIQVPLNATEFNYLCPAIINQIDARSCLIHTSEKKAEIPPKTYSLQIAWVGGFIAISIISFLSLLGVILVPLMNRVFFKFLLSFLVALAVGTLSGDAFLHLLPHSHASHHHSHSHEEPAMEMKRGPLFSHLSSQNIEESAYFDSTWKGLTALGGLYFMFLVEHVLTLIKQFKDKKKKNQKKPENDDDVEIKKQLSKYESQLSTNEEKVDTDDRTEGYLRADSQEPSHFDSQQPAVLEEEEVMIAHAHPQEVYNEYVPRGCKNKCHSHFHDTLGQSDDLIHHHHDYHHILHHHHHQNHHPHSHSQRYSREELKDAGVATLAWMVIMGDGLHNFSDGLAIGAAFTEGLSSGLSTSVAVFCHELPHELGDFAVLLKAGMTVKQAVLYNALSAMLAYLGMATGIFIGHYAENVSMWIFALTAGLFMYVALVDMVSF

SEQ ID NO: 81646 - protein, 755 aa, Homo sapiens; identical to SEQ ID NO: 81644
  Payload ID: 16268
  Gene Symbol: SLC39A6
  Gene Name: solute carrier family 39 (zinc transporter), member 6
  Uniprot ID: Q13433
  ENSP ID: ENSP00000465915

SEQ ID NO: 81647 - protein, 273 aa, Homo sapiens
  Payload ID: 16268
  Gene Symbol: SLC39A6
  Gene Name: solute carrier family 39 (zinc transporter), member 6
  ENSP ID: ENSP00000467724
MFLVEHVLTLIKQFKDKKKKNQKKPENDDDVEIKKQLSKYESQLSTNEEKVDTDDRTEGYLRADSQEPSHFDSQQPAVLEEEEVMIAHAHPQEVYNEYVPRGCKNKCHSHFHDTLGQSDDLIHHHHDYHHILHHHHHQNHHPHSHSQRYSREELKDAGVATLAWMVIMGDGLHNFSDGLAIGAAFTEGLSSGLSTSVAVFCHELPHELGDFAVLLKAGMTVKQAVLYNALSAMLAYLGMATGIFIGHYAENVSMWIFALTAGLFMYVALVDMV

SEQ ID NO: 81648 - protein, 469 aa, Homo sapiens
  Payload ID: 16269
  Gene Symbol: SLC39A7
  Gene Name: solute carrier family 39 (zinc transporter), member 7
  Uniprot ID: Q92504
  ENSP ID: ENSP00000363807
MARGLGAPHWVAVGLLTWATLGLLVAGLGGHDDLHDDLQEDFHGHSHRHSHEDFHHGHSHAHGHGHTHESIWHGHTHDHDHGHSHEDLHHGHSHGYSHESLYHRGHGHDHEHSHGGYGESGAPGIKQDLDAVTLWAYALGATVLISAAPFFVLFLIPVESNSPRHRSLLQILLSFASGGLLGDAFLHLIPHALEPHSHHTLEQPGHGHSHSGQGPILSVGLWVLSGIVAFLVVEKFVRHVKGGHGHSHGHGHAHSHTRGSHGHGRQERSTKEKQSSEEEEKETRGVQKRRGGSTVPKDGPVRPQNAEEEKRGLDLRVSGYLNLAADLAHNFTDGLAIGASFRGGRGLGILTTMTVLLHEVPHEVGDFAILVQSGCSKKQAMRLQLLTAVGALAGTACALLTEGGAVGSEIAGGAGPGWVLPFTAGGFIYVATVSVLPELLREASPLQSLLEVLGLLGGVIMMVLIAHLE

SEQ ID NO: 81649 - protein, 469 aa, Homo sapiens; identical to SEQ ID NO: 81648
  Payload ID: 16269
  Gene Symbol: SLC39A7
  Gene Name: solute carrier family 39 (zinc transporter), member 7
  Uniprot ID: Q92504
  ENSP ID: ENSP00000363809

SEQ ID NO: 81650 - protein, 469 aa, Homo sapiens; identical to SEQ ID NO: 81648
  Payload ID: 16269
  Gene Symbol: SLC39A7
  Gene Name: solute carrier family 39 (zinc transporter), member 7
  Uniprot ID: Q92504
  ENSP ID: ENSP00000372700

SEQ ID NO: 81651 - protein, 469 aa, Homo sapiens; identical to SEQ ID NO: 81648
  Payload ID: 16269
  Gene Symbol: SLC39A7
  Gene Name: solute carrier family 39 (zinc transporter), member 7
  Uniprot ID: Q92504
  ENSP ID: ENSP00000372701

SEQ ID NO: 81652 - protein, 469 aa, Homo sapiens; identical to SEQ ID NO: 81648
  Payload ID: 16269
  Gene Symbol: SLC39A7
  Gene Name: solute carrier family 39 (zinc transporter), member 7
  Uniprot ID: Q92504
  ENSP ID: ENSP00000389623

SEQ ID NO: 81653 - protein, 220 aa, Homo sapiens
  Payload ID: 16269
  Gene Symbol: SLC39A7
  Gene Name: solute carrier family 39 (zinc transporter), member 7
  ENSP ID: ENSP00000390246
MDSSLPECRHIGKGIRAKVERNFLFSRDLKAGLPRPSKPGKERIPEPALGATVLISAAPFFVLFLIPVESNSPRHRSLLQILLSFASGGLLGDAFLHLIPHALEPHSHHTLEQPGHGHSHSGQGPILSVGLWVLSGIVAFLVVEKFVRHVKGGHGHSHGHGHAHSHTRGSHGHGRQERSTKEKQSSEEEEKETRGVQKRRGGSTVPKDGPVRPQNAEEEK

SEQ ID NO: 81654 - protein, 469 aa, Homo sapiens; identical to SEQ ID NO: 81648
  Payload ID: 16269
  Gene Symbol: SLC39A7
  Gene Name: solute carrier family 39 (zinc transporter), member 7
  Uniprot ID: Q92504
  ENSP ID: ENSP00000391735

SEQ ID NO: 81655 - protein, 220 aa, Homo sapiens; identical to SEQ ID NO: 81653
  Payload ID: 16269
  Gene Symbol: SLC39A7
  Gene Name: solute carrier family 39 (zinc transporter), member 7
  ENSP ID: ENSP00000400978

SEQ ID NO: 81656 - protein, 469 aa, Homo sapiens; identical to SEQ ID NO: 81648
  Payload ID: 16269
  Gene Symbol: SLC39A7
  Gene Name: solute carrier family 39 (zinc transporter), member 7
  Uniprot ID: Q92504
  ENSP ID: ENSP00000403583

SEQ ID NO: 81657 - protein, 220 aa, Homo sapiens; identical to SEQ ID NO: 81653
  Payload ID: 16269
  Gene Symbol: SLC39A7
  Gene Name: solute carrier family 39 (zinc transporter), member 7
  ENSP ID: ENSP00000403686

SEQ ID NO: 81658 - protein, 220 aa, Homo sapiens; identical to SEQ ID NO: 81653
  Payload ID: 16269
  Gene Symbol: SLC39A7
  Gene Name: solute carrier family 39 (zinc transporter), member 7
  ENSP ID: ENSP00000404101

SEQ ID NO: 81659 - protein, 469 aa, Homo sapiens; identical to SEQ ID NO: 81648
  Payload ID: 16269
  Gene Symbol: SLC39A7
  Gene Name: solute carrier family 39 (zinc transporter), member 7
  Uniprot ID: Q92504
  ENSP ID: ENSP00000407093

SEQ ID NO: 81660 - protein, 469 aa, Homo sapiens; identical to SEQ ID NO: 81648
  Payload ID: 16269
  Gene Symbol: SLC39A7
  Gene Name: solute carrier family 39 (zinc transporter), member 7
  Uniprot ID: Q92504
  ENSP ID: ENSP00000410656

SEQ ID NO: 81661 - protein, 220 aa, Homo sapiens; identical to SEQ ID NO: 81653
  Payload ID: 16269
  Gene Symbol: SLC39A7
  Gene Name: solute carrier family 39 (zinc transporter), member 7
  ENSP ID: ENSP00000411819

SEQ ID NO: 81662 - protein, 469 aa, Homo sapiens; identical to SEQ ID NO: 81648
  Payload ID: 16269
  Gene Symbol: SLC39A7
  Gene Name: solute carrier family 39 (zinc transporter), member 7
  Uniprot ID: Q92504
  ENSP ID: ENSP00000413027

SEQ ID NO: 81663 - protein, 469 aa, Homo sapiens; identical to SEQ ID NO: 81648
  Payload ID: 16269
  Gene Symbol: SLC39A7
  Gene Name: solute carrier family 39 (zinc transporter), member 7
  Uniprot ID: Q92504
  ENSP ID: ENSP00000414145

SEQ ID NO: 81664 - protein, 469 aa, Homo sapiens; identical to SEQ ID NO: 81648
  Payload ID: 16269
  Gene Symbol: SLC39A7
  Gene Name: solute carrier family 39 (zinc transporter), member 7
  Uniprot ID: Q92504
  ENSP ID: ENSP00000416439

SEQ ID NO: 81665 - protein, 220 aa, Homo sapiens; identical to SEQ ID NO: 81653
  Payload ID: 16269
  Gene Symbol: SLC39A7
  Gene Name: solute carrier family 39 (zinc transporter), member 7
  ENSP ID: ENSP00000416566

SEQ ID NO: 81666 - protein, 429 aa, Homo sapiens
  Payload ID: 16269
  Gene Symbol: SLC39A7
  Gene Name: solute carrier family 39 (zinc transporter), member 7
  ENSP ID: ENSP00000477803
MARGLGAPHWVAVGLLTWATLGLLVAGLGGHDDLHDDLQEDFHGHSHRHSHEDFHHGHSHAHGHGHTHESIWHGHTHDHDHGHSHEDLHHGHSHGYSHESLYHRGHGHDHEHSHGGYGESGAPGIKQDLDAVTLWAYALGATVLISAAPFFVLFLIPVESNSPRHRSLLQILLSFASGGLLGDAFLHLIPHALEPHSHHTLEQPGHGHSHSGQGPILSVGLWVLSGIVAFLVVEKFVRHVKGGHGHSHGHGHAHSHTRGSHGHGRQERSTKEKQSSEEEEKETRGVQKRRGGSTVPKDGPVRPQNAEEEKRGLDLRVSGYLNLAADLAHNFTDGLAIGASFRGGRGLGILTTMTVLLHEVPHEVGDFAILVQSGCSKKQAMRLQLLTAVGALAGTAVPFSLKEEQWAVKLQVVQVLAGSCHLLQVALST

SEQ ID NO: 81667 - protein, 429 aa, Homo sapiens; identical to SEQ ID NO: 81666
  Payload ID: 16269
  Gene Symbol: SLC39A7
  Gene Name: solute carrier family 39 (zinc transporter), member 7
  ENSP ID: ENSP00000478192

SEQ ID NO: 81668 - protein, 429 aa, Homo sapiens; identical to SEQ ID NO: 81666
  Payload ID: 16269
  Gene Symbol: SLC39A7
  Gene Name: solute carrier family 39 (zinc transporter), member 7
  ENSP ID: ENSP00000479476

SEQ ID NO: 81669 - protein, 429 aa, Homo sapiens; identical to SEQ ID NO: 81666
  Payload ID: 16269
  Gene Symbol: SLC39A7
  Gene Name: solute carrier family 39 (zinc transporter), member 7
  ENSP ID: ENSP00000480222

SEQ ID NO: 81670 - protein, 429 aa, Homo sapiens; identical to SEQ ID NO: 81666
  Payload ID: 16269
  Gene Symbol: SLC39A7
  Gene Name: solute carrier family 39 (zinc transporter), member 7
  ENSP ID: ENSP00000481865

SEQ ID NO: 81671 - protein, 429 aa, Homo sapiens; identical to SEQ ID NO: 81666
  Payload ID: 16269
  Gene Symbol: SLC39A7
  Gene Name: solute carrier family 39 (zinc transporter), member 7
  ENSP ID: ENSP00000484100

SEQ ID NO: 81672 - protein, 460 aa, Homo sapiens
  Payload ID: 16270
  Gene Symbol: SLC39A8
  Gene Name: solute carrier family 39 (zinc transporter), member 8
  Uniprot ID: Q9C0K1
  ENSP ID: ENSP00000349174
MAPGRAVAGLLLLAAAGLGGVAEGPGLAFSEDVLSVFGANLSLSAAQLQHLLEQMGAASRVGVPEPGQLHFNQCLTAEEIFSLHGFSNATQITSSKFSVICPAVLQQLNFHPCEDRPKHKTRPSHSEVWGYGFLSVTIINLASLLGLILTPLIKKSYFPKILTFFVGLAIGTLFSNAIFQLIPEAFGFDPKVDSYVEKAVAVFGGFYLLFFFERMLKMLLKTYGQNGHTHFGNDNFGPQEKTHQPKALPAINGVTCYANPAVTEANGHIHFDNVSVVSLQDGKKEPSSCTCLKGPKLSEIGTIAWMITLCDALHNFIDGLAIGASCTLSLLQGLSTSIAILCEEFPHELGDFVILLNAGMSTRQALLFNFLSACSCYVGLAFGILVGNNFAPNIIFALAGGMFLYISLADMFPEMNDMLREKVTGRKTDFTFFMIQNAGMLTGFTAILLITLYAGEIELE

SEQ ID NO: 81673 - protein, 460 aa, Homo sapiens; identical to SEQ ID NO: 81672
  Payload ID: 16270
  Gene Symbol: SLC39A8
  Gene Name: solute carrier family 39 (zinc transporter), member 8
  Uniprot ID: Q9C0K1
  ENSP ID: ENSP00000378310

SEQ ID NO: 81674 - protein, 444 aa, Homo sapiens
  Payload ID: 16270
  Gene Symbol: SLC39A8
  Gene Name: solute carrier family 39 (zinc transporter), member 8
  Uniprot ID: Q9C0K1
  ENSP ID: ENSP00000394548
MAPGRAVAGLLLLAAAGLGGVAEGPGLAFSEDVLSVFGANLSLSAAQLQHLLEQMGAASRVGVPEPGQLHFNQCLTAEEIFSLHGFSNATQITSSKFSVICPAVLQQLNFHPCEDRPKHKTRPSHSEVWGYGFLSVTIINLASLLGLILTPLIKKSYFPKILTFFVGLAIGTLFSNAIFQLIPEAFGFDPKVDSYVEKAVAVFGGFYLLFFFERMLKMLLKTYGQNGHTHFGNDNFGPQEKTHQPKALPAINGVTCYANPAVTEANGHIHFDNVSVVSLQDGKKEPSSCTCLKGPKLSEIGTIAWMITLCDALHNFIDGLAIGASCTLSLLQGLSTSIAILCEEFPHELGDFVILLNAGMSTRQALLFNFLSACSCYVGLAFGILVGNNFAPNIIFALAGGMFLYISLADMFPEMNDMLREKIIKWATDDIKSQLHLLWIYTAR

SEQ ID NO: 81675 - protein, 335 aa, Homo sapiens
  Payload ID: 16271
  Gene Symbol: SLC39A11
  Gene Name: solute carrier family 39, member 11
  Uniprot ID: Q8N1S5
  ENSP ID: ENSP00000255559
MLQGHSSVFQALLGTFFTWGMTAAGAALVFVFSSGQRRILDGSLGFAAGVMLAASYWSLLAPAVEMATSSGGFGAFAFFPVAVGFTLGAAFVYLADLLMPHLGAAEDPQTTLALNFGSTLMKKKSDPEGPALLFPESELSIRIDKSENGEAYQRKKAAATGLPEGPAVPVPSRGNLAQPGGSSWRRIALLILAITIHNVPEGLAVGVGFGAIEKTASATFESARNLAIGIGIQNFPEGLAVSLPLRGAGFSTWRAFWYGQLSGMVEPLAGVFGAFAVVLAEPILPYALAFAAGAMVYVVMDDIIPEAQISGNGKLASWASILGFVVMMSLDVGLG

SEQ ID NO: 81676 - protein, 342 aa, Homo sapiens
  Payload ID: 16271
  Gene Symbol: SLC39A11
  Gene Name: solute carrier family 39, member 11
  Uniprot ID: Q8N1S5
  ENSP ID: ENSP00000445829
MLQGHSSVFQALLGTFFTWGMTAAGAALVFVFSSGQRRILDGSLGFAAGVMLAASYWSLLAPAVEMATSSGGFGAFAFFPVAVGFTLGAAFVYLADLLMPHLGAAEDPQTTLALNFGSTLMKKKSDPEGPALLFPESELSIRIGRAGLLSDKSENGEAYQRKKAAATGLPEGPAVPVPSRGNLAQPGGSSWRRIALLILAITIHNVPEGLAVGVGFGAIEKTASATFESARNLAIGIGIQNFPEGLAVSLPLRGAGFSTWRAFWYGQLSGMVEPLAGVFGAFAVVLAEPILPYALAFAAGAMVYVVMDDIIPEAQISGNGKLASWASILGFVVMMSLDVGLG

SEQ ID NO: 81677 - protein, 25 aa, Homo sapiens
  Payload ID: 16271
  Gene Symbol: SLC39A11
  Gene Name: solute carrier family 39, member 11
  ENSP ID: ENSP00000462010
MLQGHSSVFQALLGTFFTWGMTAAG

SEQ ID NO: 81678 - protein, 200 aa, Homo sapiens
  Payload ID: 16271
  Gene Symbol: SLC39A11
  Gene Name: solute carrier family 39, member 11
  ENSP ID: ENSP00000462200
MLQGHSSVFQALLGTFFTWGMTAAGAALVFVFSSGQRRILDGSLGFAAGVMLAASYWSLLAPAVEMATSSGGFGAFAFFPVAVGFTLGAAFVYLADLLMPHLGAAEDPQTTLALNFGSTLMKKKSDPEGPALLFPESELSIRIDKSENGEAYQRKKAAATGLPEGPAVPVPSRGNLAQPGGSSWRRIALLILAITIHNVP

SEQ ID NO: 81679 - protein, 124 aa, Homo sapiens
  Payload ID: 16271
  Gene Symbol: SLC39A11
  Gene Name: solute carrier family 39, member 11
  ENSP ID: ENSP00000462332
  MOD_RES (1)..(1): Any amino acid
XKSENGEAYQRKKAAATGLPEGPAVPVPSRGNLAQPGGSSWRRIALLILAITIHNVPAAACTSGDLLARRWTCLDPQCTPMAWSPTGEWTQGRGLCRPCQWSGDSTTLDGEFQRAGYPECGHIP

SEQ ID NO: 81680 - protein, 40 aa, Homo sapiens
  Payload ID: 16271
  Gene Symbol: SLC39A11
  Gene Name: solute carrier family 39, member 11
  ENSP ID: ENSP00000462816
MLQGHSSVFQALLGTFFTWGMTAAGAALVFVFSSGQRRIL

SEQ ID NO: 81681 - protein, 62 aa, Homo sapiens
  Payload ID: 16271
  Gene Symbol: SLC39A11
  Gene Name: solute carrier family 39, member 11
  ENSP ID: ENSP00000463083
AQPGGSSWRRIALLILAITIHNVPEGLAVGVGFGAIEKTASATFESARVLNLVSCPGLNLPS

SEQ ID NO: 81682 - protein, 156 aa, Homo sapiens
  Payload ID: 16271
  Gene Symbol: SLC39A11
  Gene Name: solute carrier family 39, member 11
  ENSP ID: ENSP00000463462
MLQGHSSVFQALLGTFFTWGMTAAGAALVFVFSSGQRRILDGSLGFAAGVMLAASYWSLLAPAVEMATSSGGFGAFAFFPVAVGFTLGAAFVYLADLLMPHLGAAEDPQTTLALNFGSTLMKKKSDPEGPALLFPESELSIRIGRAGLLSDKSENG

SEQ ID NO: 81683 - protein, 185 aa, Homo sapiens
  Payload ID: 16271
  Gene Symbol: SLC39A11
  Gene Name: solute carrier family 39, member 11
  ENSP ID: ENSP00000463467
MTVRPPQPCGTGAAEDPQTTLALNFGSTLMKKKSDPEGPALLFPESELSIRIGRAGLLSDKSENGEAYQRKKAAATGLPEGPAVPVPSRGNLAQPGGSSWRRIALLILAITIHNVPEGLAVGVGFGAIEKTASATFESARNLAIGIGIQNFPEGLAVSLPLRGAGFSTWRAFWYGQLSGMVEPLA

SEQ ID NO: 81684 - protein, 68 aa, Homo sapiens
  Payload ID: 16271
  Gene Symbol: SLC39A11
  Gene Name: solute carrier family 39, member 11
  ENSP ID: ENSP00000463822
  MOD_RES (1)..(1): Any amino acid
XRKKAAATGLPEGPAVPVPSRGNLAQPGGSSWRRIALLILAITIHNVPGRVCFTFCHDCKFPEASPAV

SEQ ID NO: 81685 - protein, 81 aa, Homo sapiens
  Payload ID: 16271
  Gene Symbol: SLC39A11
  Gene Name: solute carrier family 39, member 11
  ENSP ID: ENSP00000464302
MTVRPPQPCGTGAAEDPQTTLALNFGSTLMKKKSDPEGPALLFPESELSIRIGRAGLLSGKLFAADTELSQAIWTWGLVVG

SEQ ID NO: 81686 - protein, 227 aa, Homo sapiens
  Payload ID: 16271
  Gene Symbol: SLC39A11
  Gene Name: solute carrier family 39, member 11
  ENSP ID: ENSP00000464525
MLQGHSSVFQALLGTFFTWGMTAAGAALVFVFSSGQRRILDGSLGFAAGVMLAASYWSLLAPAVEMATSSGGFGAFAFFPVAVGFTLGAAFVYLADLLMPHLGAAEDPQTTLALNFGSTLMKKKSDPEGPALLFPESELSIRIDKSENGEAYQRKKAAATGLPEGPAVPVPSRGNLAQPGGSSWRRIALLILAITIHNVPVETRVLLCWPGWPRTAGLKRTSCFSLP

SEQ ID NO: 81687 - protein, 24 aa, Homo sapiens
  Payload ID: 16271
  Gene Symbol: SLC39A11
  Gene Name: solute carrier family 39, member 11
  ENSP ID: ENSP00000487926
AQPGGSSWRRIALLILAITIHNVP

SEQ ID NO: 81688 - protein, 57 aa, Homo sapiens
  Payload ID: 16271
  Gene Symbol: SLC39A11
  Gene Name: solute carrier family 39, member 11
  ENSP ID: ENSP00000488068
  MOD_RES (1)..(1): Any amino acid
XKSENGEAYQRKKAAATGLPEGPAVPVPSRGNLAQPGGSSWRRIALLILAITIHNVP

SEQ ID NO: 81689 - protein, 57 aa, Homo sapiens; identical to SEQ ID NO: 81688
  Payload ID: 16271
  Gene Symbol: SLC39A11
  Gene Name: solute carrier family 39, member 11
  ENSP ID: ENSP00000488364
  MOD_RES (1)..(1): Any amino acid

SEQ ID NO: 81690 - protein, 57 aa, Homo sapiens; identical to SEQ ID NO: 81688
  Payload ID: 16271
  Gene Symbol: SLC39A11
  Gene Name: solute carrier family 39, member 11
  ENSP ID: ENSP00000488585
  MOD_RES (1)..(1): Any amino acid

SEQ ID NO: 81691 - protein, 84 aa, Homo sapiens
  Payload ID: 16271
  Gene Symbol: SLC39A11
  Gene Name: solute carrier family 39, member 11
  ENSP ID: ENSP00000488593
  MOD_RES (1)..(1): Any amino acid
XKSENGEAYQRKKAAATGLPEGPAVPVPSRGNLAQPGGSSWRRIALLILAITIHNVPVETRVLLCWPGWPRTAGLKRTSCFSLP

SEQ ID NO: 81692 - protein, 48 aa, Homo sapiens
  Payload ID: 16271
  Gene Symbol: SLC39A11
  Gene Name: solute carrier family 39, member 11
  ENSP ID: ENSP00000488612
  MOD_RES (1)..(1): Any amino acid
XRKKAAATGLPEGPAVPVPSRGNLAQPGGSSWRRIALLILAITIHNVP

SEQ ID NO: 81693 - protein, 57 aa, Homo sapiens; identical to SEQ ID NO: 81688
  Payload ID: 16271
  Gene Symbol: SLC39A11
  Gene Name: solute carrier family 39, member 11
  ENSP ID: ENSP00000488656
  MOD_RES (1)..(1): Any amino acid

SEQ ID NO: 81694 - protein, 6 aa, Homo sapiens
  Payload ID: 16271
  Gene Symbol: SLC39A11
  Gene Name: solute carrier family 39, member 11
  ENSP ID: ENSP00000488841
  MOD_RES (1)..(1): Any amino acid
XKSENG

SEQ ID NO: 81695 - protein, 57 aa, Homo sapiens; identical to SEQ ID NO: 81688
  Payload ID: 16271
  Gene Symbol: SLC39A11
  Gene Name: solute carrier family 39, member 11
  ENSP ID: ENSP00000488858
  MOD_RES (1)..(1): Any amino acid

SEQ ID NO: 81696 - protein, 307 aa, Homo sapiens
  Payload ID: 16272
  Gene Symbol: SLC39A9
  Gene Name: solute carrier family 39, member 9
  Uniprot ID: Q9NUM3
  ENSP ID: ENSP00000336887
MDDFISISLLSLAMLVGCYVAGIIPLAVNFSEERLKLVTVLGAGLLCGTALAVIVPEGVHALYEDILEGKHHQASETHNVIASDKAAEKSVVHEHEHSHDHTQLHAYIGVSLVLGFVFMLLVDQIGNSHVHSTDDPEAARSSNSKITTTLGLVVHAAADGVALGAAASTSQTSVQLIVFVAIMLHKAPAAFGLVSFLMHAGLERNRIRKHLLVFALAAPVMSMVTYLGLSKSSKEALSEVNATGVAMLFSAGTFLYVATVHVLPEVGGIGHSHKPDATGGRGLSRLEVAALVLGCLIPLILSVGHQH

SEQ ID NO: 81697 - protein, 307 aa, Homo sapiens; identical to SEQ ID NO: 81696
  Payload ID: 16272
  Gene Symbol: SLC39A9
  Gene Name: solute carrier family 39, member 9
  Uniprot ID: Q9NUM3
  ENSP ID: ENSP00000450639

SEQ ID NO: 81698 - protein, 284 aa, Homo sapiens
  Payload ID: 16272
  Gene Symbol: SLC39A9
  Gene Name: solute carrier family 39, member 9
  Uniprot ID: Q9NUM3
  ENSP ID: ENSP00000451833
MDDFISISLLSLAMLVGCYVAGIIPLAVNFSEERLKLVTVLGAGLLCGTALAVIVPEGVHALYEDILEGKHHQASETHNVIASDKAAEKSVVHEHEHSHDHTQLHAYIGVSLVLGFVFMLLVDQIGNSHVHSTDADGVALGAAASTSQTSVQLIVFVAIMLHKAPAAFGLVSFLMHAGLERNRIRKHLLVFALAAPVMSMVTYLGLSKSSKEALSEVNATGVAMLFSAGTFLYVATVHVLPEVGGIGHSHKPDATGGRGLSRLEVAALVLGCLIPLILSVGHQH

SEQ ID NO: 81699 - protein, 232 aa, Homo sapiens
  Payload ID: 16272
  Gene Symbol: SLC39A9
  Gene Name: solute carrier family 39, member 9
  Uniprot ID: Q9NUM3
  ENSP ID: ENSP00000452385
MDDFISISLLSLAMLVGCYVAGIIPLAVNFSEERLKLVTVLGAGLLCGTALAVIVPEGVHALYEDILEGKHHQASETHNVIASDKAAEKSVVHEHEHSHDHTQLHAYIGVSLVLGFVFMLLVDQIGNSHVHSTDDPEAARSSNSKITTTLGLVVHAAADGVALGAAASTSQTSVQLIVFVAIMLHKAPAAFGLVSFLMHAGLERNRIRKHLLVFALAAPVMSMVTYLGLSKD

SEQ ID NO: 81700 - protein, 241 aa, Homo sapiens
  Payload ID: 16272
  Gene Symbol: SLC39A9
  Gene Name: solute carrier family 39, member 9
  ENSP ID: ENSP00000468864
MDDFISISLLSLAMLVGCYVAGIIPLAVNFSEERLKLVTVLGAGLLCGTALAVIVPEGVHALYEDILEDPEAARSSNSKITTTLGLVVHAAADGVALGAAASTSQTSVQLIVFVAIMLHKAPAAFGLVSFLMHAGLERNRIRKHLLVFALAAPVMSMVTYLGLSKSSKEALSEVNATGVAMLFSAGTFLYVATVHVLPEVGGIGHSHKPDATGGRGLSRLEVAALVLGCLIPLILSVGHQH

SEQ ID NO: 81701 - protein, 92 aa, Homo sapiens
  Payload ID: 16272
  Gene Symbol: SLC39A9
  Gene Name: solute carrier family 39, member 9
  ENSP ID: ENSP00000486416
MDDFISISLLSLAMLVGCYVAGIIPLAVNFSEERLKLVTVLGAGLLCGTALAVIVPEGVHALYEDILEGVENNRQSEGLHAKGRRHLGIFSS

SEQ ID NO: 81702 - protein, 911 aa, Homo sapiens
  Payload ID: 16273
  Gene Symbol: SLC4A1
  Gene Name: solute carrier family 4 (anion exchanger), member 1 (Diego blood group)
  Uniprot ID: P02730
  ENSP ID: ENSP00000262418
MEELQDDYEDMMEENLEQEEYEDPDIPESQMEEPAAHDTEATATDYHTTSHPGTHKVYVELQELVMDEKNQELRWMEAARWVQLEENLGENGAWGRPHLSHLTFWSLLELRRVFTKGTVLLDLQETSLAGVANQLLDRFIFEDQIRPQDREELLRALLLKHSHAGELEALGGVKPAVLTRSGDPSQPLLPQHSSLETQLFCEQGDGGTEGHSPSGILEKIPPDSEATLVLVGRADFLEQPVLGFVRLQEAAELEAVELPVPIRFLFVLLGPEAPHIDYTQLGRAAATLMSERVFRIDAYMAQSRGELLHSLEGFLDCSLVLPPTDAPSEQALLSLVPVQRELLRRRYQSSPAKPDSSFYKGLDLNGGPDDPLQQTGQLFGGLVRDIRRRYPYYLSDITDAFSPQVLAAVIFIYFAALSPAITFGGLLGEKTRNQMGVSELLISTAVQGILFALLGAQPLLVVGFSGPLLVFEEAFFSFCETNGLEYIVGRVWIGFWLILLVVLVVAFEGSFLVRFISRYTQEIFSFLISLIFIYETFSKLIKIFQDHPLQKTYNYNVLMVPKPQGPLPNTALLSLVLMAGTFFFAMMLRKFKNSSYFPGKLRRVIGDFGVPISILIMVLVDFFIQDTYTQKLSVPDGFKVSNSSARGWVIHPLGLRSEFPIWMMFASALPALLVFILIFLESQITTLIVSKPERKMVKGSGFHLDLLLVVGMGGVAALFGMPWLSATTVRSVTHANALTVMGKASTPGAAAQIQEVKEQRISGLLVAVLVGLSILMEPILSRIPLAVLFGIFLYMGVTSLSGIQLFDRILLLFKPPKYHPDVPYVKRVKTWRMHLFTGIQIICLAVLWVVKSTPASLALPFVLILTVPLRRVLLPLIFRNVELQCLDADDAKATFDEEEGRDEYDEVAMPV

SEQ ID NO: 81703 - protein, 545 aa, Homo sapiens
  Payload ID: 16273
  Gene Symbol: SLC4A1
  Gene Name: solute carrier family 4 (anion exchanger), member 1 (Diego blood group)
  ENSP ID: ENSP00000382190
MEELQDDYEDMMEENLEQEEYEDPDIPESQMEEPAAHDTEATATDYHTTSHPGTHKVYVELQELVMDEKNQELRWMEAARWVQLEENLGENGAWGRPHLSHLTFWSLLELRRVFTKGTVLLDLQETSLAGVANQLLDRFIFEDQIRPQDREELLRALLLKHSHAGELEALGGVKPAVLTRSGDPSQPLLPQHSSLETQLFCEQGDGGTEGHSPSGILEKIPPDSEATLVLVGRADFLEQPVLGFVRLQEAAELEAVELPDTYTQKLSVPDGFKVSNSSARGWVIHPLGLRSEFPIWMMFASALPALLVFILIFLESQITTLIVSKPERKMVKGSGFHLDLLLVVGMGGVAALFGMPWLSATTVRSVTHANALTVMGKASTPGAAAQIQEVKEQRISGLLVAVLVGLSILMEPILSRIPLAVLFGIFLYMGVTSLSGIQLFDRILLLFKPPKYHPDVPYVKRVKTWRMHLFTGIQIICLAVLWVVKSTPASLALPFVLILTVPLRRVLLPLIFRNVELQCLDADDAKATFDEEEGRDEYDEVAMPV

SEQ ID NO: 81704 - protein, 36 aa, Homo sapiens
  Payload ID: 16273
  Gene Symbol: SLC4A1
  Gene Name: solute carrier family 4 (anion exchanger), member 1 (Diego blood group)
  ENSP ID: ENSP00000486787
MEETESGSGRKERRWLGAVAHVCNPSTLGGQVGRII

SEQ ID NO: 81705 - protein, 796 aa, Homo sapiens
  Payload ID: 16274
  Gene Symbol: SLC4A1AP
  Gene Name: solute carrier family 4 (anion exchanger), member 1, adaptor protein
  Uniprot ID: Q9BWU0
  ENSP ID: ENSP00000323837
MLAPLRNAPGREGATSPSPPTDATGSLGEWDVDRNVKTEGWVSKERISKLHRLRMADILSQSETLASQDLSGDFKKPALPVSPAARSKAPASSSSNPEEVQKEGPTALQDSNSGEPDIPPPQPDCGDFRSLQEEQSRPPTAVSSPGGPARAPPYQEPPWGGPATAPYSLETLKGGTILGTRSLKGTSYCLFGRLSGCDVCLEHPSVSRYHAVLQHRASGPDGECDSNGPGFYLYDLGSTHGTFLNKTRIPPRTYCRVHVGHVVRFGGSTRLFILQGPEEDREAESELTVTQLKELRKQQQILLEKKMLGEDSDEEEEMDTSERKINAGSQDDEMGCTWGMGEDAVEDDAEENPIVLEFQQEREAFYIKDPKKALQGFFDREGEELEYEFDEQGHSTWLCRVRLPVDDSTGKQLVAEAIHSGKKKEAMIQCSLEACRILDTLGLLRQEAVSRKRKAKNWEDEDFYDSDDDTFLDRTGLIEKKRLNRMKKAGKIDEKPETFESLVAKLNDAERELSEISERLKASSQVLSESPSQDSLDAFMSEMKSGSTLDGVSRKKLHLRTFELRKEQQRLKGLIKIVKPAEIPELKKTETQTTGAENKAKKLTLPLFGAMKGGSKFKLKTGTVGKLPPKRPELPPTLMRMKDEPEVEEEEEEEEEEEKEKEEHEKKKLEDGSLSRPQPEIEPEAAVQEMRPPTDLTHFKETQTHENMSQLSEEEQNKDYQDCSKTTSLCAGPSASKNEYEKSRGELKKKKTPGPGKLPPTLSSKYPEDDPDYCVWVPPEGQSGDGRTHLNDKYGY

SEQ ID NO: 81706 - protein, 157 aa, Homo sapiens
  Payload ID: 16274
  Gene Symbol: SLC4A1AP
  Gene Name: solute carrier family 4 (anion exchanger), member 1, adaptor protein
  ENSP ID: ENSP00000404129
THGTFLNKTRIPPRTYCRVHVGHVVRFGGSTRLFILQGPEEDREAESELTVTQLKELRKQQQILLEKKMLGEDSDEEEEMDTSERKINAGSQDDEMGCTWGMGEDAVEDDAEENPIVLEFQQEREAFYIKDPKKALQGFFDREDGVLPCCTDWFRAP

SEQ ID NO: 81707 - protein, 796 aa, Homo sapiens; identical to SEQ ID NO: 81705
  Payload ID: 16274
  Gene Symbol: SLC4A1AP
  Gene Name: solute carrier family 4 (anion exchanger), member 1, adaptor protein
  Uniprot ID: Q9BWU0
  ENSP ID: ENSP00000479964

SEQ ID NO: 81708 - protein, 273 aa, Homo sapiens
  Payload ID: 16274
  Gene Symbol: SLC4A1AP
  Gene Name: solute carrier family 4 (anion exchanger), member 1, adaptor protein
  ENSP ID: ENSP00000480182
MADILSQSETLASQDLSGDFKKPALPVSPAARSKAPASSSSNPEEGPEEDREAESELTVTQLKELRKQQQILLEKKMLGEDSDEEEEMDTSERKINAGSQDDEMGCTWGMGEDAVEDDAEENPIVLEFQQEREAFYIKDPKKALQGFFDREGEELEYEFDEQGHSTWLCRVRLPVDDSTGKQLVAEAIHSGKKKEAMIQCSLEACRILDTLGLLRQEAVSRKRKAKNWEDEDFYDSDDDTFLDRTGLIEKKRLNRMKKAGKIDEKPETFESLV

SEQ ID NO: 81709 - protein, 742 aa, Homo sapiens
  Payload ID: 16274
  Gene Symbol: SLC4A1AP
  Gene Name: solute carrier family 4 (anion exchanger), member 1, adaptor protein
  ENSP ID: ENSP00000483501
MADILSQSETLASQDLSGDFKKPALPVSPAARSKAPASSSSNPEEVQKEGPTALQDSNSGEPDIPPPQPDCGDFRSLQEEQSRPPTAVSSPGGPARAPPYQEPPWGGPATAPYSLETLKGGTILGTRSLKGTSYCLFGRLSGCDVCLEHPSVSRYHAVLQHRASGPDGECDSNGPGFYLYDLGSTHGTFLNKTRIPPRTYCRVHVGHVVRFGGSTRLFILQGPEEDREAESELTVTQLKELRKQQQILLEKKMLGEDSDEEEEMDTSERKINAGSQDDEMGCTWGMGEDAVEDDAEENPIVLEFQQEREAFYIKDPKKALQGFFDREGEELEYEFDEQGHSTWLCRVRLPVDDSTGKQLVAEAIHSGKKKEAMIQCSLEACRILDTLGLLRQEAVSRKRKAKNWEDEDFYDSDDDTFLDRTGLIEKKRLNRMKKAGKIDEKPETFESLVAKLNDAERELSEISERLKASSQVLSESPSQDSLDAFMSEMKSGSTLDGVSRKKLHLRTFELRKEQQRLKGLIKIVKPAEIPELKKTETQTTGAENKAKKLTLPLFGAMKGGSKFKLKTGTVGKLPPKRPELPPTLMRMKDEPEVEEEEEEEEEEEKEKEEHEKKKLEDGSLSRPQPEIEPEAAVQEMRPPTDLTHFKETQTHENMSQLSEEEQNKDYQDCSKTTSLCAGPSASKNEYEKSRGELKKKKTPGPGKLPPTLSSKYPEDDPDYCVWVPPEGQSGDGRTHLNDKYGY

SEQ ID NO: 81710 - protein, 1159 aa, Homo sapiens
  Payload ID: 16275
  Gene Symbol: SLC4A2
  Gene Name: solute carrier family 4 (anion exchanger), member 2
  ENSP ID: ENSP00000311402
MSSAPRRPAKGADSFCTPGPGRKPRRRPGASPTGETPTIEEGEEDEDEASEAEGARALTQPSPVSTPSSVQFFLQEDDSADRKAERTSPSSPAPLPHQEATPRASKGAQAGTQVEEAEAEAVAVASGTAGGDDGGASGRPLPKAQPGHRSYNLQERRRIGSMTGAEQALLPRVPTDEIEAQTLATADLDLMKSHRFEDVPGVRRHLVRKNAKGSTQSGREGREPGPTPRARPRAPHKPHEVFVELNELLLDKNQEPQWRETARWIKFEEDVEEETERWGKPHVASLSFRSLLELRRTLAHGAVLLDLDQQTLPGVAHQVVEQMVISDQIKAEDRANVLRALLLKHSHPSDEKDFSFPRNISAGSLGSLLGHHHGQGAESDPHVTEPLMGGVPETRLEVERERELPPPAPPAGITRSKSKHELKLLEKIPENAEATVVLVGCVEFLSRPTMAFVRLREAVELDAVLEVPVPVRFLFLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVRTLRMHLFTALQLLCLALLWAVMSTAASLAFPFILILTVPLRMVVLTRIFTDREMKCLDANEAEPVFDEREGVDEYNEMPMPV

SEQ ID NO: 81711 - protein, 1232 aa, Homo sapiens
  Payload ID: 16275
  Gene Symbol: SLC4A2
  Gene Name: solute carrier family 4 (anion exchanger), member 2
  Uniprot ID: P04920
  ENSP ID: ENSP00000376571
MDFLLRPQPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSPVSTPSSVQFFLQEDDSADRKAERTSPSSPAPLPHQEATPRASKGAQAGTQVEEAEAEAVAVASGTAGGDDGGASGRPLPKAQPGHRSYNLQERRRIGSMTGAEQALLPRVPTDEIEAQTLATADLDLMKSHRFEDVPGVRRHLVRKNAKGSTQSGREGREPGPTPRARPRAPHKPHEVFVELNELLLDKNQEPQWRETARWIKFEEDVEEETERWGKPHVASLSFRSLLELRRTLAHGAVLLDLDQQTLPGVAHQVVEQMVISDQIKAEDRANVLRALLLKHSHPSDEKDFSFPRNISAGSLGSLLGHHHGQGAESDPHVTEPLMGGVPETRLEVERERELPPPAPPAGITRSKSKHELKLLEKIPENAEATVVLVGCVEFLSRPTMAFVRLREAVELDAVLEVPVPVRFLFLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVRTLRMHLFTALQLLCLALLWAVMSTAASLAFPFILILTVPLRMVVLTRIFTDREMKCLDANEAEPVFDEREGVDEYNEMPMPV

SEQ ID NO: 81712 - protein, 1241 aa, Homo sapiens
  Payload ID: 16275
  Gene Symbol: SLC4A2
  Gene Name: solute carrier family 4 (anion exchanger), member 2
  Uniprot ID: P04920
  ENSP ID: ENSP00000405600
MSSAPRRPAKGADSFCTPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSPVSTPSSVQFFLQEDDSADRKAERTSPSSPAPLPHQEATPRASKGAQAGTQVEEAEAEAVAVASGTAGGDDGGASGRPLPKAQPGHRSYNLQERRRIGSMTGAEQALLPRVPTDEIEAQTLATADLDLMKSHRFEDVPGVRRHLVRKNAKGSTQSGREGREPGPTPRARPRAPHKPHEVFVELNELLLDKNQEPQWRETARWIKFEEDVEEETERWGKPHVASLSFRSLLELRRTLAHGAVLLDLDQQTLPGVAHQVVEQMVISDQIKAEDRANVLRALLLKHSHPSDEKDFSFPRNISAGSLGSLLGHHHGQGAESDPHVTEPLMGGVPETRLEVERERELPPPAPPAGITRSKSKHELKLLEKIPENAEATVVLVGCVEFLSRPTMAFVRLREAVELDAVLEVPVPVRFLFLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVRTLRMHLFTALQLLCLALLWAVMSTAASLAFPFILILTVPLRMVVLTRIFTDREMKCLDANEAEPVFDEREGVDEYNEMPMPV

SEQ ID NO: 81713 - protein, 70 aa, Homo sapiens
  Payload ID: 16275
  Gene Symbol: SLC4A2
  Gene Name: solute carrier family 4 (anion exchanger), member 2
  ENSP ID: ENSP00000417221
MSSAPRRPAKGADSFCTPEPESLGPGTPGFPEQEEDELHRTLGVERFEEILQEAGSRGGEEPGRSYGEED

SEQ ID NO: 81714 - protein, 145 aa, Homo sapiens
  Payload ID: 16275
  Gene Symbol: SLC4A2
  Gene Name: solute carrier family 4 (anion exchanger), member 2
  ENSP ID: ENSP00000417808
MSSAPRRPAKGADSFCTPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSP

SEQ ID NO: 81715 - protein, 169 aa, Homo sapiens
  Payload ID: 16275
  Gene Symbol: SLC4A2
  Gene Name: solute carrier family 4 (anion exchanger), member 2
  ENSP ID: ENSP00000418114
MSSAPRRPAKGADSFCTPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSPVSTPSSVQFFLQEDDSADRKAERT

SEQ ID NO: 81716 - protein, 150 aa, Homo sapiens
  Payload ID: 16275
  Gene Symbol: SLC4A2
  Gene Name: solute carrier family 4 (anion exchanger), member 2
  ENSP ID: ENSP00000418584
MSSAPRRPAKGADSFCTPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSPVSTPS

SEQ ID NO: 81717 - protein, 1227 aa, Homo sapiens
  Payload ID: 16275
  Gene Symbol: SLC4A2
  Gene Name: solute carrier family 4 (anion exchanger), member 2
  Uniprot ID: P04920
  ENSP ID: ENSP00000419164
MTQPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSPVSTPSSVQFFLQEDDSADRKAERTSPSSPAPLPHQEATPRASKGAQAGTQVEEAEAEAVAVASGTAGGDDGGASGRPLPKAQPGHRSYNLQERRRIGSMTGAEQALLPRVPTDEIEAQTLATADLDLMKSHRFEDVPGVRRHLVRKNAKGSTQSGREGREPGPTPRARPRAPHKPHEVFVELNELLLDKNQEPQWRETARWIKFEEDVEEETERWGKPHVASLSFRSLLELRRTLAHGAVLLDLDQQTLPGVAHQVVEQMVISDQIKAEDRANVLRALLLKHSHPSDEKDFSFPRNISAGSLGSLLGHHHGQGAESDPHVTEPLMGGVPETRLEVERERELPPPAPPAGITRSKSKHELKLLEKIPENAEATVVLVGCVEFLSRPTMAFVRLREAVELDAVLEVPVPVRFLFLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVRTLRMHLFTALQLLCLALLWAVMSTAASLAFPFILILTVPLRMVVLTRIFTDREMKCLDANEAEPVFDEREGVDEYNEMPMPV

SEQ ID NO: 81718 - protein, 127 aa, Homo sapiens
  Payload ID: 16275
  Gene Symbol: SLC4A2
  Gene Name: solute carrier family 4 (anion exchanger), member 2
  ENSP ID: ENSP00000419379
MSSAPRRPAKGADSFCTPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEED

SEQ ID NO: 81719 - protein, 1241 aa, Homo sapiens; identical to SEQ ID NO: 81712
  Payload ID: 16275
  Gene Symbol: SLC4A2
  Gene Name: solute carrier family 4 (anion exchanger), member 2
  Uniprot ID: P04920
  ENSP ID: ENSP00000419412

SEQ ID NO: 81720 - protein, 1259 aa, Homo sapiens
  Payload ID: 16276
  Gene Symbol: SLC4A3
  Gene Name: solute carrier family 4 (anion exchanger), member 3
  Uniprot ID: P48751
  ENSP ID: ENSP00000273063
MANGVIPPPGGASPLPQVRVPLEEPPLSPDVEEEDDDLGKTLAVSRFGDLISKPPAWDPEKPSRSYSERDFEFHRHTSHHTHHPLSARLPPPHKLRRLPPTSARHTRRKRKKEKTSAPPSEGTPPIQEEGGAGVDEEEEEEEEEEGESEAEPVEPPHSGTPQKAKFSIGSDEDDSPGLPGRAAVTKPLPSVGPHTDKSPQHSSRPCSELRDGDGTTDLALSSPRLLCCLPSSPSPRARASRLAGEKSRPWSPSASYDLRERLCPGSALGNPGGPEQQVPTDEAEAQMLGSADLDDMKSHRLEDNPGVRRHLVKKPSRTQGGRGSPSGLAPILRRKKKKKKLDRRPHEVFVELNELMLDRSQEPHWRETARWIKFEEDVEEETERWGKPHVASLSFRSLLELRRTIAHGAALLDLEQTTLPGIAHLVVETMIVSDQIRPEDRASVLRTLLLKHSHPNDDKDSGFFPRNPSSSSMNSVLGNHHPTPSHGPDGAVPTMADDLGEPAPLWPHDPDAKEKPLHMPGGDGHRGKSLKLLEKIPEDAEATVVLVGCVPFLEQPAAAFVRLNEAVLLESVLEVPVPVRFLFVMLGPSHTSTDYHELGRSIATLMSDKLFHEAAYQADDRQDLLSAISEFLDGSIVIPPSEVEGRDLLRSVAAFQRELLRKRREREQTKVEMTTRGGYTAPGKELSLELGGSEATPEDDPLLRTGSVFGGLVRDVRRRYPHYPSDLRDALHSQCVAAVLFIYFAALSPAITFGGLLGEKTEGLMGVSELIVSTAVLGVLFSLLGAQPLLVVGFSGPLLVFEEAFFKFCRAQDLEYLTGRVWVGLWLVVFVLALVAAEGSFLVRYISPFTQEIFAFLISLIFIYETFYKLYKVFTEHPLLPFYPPEGALEGSLDAGLEPNGSALPPTEGPPSPRNQPNTALLSLILMLGTFFIAFFLRKFRNSRFLGGKARRIIGDFGIPISILVMVLVDYSITDTYTQKLTVPTGLSVTSPDKRSWFIPPLGSARPFPPWMMVAAAVPALLVLILIFMETQITALIVSQKARRLLKGSGFHLDLLLIGSLGGLCGLFGLPWLTAATVRSVTHVNALTVMRTAIAPGDKPQIQEVREQRVTGVLIASLVGLSIVMGAVLRRIPLAVLFGIFLYMGVTSLSGIQLSQRLLLILMPAKHHPEQPYVTKVKTWRMHLFTCIQLGCIALLWVVKSTAASLAFPFLLLLTVPLRHCLLPRLFQDRELQALDSEDAEPNFDEDGQDEYNELHMPV

SEQ ID NO: 81721 - protein, 1232 aa, Homo sapiens
  Payload ID: 16276
  Gene Symbol: SLC4A3
  Gene Name: solute carrier family 4 (anion exchanger), member 3
  Uniprot ID: P48751
  ENSP ID: ENSP00000314006
MANGVIPPPGGASPLPQVRVPLEEPPLSPDVEEEDDDLGKTLAVSRFGDLISKPPAWDPEKPSRSYSERDFEFHRHTSHHTHHPLSARLPPPHKLRRLPPTSARHTRRKRKKEKTSAPPSEGTPPIQEEGGAGVDEEEEEEEEEEGESEAEPVEPPHSGTPQKAKFSIGSDEDDSPGLPGRAAVTKPLPSVGPHTDKSPQHSSSSPSPRARASRLAGEKSRPWSPSASYDLRERLCPGSALGNPGGPEQQVPTDEAEAQMLGSADLDDMKSHRLEDNPGVRRHLVKKPSRTQGGRGSPSGLAPILRRKKKKKKLDRRPHEVFVELNELMLDRSQEPHWRETARWIKFEEDVEEETERWGKPHVASLSFRSLLELRRTIAHGAALLDLEQTTLPGIAHLVVETMIVSDQIRPEDRASVLRTLLLKHSHPNDDKDSGFFPRNPSSSSMNSVLGNHHPTPSHGPDGAVPTMADDLGEPAPLWPHDPDAKEKPLHMPGGDGHRGKSLKLLEKIPEDAEATVVLVGCVPFLEQPAAAFVRLNEAVLLESVLEVPVPVRFLFVMLGPSHTSTDYHELGRSIATLMSDKLFHEAAYQADDRQDLLSAISEFLDGSIVIPPSEVEGRDLLRSVAAFQRELLRKRREREQTKVEMTTRGGYTAPGKELSLELGGSEATPEDDPLLRTGSVFGGLVRDVRRRYPHYPSDLRDALHSQCVAAVLFIYFAALSPAITFGGLLGEKTEGLMGVSELIVSTAVLGVLFSLLGAQPLLVVGFSGPLLVFEEAFFKFCRAQDLEYLTGRVWVGLWLVVFVLALVAAEGSFLVRYISPFTQEIFAFLISLIFIYETFYKLYKVFTEHPLLPFYPPEGALEGSLDAGLEPNGSALPPTEGPPSPRNQPNTALLSLILMLGTFFIAFFLRKFRNSRFLGGKARRIIGDFGIPISILVMVLVDYSITDTYTQKLTVPTGLSVTSPDKRSWFIPPLGSARPFPPWMMVAAAVPALLVLILIFMETQITALIVSQKARRLLKGSGFHLDLLLIGSLGGLCGLFGLPWLTAATVRSVTHVNALTVMRTAIAPGDKPQIQEVREQRVTGVLIASLVGLSIVMGAVLRRIPLAVLFGIFLYMGVTSLSGIQLSQRLLLILMPAKHHPEQPYVTKVKTWRMHLFTCIQLGCIALLWVVKSTAASLAFPFLLLLTVPLRHCLLPRLFQDRELQALDSEDAEPNFDEDGQDEYNELHMPV

SEQ ID NO: 81722 - protein, 1232 aa, Homo sapiens; identical to SEQ ID NO: 81721
  Payload ID: 16276
  Gene Symbol: SLC4A3
  Gene Name: solute carrier family 4 (anion exchanger), member 3
  Uniprot ID: P48751
  ENSP ID: ENSP00000350756

SEQ ID NO: 81723 - protein, 1232 aa, Homo sapiens; identical to SEQ ID NO: 81721
  Payload ID: 16276
  Gene Symbol: SLC4A3
  Gene Name: solute carrier family 4 (anion exchanger), member 3
  Uniprot ID: P48751
  ENSP ID: ENSP00000362865

SEQ ID NO: 81724 - protein, 518 aa, Homo sapiens
  Payload ID: 16276
  Gene Symbol: SLC4A3
  Gene Name: solute carrier family 4 (anion exchanger), member 3
  ENSP ID: ENSP00000396863
MANGVIPPPGGASPLPQVRVPLEEPPLSPDVEEEDDDLGKTLAVSRFGDLISKPPAWDPEKPSRSYSERDFEFHRHTSHHTHHPLSARLPPPHKLRRLPPTSARHTRRKRKKEKTSAPPSEGTPPIQEEGGAGVDEEEEEEEEEEGESEAEPVEPPHSGTPQKAKFSIGSDEDDSPGLPGRAAVTKPLPSVGPHTDKSPQHSSSSPSPRARASRLAGEKSRPWSPSASYDLRERLCPGSALGNPGGPEQQVPTDEAEAQMLGSADLDDMKSHRLEDNPGVRRHLVKKPSRTQGGRGSPSGLAPILRRKKKKKKLDRRPHEVFVELNELMLDRSQEPHWRETARWIKFEEDVEEETERWGKPHVASLSFRSLLELRRTIAHGAALLDLEQTTLPGIAHLVVETMIVSDQIRPEDRASVLRTLLLKHSHPNDDKDSGFFPRNPSSSSMNSVLGNHHPTPSHGPDGAVPTMADDLGEPAPLWPHDPDAKEPYSSSASSEAPPHAWGRWSPGEKPEAAGEDP

SEQ ID NO: 81725 - protein, 74 aa, Homo sapiens
  Payload ID: 16276
  Gene Symbol: SLC4A3
  Gene Name: solute carrier family 4 (anion exchanger), member 3
  ENSP ID: ENSP00000398628
  MOD_RES (1)..(1): Any amino acid
XGNHHPTPSHGPDGAVPTMADDLGEPAPLWPHDPDAKEKPLHMPGGDGHRGKSLKLLEKIPEDAEATVVLVAVS

SEQ ID NO: 81726 - protein, 207 aa, Homo sapiens
  Payload ID: 16276
  Gene Symbol: SLC4A3
  Gene Name: solute carrier family 4 (anion exchanger), member 3
  ENSP ID: ENSP00000403160
  MOD_RES (1)..(1): Any amino acid
XAPILRRKKKKKKLDRRPHEVFVELNELMLDRSQEPHWRETARWIKFEEDVEEETERWGKPHVASLSFRSLLELRRTIAHGAALLDLEQTTLPGIAHLVVETMIVSDQIRPEDRASVLRTLLLKHSHPNDDKDSGFFPRNPSSSSMNSVLGNHHPTPSHGPDGAVPTMADDLGEPAPLWPHDPDAKEFCVLRSPSTCLGEMVTGGKA

SEQ ID NO: 81727 - protein, 227 aa, Homo sapiens
  Payload ID: 16276
  Gene Symbol: SLC4A3
  Gene Name: solute carrier family 4 (anion exchanger), member 3
  ENSP ID: ENSP00000414722
MTSPLEKDPEPNGALSPGPGDTNSWGFGRDPAPSPRDSLAPEDLEMFVLDFEDGDLWESIRGQLGPMAGPPTCHRLEDNPGVRRHLVKKPSRTQGGRGSPSGLAPILRRKKKKKKLDRRPHEVFVELNELMLDRSQEPHWRETARWIKFEEDVEEETERWGKPHVASLSFRSLLELRRTIAHGAALLDLEQTTLPGIAHLVVETMIVSDQIRPEDRASVLRTLLLKH

SEQ ID NO: 81728 - protein, 1079 aa, Homo sapiens
  Payload ID: 16277
  Gene Symbol: SLC4A4
  Gene Name: solute carrier family 4 (sodium bicarbonate cotransporter), member 4
  Uniprot ID: Q9Y6R1
  ENSP ID: ENSP00000264485
MEDEAVLDRGASFLKHVCDEEEVEGHHTIYIGVHVPKSYRRRRRHKRKTGHKEKKEKERISENYSDKSDIENADESSSSILKPLISPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPANISISNDTTLAPEYLPTMSSTDMYHNTTFDWAFLSKKECSKYGGNLVGNNCNFVPDITLMSFILFLGTYTSSMALKKFKTSPYFPTTARKLISDFAIILSILIFCVIDALVGVDTPKLIVPSEFKPTSPNRGWFVPPFGENPWWVCLAAAIPALLVTILIFMDQQITAVIVNRKEHKLKKGAGYHLDLFWVAILMVICSLMALPWYVAATVISIAHIDSLKMETETSAPGEQPKFLGVREQRVTGTLVFILTGLSVFMAPILKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDSDCPYSEKVPSIKIPMDIMEQQPFLSDSKPSDRERSPTFLERHTSC

SEQ ID NO: 81729 - protein, 995 aa, Homo sapiens
  Payload ID: 16277
  Gene Symbol: SLC4A4
  Gene Name: solute carrier family 4 (sodium bicarbonate cotransporter), member 4
  Uniprot ID: Q9Y6R1
  ENSP ID: ENSP00000307349
MEDEAVLDRGASFLKHVCDEEEVEGHHTIYIGVHVPKSYRRRRRHKRKTGHKEKKEKERISENYSDKSDIENADESSSSILKPLISPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPANISISNDTTLAPEYLPTMSSTDMYHNTTFDWAFLSKKECSKYGGNLVGNNCNFVPDITLMSFILFLGTYTSSMALKKFKTSPYFPTTARKLISDFAIILSILIFCVIDALVGVDTPKLIVPSEFKPTSPNRGWFVPPFGENPWWVCLAAAIPALLVTILIFMDQQITAVIVNRKEHKLKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDSDCPYSEKVPSIKIPMDIMEQQPFLSDSKPSDRERSPTFLERHTSC

SEQ ID NO: 81730 - protein, 1035 aa, Homo sapiens
  Payload ID: 16277
  Gene Symbol: SLC4A4
  Gene Name: solute carrier family 4 (sodium bicarbonate cotransporter), member 4
  Uniprot ID: Q9Y6R1
  ENSP ID: ENSP00000344272
MSTENVEGKPSNLGERGRARSSTFLRVVQPMFNHSIFTSAVSPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPANISISNDTTLAPEYLPTMSSTDMYHNTTFDWAFLSKKECSKYGGNLVGNNCNFVPDITLMSFILFLGTYTSSMALKKFKTSPYFPTTARKLISDFAIILSILIFCVIDALVGVDTPKLIVPSEFKPTSPNRGWFVPPFGENPWWVCLAAAIPALLVTILIFMDQQITAVIVNRKEHKLKKGAGYHLDLFWVAILMVICSLMALPWYVAATVISIAHIDSLKMETETSAPGEQPKFLGVREQRVTGTLVFILTGLSVFMAPILKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDSDCPYSEKVPSIKIPMDIMEQQPFLSDSKPSDRERSPTFLERHTSC

SEQ ID NO: 81731 - protein, 1094 aa, Homo sapiens
  Payload ID: 16277
  Gene Symbol: SLC4A4
  Gene Name: solute carrier family 4 (sodium bicarbonate cotransporter), member 4
  Uniprot ID: Q9Y6R1
  ENSP ID: ENSP00000393557
MEDEAVLDRGASFLKHVCDEEEVEGHHTIYIGVHVPKSYRRRRRHKRKTGHKEKKEKERISENYSDKSDIENADESSSSILKPLISPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPANISISNDTTLAPEYLPTMSSTDMYHNTTFDWAFLSKKECSKYGGNLVGNNCNFVPDITLMSFILFLGTYTSSMALKKFKTSPYFPTTARKLISDFAIILSILIFCVIDALVGVDTPKLIVPSEFKPTSPNRGWFVPPFGENPWWVCLAAAIPALLVTILIFMDQQITAVIVNRKEHKLKKGAGYHLDLFWVAILMVICSLMALPWYVAATVISIAHIDSLKMETETSAPGEQPKFLGVREQRVTGTLVFILTGLSVFMAPILKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDEKDHQHSLNATHHADKIPFLQSLGMPSPPRTPVKVVPQIRIELEPEDNDYFWRSKGTETTL

SEQ ID NO: 81732 - protein, 646 aa, Homo sapiens
  Payload ID: 16277
  Gene Symbol: SLC4A4
  Gene Name: solute carrier family 4 (sodium bicarbonate cotransporter), member 4
  Uniprot ID: Q9Y6R1
  ENSP ID: ENSP00000422400
MSTENVEGKPSNLGERGRARSSTFLRVVQPMFNHSIFTSAVSPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPGEGITLCVYARFVFGGRCRLHACKFSTCCHGPQELVLFFSLKNSATEFDVSLPEVF

SEQ ID NO: 81733 - protein, 1137 aa, Homo sapiens
  Payload ID: 16278
  Gene Symbol: SLC4A5
  Gene Name: solute carrier family 4 (sodium bicarbonate cotransporter), member 5
  Uniprot ID: Q9BY07
  ENSP ID: ENSP00000251768
MKVKEEKAGVGKLDHTNHRRRFPDQKECPPIHIGLPVPTYPQRKTDQKGHLSGLQKVHWGLRPDQPQQELTGPGSGASSQDSSMDLISRTRSPAAEQLQDILGEEDEAPNPTLFTEMDTLQHDGDQMEWKESARWIKFEEKVEEGGERWSKPHVSTLSLHSLFELRTCLQTGTVLLDLDSGSLPQIIDDVIEKQIEDGLLRPELRERVSYVLLRRHRHQTKKPIHRSLADIGKSVSTTNRSPARSPGAGPSLHHSTEDLRMRQSANYGRLCHAQSRSMNDISLTPNTDQRKNKFMKKIPKDSEASNVLVGEVDFLDQPFIAFVRLIQSAMLGGVTEVPVPTRFLFILLGPSGRAKSYNEIGRAIATLMVDDLFSDVAYKARNREDLIAGIDEFLDEVIVLPPGEWDPNIRIEPPKKVPSADKRKSVFSLAELGQMNGSVGGGGGAPGGGNGGGGGGGSGGGAGSGGAGGTSSGDDGEMPAMHEIGEELIWTGRFFGGLCLDIKRKLPWFPSDFYDGFHIQSISAILFIYLGCITNAITFGGLLGDATDNYQGVMESFLGTAMAGSLFCLFSGQPLIILSSTGPILIFEKLLFDFSKGNGLDYMEFRLWIGLHSAVQCLILVATDASFIIKYITRFTEEGFSTLISFIFIYDAIKKMIGAFKYYPINMDFKPNFITTYKCECVAPDTVNTTVFNASAPLAPDTNASLYNLLNLTALDWSLLSKKECLSYGGRLLGNSCKFIPDLALMSFILFFGTYSMTLTLKKFKFSRYFPTKVRALVADFSIVFSILMFCGIDACFGLETPKLHVPSVIKPTRPDRGWFVAPFGKNPWWVYPASILPALLVTILIFMDQQITAVIVNRKENKLKKAAGYHLDLFWVGILMALCSFMGLPWYVAATVISIAHIDSLKMETETSAPGEQPQFLGVREQRVTGIIVFILTGISVFLAPILKCIPLPVLYGVFLYMGVASLNGIQMGTGGSEFKIQKKLTPFWERCKLFLMPAKHQPDHAFLRHVPLRRIHLFTLVQILCLAVLWILKSTVAAIIFPVMILGLIIVRRLLDFIFSQHDLAWIDNILPEKEKKETDKKRKRKKGAHEDCDEEPQFPPPSVIKIPMESVQSDPQNGIHCIARKRSSSWSYSL

SEQ ID NO: 81734 - protein, 1019 aa, Homo sapiens
  Payload ID: 16278
  Gene Symbol: SLC4A5
  Gene Name: solute carrier family 4 (sodium bicarbonate cotransporter), member 5
  Uniprot ID: Q9BY07
  ENSP ID: ENSP00000351513
MKVKEEKAGVGKLDHTNHRRRFPDQKGSPAAEQLQDILGEEDEAPNPTLFTEMDTLQHDGDQMEWKESARWIKFEEKVEEGGERWSKPHVSTLSLHSLFELRTCLQTGTVLLDLDSGSLPQIIDDVIEKQIEDGLLRPELRERVSYVLLRRHRHQTKKPIHRSLADIGKSVSTTNRSPARSPGAGPSLHHSTEDLRMRQSANYGRLCHAQSRSMNDISLTPNTDQRKNKFMKKIPKDSEASNVLVGEVDFLDQPFIAFVRLIQSAMLGGVTEVPVPTRFLFILLGPSGRAKSYNEIGRAIATLMVDDLFSDVAYKARNREDLIAGIDEFLDEVIVLPPGEWDPNIRIEPPKKVPSADKRKSVFSLAELGQMNGSVGGGGGAPGGGNGGGGGGGSGGGAGSGGAGGTSSGDDGEMPAMHEIGEELIWTGRFFGGLCLDIKRKLPWFPSDFYDGFHIQSISAILFIYLGCITNAITFGGLLGDATDNYQGVMESFLGTAMAGSLFCLFSGQPLIILSSTGPILIFEKLLFDFSKGNGLDYMEFRLWIGLHSAVQCLILVATDASFIIKYITRFTEEGFSTLISFIFIYDAIKKMIGAFKYYPINMDFKPNFITTYKCECVAPDTVNTTVFNASAPLAPDTNASLYNLLNLTALDWSLLSKKECLSYGGRLLGNSCKFIPDLALMSFILFFGTYSMTLTLKKFKFSRYFPTKPTRPDRGWFVAPFGKNPWWVYPASILPALLVTILIFMDQQITAVIVNRKENKLKKAAGYHLDLFWVGILMALCSFMGLPWYVAATVISIAHIDSLKMETETSAPGEQPQFLGVREQRVTGIIVFILTGISVFLAPILKCIPLPVLYGVFLYMGVASLNGIQFWERCKLFLMPAKHQPDHAFLRHVPLRRIHLFTLVQILCLAVLWILKSTVAAIIFPVMILGLIIVRRLLDFIFSQHDLAWIDNILPEKEKKETDKKRKRKKGAHEDCDEEPQFPPPSVIKIPMESVQSDPQNGIHCIARKRSSSWSYSL

SEQ ID NO: 81735 - protein, 1040 aa, Homo sapiens
  Payload ID: 16278
  Gene Symbol: SLC4A5
  Gene Name: solute carrier family 4 (sodium bicarbonate cotransporter), member 5
  Uniprot ID: Q9BY07
  ENSP ID: ENSP00000366859
MKVKEEKAGVGKLDHTNHRRRFPDQKECPPIHIGLPVPTYPQRKTDQKGHLSGLQKVHWGLRPDQPQQELTGPGSGASSQDSSMDLISRTRSPAAEQLQDILGEEDEAPNPTLFTEMDTLQHDGDQMEWKESARWIKFEEKVEEGGERWSKPHVSTLSLHSLFELRTCLQTGTVLLDLDSGSLPQIIDDVIEKQIEDGLLRPELRERVSYVLLRRHRHQTKKPIHRSLADIGKSVSTTNRSPARSPGAGPSLHHSTEDLRMRQSANYGRLCHAQSRSMNDISLTPNTDQRKNKFMKKIPKDSEASNVLVGEVDFLDQPFIAFVRLIQSAMLGGVTEVPVPTRFLFILLGPSGRAKSYNEIGRAIATLMVDDLFSDVAYKARNREDLIAGIDEFLDEVIVLPPGEWDPNIRIEPPKKVPSADKRKSVFSLAELGQMNGSVGGGGGAPGGGNGGGGGGGSGGGAGSGGAGGTSSGDDGEMPAMHEIGEELIWTGRFFGGLCLDIKRKLPWFPSDFYDGFHIQSISAILFIYLGCITNAITFGGLLGDATDNYQGVMESFLGTAMAGSLFCLFSGQPLIILSSTGPILIFEKLLFDFSKGNGLDYMEFRLWIGLHSAVQCLILVATDASFIIKYITRFTEEGFSTLISFIFIYDAIKKMIGAFKYYPINMDFKPNFITTYKCECVAPDTVNTTVFNASAPLAPDTNASLYNLLNLTALDWSLLSKKECLSYGGRLLGNSCKFIPDLALMSFILFFGTYSMTLTLKKFKFSRYFPTKVRALVADFSIVFSILMFCGIDACFGLETPKLHVPSVIKPTRPDRGWFVAPFGKNPWWVYPASILPALLVTILIFMDQQITAVIVNRKENKLKKAAGYHLDLFWVGILMALCSFMGLPWYVAATVISIAHIDSLKMETETSAPGEQPQFLGVREQRVTGIIVFILTGISVFLAPILKILGLIIVRRLLDFIFSQHDLAWIDNILPEKEKKETDKKRKRKKGAHEDCDEEPQFPPPSVIKIPMESVQSDPQNGIHCIARKRSSSWSYSL

SEQ ID NO: 81736 - protein, 1137 aa, Homo sapiens; identical to SEQ ID NO: 81733
  Payload ID: 16278
  Gene Symbol: SLC4A5
  Gene Name: solute carrier family 4 (sodium bicarbonate cotransporter), member 5
  Uniprot ID: Q9BY07
  ENSP ID: ENSP00000366861

SEQ ID NO: 81737 - protein, 1121 aa, Homo sapiens
  Payload ID: 16278
  Gene Symbol: SLC4A5
  Gene Name: solute carrier family 4 (sodium bicarbonate cotransporter), member 5
  Uniprot ID: Q9BY07
  ENSP ID: ENSP00000377587
MKVKEEKAGVGKLDHTNHRRRFPDQKECPPIHIGLPVPTYPQRKTDQKGHLSGLQKVHWGLRPDQPQQELTGPGSGASSQDSSMDLISRTRSPAAEQLQDILGEEDEAPNPTLFTEMDTLQHDGDQMEWKESARWIKFEEKVEEGGERWSKPHVSTLSLHSLFELRTCLQTGTVLLDLDSGSLPQIIDDVIEKQIEDGLLRPELRERVSYVLLRRHRHQTKKPIHRSLADIGKSVSTTNRSPARSPGAGPSLHHSTEDLRMRQSANYGRLCHAQSRSMNDISLTPNTDQRKNKFMKKIPKDSEASNVLVGEVDFLDQPFIAFVRLIQSAMLGGVTEVPVPTRFLFILLGPSGRAKSYNEIGRAIATLMVDDLFSDVAYKARNREDLIAGIDEFLDEVIVLPPGEWDPNIRIEPPKKVPSADKRKSVFSLAELGQMNGSVGGGGGAPGGGNGGGGGGGSGGGAGSGGAGGTSSGDDGEMPAMHEIGEELIWTGRFFGGLCLDIKRKLPWFPSDFYDGFHIQSISAILFIYLGCITNAITFGGLLGDATDNYQGVMESFLGTAMAGSLFCLFSGQPLIILSSTGPILIFEKLLFDFSKGNGLDYMEFRLWIGLHSAVQCLILVATDASFIIKYITRFTEEGFSTLISFIFIYDAIKKMIGAFKYYPINMDFKPNFITTYKCECVAPDTVNTTVFNASAPLAPDTNASLYNLLNLTALDWSLLSKKECLSYGGRLLGNSCKFIPDLALMSFILFFGTYSMTLTLKKFKFSRYFPTKVRALVADFSIVFSILMFCGIDACFGLETPKLHVPSVIKPTRPDRGWFVAPFGKNPWWVYPASILPALLVTILIFMDQQITAVIVNRKENKLKKAAGYHLDLFWVGILMALCSFMGLPWYVAATVISIAHIDSLKMETETSAPGEQPQFLGVREQRVTGIIVFILTGISVFLAPILKCIPLPVLYGVFLYMGVASLNGIQFWERCKLFLMPAKHQPDHAFLRHVPLRRIHLFTLVQILCLAVLWILKSTVAAIIFPVMILGLIIVRRLLDFIFSQHDLAWIDNILPEKEKKETDKKRKRKKGAHEDCDEEPQFPPPSVIKIPMESVQSDPQNGIHCIARKRSSSWSYSL

SEQ ID NO: 81738 - protein, 1121 aa, Homo sapiens; identical to SEQ ID NO: 81737
  Payload ID: 16278
  Gene Symbol: SLC4A5
  Gene Name: solute carrier family 4 (sodium bicarbonate cotransporter), member 5
  Uniprot ID: Q9BY07
  ENSP ID: ENSP00000395804

SEQ ID NO: 81739 - protein, 129 aa, Homo sapiens
  Payload ID: 16278
  Gene Symbol: SLC4A5
  Gene Name: solute carrier family 4 (sodium bicarbonate cotransporter), member 5
  ENSP ID: ENSP00000399319
MKVKEEKAGVGKLDHTNHRRRFPDQKECPPIHIGLPVPTYPQRKTDQKGHLSGLQKVHWGLRPDQPQQELTGPGSGASSQDSSMDLISRTRSPAAEQLQDILGEEDEAPNPTLFTEMDTLQHDGDQMEW

SEQ ID NO: 81740 - protein, 963 aa, Homo sapiens
  Payload ID: 16278
  Gene Symbol: SLC4A5
  Gene Name: solute carrier family 4 (sodium bicarbonate cotransporter), member 5
  ENSP ID: ENSP00000405678
MKVKEEKAGVGKLDHTNHRRRFPDQKECPPIHIGLPVPTYPQRKTDQKGHLSGLQKVHWGLRPDQPQQELTGPGSGASSQDSSMDLISRTRSPAAEQLQDILGEEDEAPNPTLFTEMDTLQHDGDQMEWKESARWIKFEEKVEEGGERWSKPHVSTLSLHSLFELRTCLQTGTVLLDLDSGSLPQIIDDVIEKQIEDGLLRPELRERVSYVLLRRHRHQTKKPIHRSLADIGKSVSTTNRSPARSPGAGPSLHHSTEDLRMRQSANYGRLCHAQSRSMNDISLTPNTDQRKNKFMKKIPKDSEASNVLVGEVDFLDQPFIAFVRLIQSAMLGGVTEVPVPTRFLFILLGPSGRAKSYNEIGRAIATLMVDDLFSDVAYKARNREDLIAGIDEFLDEVIVLPPGEWDPNIRIEPPKKVPSADKRKSVFSLAELGQMNGSVGGGGGAPGGGNGGGGGGGSGGGAGSGGAGGTSSGDDGEMPAMHEIGEELIWTGRFFGGLCLDIKRKLPWFPSDFYDGFHIQSISAILFIYLGCITNAITFGGLLGDATDNYQGVMESFLGTAMAGSLFCLFSGQPLIILSSTGPILIFEKLLFDFSKGNGLDYMEFRLWIGLHSAVQCLILVATDASFIIKYITRFTEEGFSTLISFIFIYDAIKKMIGAFKYYPINMDFKPNFITTYKCECVAPDTVNTTVFNASAPLAPDTNASLYNLLNLTALDWSLLSKKECLSYGGRLLGNSCKFIPDLALMSFILFFGTYSMTLTLKKFKFSRYFPTKPTRPDRGWFVAPFGKNPWWVYPASILPALLVTILIFMDQQITAVIVNRKENKLKGTESNRHHRLHPDGNLCLPGSHPKVYPPAGAVRSLPLHGRGLPEWHPVLGTLQALPDASQAPAGPCLPAARAAAPDPPLHPGADPLPGGALDPQIHGGCHHLPGHVSLHHRSWASSSFEGFWISSFPSTTWPGLTT

SEQ ID NO: 81741 - protein, 144 aa, Homo sapiens
  Payload ID: 16278
  Gene Symbol: SLC4A5
  Gene Name: solute carrier family 4 (sodium bicarbonate cotransporter), member 5
  ENSP ID: ENSP00000407550
MKVKEEKAGVGKLDHTNHRRRFPDQKECPPIHIGLPVPTYPQRKTDQKGHLSGLQKVHWGLRPDQPQQELTGPGSGASSQDSSMDLISRTRSPAAEQLQDILGEEDEAPNPTLFTEMDTLQHDGDQMEWKESARWIKFEEKVEE

SEQ ID NO: 81742 - protein, 122 aa, Homo sapiens
  Payload ID: 16278
  Gene Symbol: SLC4A5
  Gene Name: solute carrier family 4 (sodium bicarbonate cotransporter), member 5
  ENSP ID: ENSP00000414162
MDTLQHDGDQMEWKESARWIKFEEKVEEGGERWSKPHVSTLSLHSLFELRTCLQTGTVLLDLDSGSLPQIIDDVIEKQIEDGLLRPELRERVSYVLLRRHRHQTKKPIHRSLADIGKSVSTT

SEQ ID NO: 81743 - protein, 1214 aa, Homo sapiens
  Payload ID: 16279
  Gene Symbol: SLC4A7
  Gene Name: solute carrier family 4, sodium bicarbonate cotransporter, member 7
  Uniprot ID: Q9Y6M7
  ENSP ID: ENSP00000295736
MERFRLEKKLPGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGEGLSASRHSLRTGLSASNLSLRGESPLSLLLGHLLPSSRAGTPAGSRCTTPVPTPQNSPPSSPSISRLTSRSSQESQRQAPELLVSPASDDIPTVVIHPPEEDLEAALKGEEQKNEENVDLTPGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSPDKPVSVKISFEDEPRKKYVDAETSL

SEQ ID NO: 81744 - protein, 1051 aa, Homo sapiens
  Payload ID: 16279
  Gene Symbol: SLC4A7
  Gene Name: solute carrier family 4, sodium bicarbonate cotransporter, member 7
  ENSP ID: ENSP00000388703
MERFRLEKKLPGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGILASPQSAPGNLDNSKSGEIKGNGSGGSRENSTVDFSKESASWHCSCGTLGVGLKRPAVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKE

SEQ ID NO: 81745 - protein, 1259 aa, Homo sapiens
  Payload ID: 16279
  Gene Symbol: SLC4A7
  Gene Name: solute carrier family 4, sodium bicarbonate cotransporter, member 7
  Uniprot ID: Q9Y6M7
  ENSP ID: ENSP00000390394
MEADGAGEQMRPLLTRVTSRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGEGLSASRHSLRTGLSASNLSLRGESPLSLLLGHLLPSSRAGTPAGSRCTTPVPTPQNSPPSSPSISRLTSRSSQESQRQAPELLVSPASDDIPTVVIHPPEEDLEAALKGEEQKNEENVDLTPGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSVDPSIVNISDEMAKTAQWKALSMNTENAKVTRSNMSPDKPVSVKISFEDEPRKKYVDAETSL

SEQ ID NO: 81746 - protein, 1095 aa, Homo sapiens
  Payload ID: 16279
  Gene Symbol: SLC4A7
  Gene Name: solute carrier family 4, sodium bicarbonate cotransporter, member 7
  Uniprot ID: Q9Y6M7
  ENSP ID: ENSP00000394252
MEADGAGEQMRPLLTRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSPDKPVSVKISFEDEPRKKYVDAETSL

SEQ ID NO: 81747 - protein, 1201 aa, Homo sapiens [sequence omitted]

SEQ ID NO: 81748 - protein, 1206 aa, Homo sapiens
  Payload ID: 16279
  Gene Symbol: SLC4A7
  Gene Name: solute carrier family 4, sodium bicarbonate cotransporter, member 7
  Uniprot ID: Q9Y6M7
  ENSP ID: ENSP00000406605
MEADGAGEQMRPLLTRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGEGLSASRHSLRTGLSASNLSLRGESPLSLLLGHLLPSSRAGTPAGSRCTTPVPTPQNSPPSSPSISRLTSRSSQESQRQAPELLVSPASDDIPTVVIHPPEEDLEAALKGEEQKNEENVDLTPGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSPDKPVSVKISFEDEPRKKYVDAETSL

SEQ ID NO: 81749 - protein, 1210 aa, Homo sapiens
  Payload ID: 16279
  Gene Symbol: SLC4A7
  Gene Name: solute carrier family 4, sodium bicarbonate cotransporter, member 7
  ENSP ID: ENSP00000406804
MEADGAGEQMRPLLTRVTSRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGEGLSASRHSLRTGLSASNLSLRGESPLSLLLGHLLPSSRAGTPAGSRCTTPVPTPQNSPPSSPSISRLTSRSSQESQRQAPELLVSPASDDIPTVVIHPPEEDLEAALKGEEQKNEENVDLTPGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSPDKPVSVKISFEDEPRKKYVDAETSL

SEQ ID NO: 81750 - protein, 574 aa, Homo sapiens
  Payload ID: 16279
  Gene Symbol: SLC4A7
  Gene Name: solute carrier family 4, sodium bicarbonate cotransporter, member 7
  Uniprot ID: Q9Y6M7
  ENSP ID: ENSP00000407304
MEADGAGEQMRPLLTRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGEGLSASRHSLRTGLSASNLSLRGESPLSLLLGHLLPSSRAGTPAGSRCTTPVPTPQNSPPSSPSISRLTSRSSQESQRQAPELLVSPASDDIPTVVIHPPEEDLEAALKGEEQKNEENVDLTPGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRVQ

SEQ ID NO: 81751 - protein, 1131 aa, Homo sapiens
  Payload ID: 16279
  Gene Symbol: SLC4A7
  Gene Name: solute carrier family 4, sodium bicarbonate cotransporter, member 7
  Uniprot ID: Q9Y6M7
  ENSP ID: ENSP00000407382
MEADGAGEQMRPLLTRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSVDPSIVNISDEMAKTAQWKALSMNTENAKVTRSNMSPDKPVSVKISFEDEPRKKYVDAETSL

SEQ ID NO: 81752 - protein, 463 aa, Homo sapiens
  Payload ID: 16279
  Gene Symbol: SLC4A7
  Gene Name: solute carrier family 4, sodium bicarbonate cotransporter, member 7
  Uniprot ID: Q9Y6M7
  ENSP ID: ENSP00000408323
MEADGAGEQMRPLLTRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRVQ

SEQ ID NO: 81753 - protein, 463 aa, Homo sapiens; identical to SEQ ID NO: 81752
  Payload ID: 16279
  Gene Symbol: SLC4A7
  Gene Name: solute carrier family 4, sodium bicarbonate cotransporter, member 7
  Uniprot ID: Q9Y6M7
  ENSP ID: ENSP00000409418

SEQ ID NO: 81754 - protein, 801 aa, Homo sapiens
  Payload ID: 16279
  Gene Symbol: SLC4A7
  Gene Name: solute carrier family 4, sodium bicarbonate cotransporter, member 7
  ENSP ID: ENSP00000411031
VMEVVEAEKIVLLTSARFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSVDPSIVNISDEMAKTAQWKALSMNTENAKVTRSNMSPDKPVSVKISFEDEPRKKYVDAETSL

SEQ ID NO: 81755 - protein, 1246 aa, Homo sapiens
  Payload ID: 16279
  Gene Symbol: SLC4A7
  Gene Name: solute carrier family 4, sodium bicarbonate cotransporter, member 7
  Uniprot ID: Q9Y6M7
  ENSP ID: ENSP00000414797
MEADGAGEQMRPLLTRVTSRGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGEGLSASRHSLRTGLSASNLSLRGESPLSLLLGHLLPSSRAGTPAGSRCTTPVPTPQNSPPSSPSISRLTSRSSQESQRQAPELLVSPASDDIPTVVIHPPEEDLEAALKGEEQKNEENVDLTPGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSVDPSIVNISDEMAKTAQWKALSMNTENAKVTRSNMSPDKPVSVKISFEDEPRKKYVDAETSL

SEQ ID NO: 81756 - protein, 1090 aa, Homo sapiens
  Payload ID: 16279
  Gene Symbol: SLC4A7
  Gene Name: solute carrier family 4, sodium bicarbonate cotransporter, member 7
  Uniprot ID: Q9Y6M7
  ENSP ID: ENSP00000416368
MERFRLEKKLPGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSPDKPVSVKISFEDEPRKKYVDAETSL

SEQ ID NO: 81757 - protein, 1040 aa, Homo sapiens
  Payload ID: 16280
  Gene Symbol: SLC4A8
  Gene Name: solute carrier family 4, sodium bicarbonate cotransporter, member 8
  Uniprot ID: Q2Y0W8
  ENSP ID: ENSP00000351483
MPLGRQSHRHHRTHGQKHRRRGRGKGASQGEEGLEALAHDTPSQRVQFILGTEEDEEHVPHELFTELDEICMKEGEDAEWKETARWLKFEEDVEDGGERWSKPYVATLSLHSLFELRSCLINGTVLLDMHANSIEEISDLILDQQELSSDLNDSMRVKVREALLKKHHHQNEKKRNNLIPIVRSFAEVGKKQSDPHLMDKHGQTVSPQSVPTTNLEVKNGVNCEHSPVDLSKVDLHFMKKIPTGAEASNVLVGEVDILDRPIVAFVRLSPAVLLSGLTEVPIPTRFLFILLGPVGKGQQYHEIGRSMATIMTDEIFHDVAYKAKERDDLLAGIDEFLDQVTVLPPGEWDPSIRIEPPKNVPSQEKRKMPGVPNGNVCHIEQEPHGGHSGPELQRTGRLFGGLVLDIKRKAPWYWSDYRDALSLQCLASFLFLYCACMSPVITFGGLLGEATEGRISAIESLFGASMTGIAYSLFAGQALTILGSTGPVLVFEKILFKFCKDYALSYLSLRACIGLWTAFLCIVLVATDASSLVCYITRFTEEAFASLICIIFIYEAIEKLIHLAETYPIHMHSQLDHLSLYYCRCTLPENPNNHTLQYWKDHNIVTAEVHWANLTVSECQEMHGEFMGSACGHHGPYTPDVLFWSCILFFTTFILSSTLKTFKTSRYFPTRVRSMVSDFAVFLTIFTMVIIDFLIGVPSPKLQVPSVFKPTRDDRGWIINPIGPNPWWTVIAAIIPALLCTILIFMDQQITAVIINRKEHKLKKGCGYHLDLLMVAIMLGVCSIMGLPWFVAATVLSITHVNSLKLESECSAPGEQPKFLGIREQRVTGLMIFVLMGCSVFMTAILKFIPMPVLYGVFLYMGVSSLQGIQFFDRLKLFGMPAKHQPDFIYLRHVPLRKVHLFTLIQLTCLVLLWVIKASPAAIVFPMMVLALVFVRKVMDLCFSKRELSWLDDLMPESKKKKLDDAKKKAKEEEEAEKMLEIGGDKFPLESRKLLSSPGKNISCRCDPSEINISDEMPKTTVWKALSMNSGNAKEKSLFN

SEQ ID NO: 81758 - protein, 1093 aa, Homo sapiens
  Payload ID: 16280
  Gene Symbol: SLC4A8
  Gene Name: solute carrier family 4, sodium bicarbonate cotransporter, member 8
  Uniprot ID: Q2Y0W8
  ENSP ID: ENSP00000405812
MPAAGSNEPDGVLSYQRPDEEAVVDQGGTSTILNIHYEKEELEGHRTLYVGVRMPLGRQSHRHHRTHGQKHRRRGRGKGASQGEEGLEALAHDTPSQRVQFILGTEEDEEHVPHELFTELDEICMKEGEDAEWKETARWLKFEEDVEDGGERWSKPYVATLSLHSLFELRSCLINGTVLLDMHANSIEEISDLILDQQELSSDLNDSMRVKVREALLKKHHHQNEKKRNNLIPIVRSFAEVGKKQSDPHLMDKHGQTVSPQSVPTTNLEVKNGVNCEHSPVDLSKVDLHFMKKIPTGAEASNVLVGEVDILDRPIVAFVRLSPAVLLSGLTEVPIPTRFLFILLGPVGKGQQYHEIGRSMATIMTDEIFHDVAYKAKERDDLLAGIDEFLDQVTVLPPGEWDPSIRIEPPKNVPSQEKRKMPGVPNGNVCHIEQEPHGGHSGPELQRTGRLFGGLVLDIKRKAPWYWSDYRDALSLQCLASFLFLYCACMSPVITFGGLLGEATEGRISAIESLFGASMTGIAYSLFAGQALTILGSTGPVLVFEKILFKFCKDYALSYLSLRACIGLWTAFLCIVLVATDASSLVCYITRFTEEAFASLICIIFIYEAIEKLIHLAETYPIHMHSQLDHLSLYYCRCTLPENPNNHTLQYWKDHNIVTAEVHWANLTVSECQEMHGEFMGSACGHHGPYTPDVLFWSCILFFTTFILSSTLKTFKTSRYFPTRVRSMVSDFAVFLTIFTMVIIDFLIGVPSPKLQVPSVFKPTRDDRGWIINPIGPNPWWTVIAAIIPALLCTILIFMDQQITAVIINRKEHKLKKGCGYHLDLLMVAIMLGVCSIMGLPWFVAATVLSITHVNSLKLESECSAPGEQPKFLGIREQRVTGLMIFVLMGCSVFMTAILKFIPMPVLYGVFLYMGVSSLQGIQFFDRLKLFGMPAKHQPDFIYLRHVPLRKVHLFTLIQLTCLVLLWVIKASPAAIVFPMMVLALVFVRKVMDLCFSKRELSWLDDLMPESKKKKLDDAKKKAKEEEEAEKMLEIGGDKFPLESRKLLSSPGKNISCRCDPSEINISDEMPKTTVWKALSMNSGNAKEKSLFN

SEQ ID NO: 81759 - protein, 638 aa, Homo sapiens
  Payload ID: 16280
  Gene Symbol: SLC4A8
  Gene Name: solute carrier family 4, sodium bicarbonate cotransporter, member 8
  Uniprot ID: Q2Y0W8
  ENSP ID: ENSP00000441520
MPLGRQSHRHHRTHGQKHRRRGRGKGASQGEEGLEALAHDTPSQRVQFILGTEEDEEHVPHELFTELDEICMKEGEDAEWKETARWLKFEEDVEDGGERWSKPYVATLSLHSLFELRSCLINGTVLLDMHANSIEEISDLILDQQELSSDLNDSMRVKVREALLKKHHHQNEKKRNNLIPIVRSFAEVGKKQSDPHLMDKHGQTVSPQSVPTTNLEVKNGVNCEHSPVDLSKVDLHFMKKIPTGAEASNVLVGEVDILDRPIVAFVRLSPAVLLSGLTEVPIPTRFLFILLGPVGKGQQYHEIGRSMATIMTDEIFHDVAYKAKERDDLLAGIDEFLDQVTVLPPGEWDPSIRIEPPKNVPSQEKRKMPGVPNGNVCHIEQEPHGGHSGPELQRTGRLFGGLVLDIKRKAPWYWSDYRDALSLQCLASFLFLYCACMSPVITFGGLLGEATEGRISAIESLFGASMTGIAYSLFAGQALTILGSTGPVLVFEKILFKFCKDYALSYLSLRACIGLWTAFLCIVLVATDASSLVCYITRFTEEAFASLICIIFIYEAIEKLIHLAETYPIHMHSQLDHLSLYYCRCTLPENPNNHTLQYWKDHNIVTAEVHWANLTVSVSLGAARCPSIVTTGLGGTSK

SEQ ID NO: 81760 - protein, 747 aa, Homo sapiens
  Payload ID: 16280
  Gene Symbol: SLC4A8
  Gene Name: solute carrier family 4, sodium bicarbonate cotransporter, member 8
  Uniprot ID: Q2Y0W8
  ENSP ID: ENSP00000442561
MPLGRQSHRHHRTHGQKHRRRGRGKGASQGEEGLEALAHDTPSQRVQFILGTEEDEEHVPHELFTELDEICMKEGEDAEWKETARWLKFEEDVEDGGERWSKPYVATLSLHSLFELRSCLINGTVLLDMHANSIEEISDLILDQQELSSDLNDSMRVKVREALLKKHHHQNEKKRNNLIPIVRSFAEVGKKQSDPHLMDKHGQTVSPQSVPTTNLEVKNGVNCEHSPVDLSKVDLHFMKKIPTGAEASNVLVGEVDILDRPIVAFVRLSPAVLLSGLTEVPIPTRFLFILLGPVGKGQQYHEIGRSMATIMTDEIFHDVAYKAKERDDLLAGIDEFLDQVTVLPPGEWDPSIRIEPPKNVPSQEKRKMPGVPNGNVCHIEQEPHGGHSGPELQRTGRLFGGLVLDIKRKAPWYWSDYRDALSLQCLASFLFLYCACMSPVITFGGLLGEATEGRISAIESLFGASMTGIAYSLFAGQALTILGSTGPVLVFEKILFKFCKDYALSYLSLRACIGLWTAFLCIVLVATDASSLVCYITRFTEEAFASLICIIFIYEAIEKLIHLAETYPIHMHSQLDHLSLYYCRCTLPENPNNHTLQYWKDHNIVTAEVHWANLTVSECQEMHGEFMGSACGHHGPYTPDVLFWSCILFFTTFILSSTLKTFKTSRYFPTRMESCSVAWLECGGVILAHCNLRLLPSSWDYRHAPPQPANFCIFSRDGVSPCWPGWSQSLDLVICLPRPPKMLGLQA

SEQ ID NO: 81761 - protein, 945 aa, Homo sapiens
  Payload ID: 16281
  Gene Symbol: SLC4A9
  Gene Name: solute carrier family 4, sodium bicarbonate cotransporter, member 9
  Uniprot ID: Q96Q91
  ENSP ID: ENSP00000410056
MEMKLPGQEGFEASSAPRNIPSGELDSNPDPGTGPSPDGPSDTESKELGVPKDPLLFIQLNELLGWPQALEWRETGRWVLFEEKLEVAAGRWSAPHVPTLALPSLQKLRSLLAEGLVLLDCPAQSLLELVEQVTRVESLSPELRGQLQALLLQRPQHYNQTTGTRPCWGSTHPRKASDNEEAPLREQCQNPLRQKLPPGAEAGTVLAGELGFLAQPLGAFVRLRNPVVLGSLTEVSLPSRFFCLLLGPCMLGKGYHEMGRAAAVLLSDPQFQWSVRRASNLHDLLAALDAFLEEVTVLPPGRWDPTARIPPPKCLPSQHKRLPSQQREIRGPAVPRLTSAEDRHRHGPHAHSPELQRTGRKVPWYPSDFLDALHLQCFSAVLYIYLATVTNAITFGGLLGDATDGAQGVLESFLGTAVAGAAFCLMAGQPLTILSSTGPVLVFERLLFSFSRDYSLDYLPFRLWVGIWVATFCLVLVATEASVLVRYFTRFTEEGFCALISLIFIYDAVGKMLNLTHTYPIQKPGSSAYGCLCQYPGPGGNESQWIRTRPKDRDDIDLGLINASLLPPPECTRQGGHPRGPGCHTVPDIAFFSLLLFLTSFFFAMALKCVKTSRFFPSVVRKGLSDFSSVLAILLGCGLDAFLGLATPKLMVPREFKPTLPGRGWLVSPFGANPWWWSVAAALPALLLSILIFMDQQITAVILNRMEYRLQKGAGFHLDLFCVAVLMLLTSALGLPWYVSATVISLAHMDSLRRESRACAPGERPNFLGIREQRLTGLVVFILTGASIFLAPVLKFIPMPVLYGIFLYMGVAALSSIQFTNRVKLLLMPAKHQPDLLLLRHVPLTRVHLFTAIQLACLGLLWIIKSTPAAIIFPLMLLGLVGVRKALERVFSPQELLWLDELMPEEERSIPEKGLEPEHSFSGSDSEDSELMYQPKAPEINISVN

SEQ ID NO: 81762 - protein, 896 aa, Homo sapiens
  Payload ID: 16281
  Gene Symbol: SLC4A9
  Gene Name: solute carrier family 4, sodium bicarbonate cotransporter, member 9
  Uniprot ID: Q96Q91
  ENSP ID: ENSP00000422855
MEMKLPGQEGFEASSAPRNIPSGELDSNPDPGTGPSPDGPSDTESKELGVPKDPLLFIQLNELLGWPQALEWRETGRWVLFEEKLEVAAGRWSAPHVPTLALPSLQKLRSLLAEGLVLLDCPAQSLLELVEQVTRVESLSPELRGQLQALLLQRPQHYNQTTGTRPCWGSTHPRKASDNEEAPLREQCQNPLRQKLPPGAEAGTVLAGELGFLAQPLGAFVRLRNPVVLGSLTEVSLPSRFFCLLLGPCMLGKGYHEMGRAAAVLLSDPQFQWSVRRASNLHDLLAALDAFLEEVTVLPPGRWDPTARIPPPKCLPSQHKRLPSQQREIRGPAVPRLTSAEDRHRHGPHAHSPELQRTGRLFGGLIQDVRRKVPWYPSDFLDALHLQCFSAVLYIYLATVTNAITFGGLLGDATDGAQGVLESFLGTAVAGAAFCLMAGQPLTILSSTGPVLVFERLLFSFSRDYSLDYLPFRLWVGIWVATFCLVLVATEASVLVRYFTRFTEEGFCALISLIFIYDAVGKMLNLTHTYPIQKPGSSAYGCLCQYPGPGGNESQWIRTRPKDRDDIVSMVRKGLSDFSSVLAILLGCGLDAFLGLATPKLMVPREFKPTLPGRGWLVSPFGANPWWWSVAAALPALLLSILIFMDQQITAVILNRMEYRLQKGAGFHLDLFCVAVLMLLTSALGLPWYVSATVISLAHMDSLRRESRACAPGERPNFLGIREQRLTGLVVFILTGASIFLAPVLKFIPMPVLYGIFLYMGVAALSSIQFTNRVKLLLMPAKHQPDLLLLRHVPLTRVHLFTAIQLACLGLLWIIKSTPAAIIFPLMLLGLVGVRKALERVFSPQELLWLDELMPEEERSIPEKGLEPEHSFSGSDSEDSELMYQPKAPEINISVN

SEQ ID NO: 81763 - protein, 959 aa, Homo sapiens
  Payload ID: 16281
  Gene Symbol: SLC4A9
  Gene Name: solute carrier family 4, sodium bicarbonate cotransporter, member 9
  Uniprot ID: Q96Q91
  ENSP ID: ENSP00000424424
MEMKLPGQEGFEASSAPRNIPSGELDSNPDPGTGPSPDGPSDTESKELGVPKDPLLFIQLNELLGWPQALEWRETGRWVLFEEKLEVAAGRWSAPHVPTLALPSLQKLRSLLAEGLVLLDCPAQSLLELVEQVTRVESLSPELRGQLQALLLQRPQHYNQTTGTRPCWGSTHPRKASDNEEAPLREQCQNPLRQKLPPGAEAGTVLAGELGFLAQPLGAFVRLRNPVVLGSLTEVSLPSRFFCLLLGPCMLGKGYHEMGRAAAVLLSDPQFQWSVRRASNLHDLLAALDAFLEEVTVLPPGRWDPTARIPPPKCLPSQHKRLPSQQREIRGPAVPRLTSAEDRHRHGPHAHSPELQRTGRLFGGLIQDVRRKVPWYPSDFLDALHLQCFSAVLYIYLATVTNAITFGGLLGDATDGAQGVLESFLGTAVAGAAFCLMAGQPLTILSSTGPVLVFERLLFSFSRDYSLDYLPFRLWVGIWVATFCLVLVATEASVLVRYFTRFTEEGFCALISLIFIYDAVGKMLNLTHTYPIQKPGSSAYGCLCQYPGPGGNESQWIRTRPKDRDDIVSMDLGLINASLLPPPECTRQGGHPRGPGCHTVPDIAFFSLLLFLTSFFFAMALKCVKTSRFFPSVVRKGLSDFSSVLAILLGCGLDAFLGLATPKLMVPREFKPTLPGRGWLVSPFGANPWWWSVAAALPALLLSILIFMDQQITAVILNRMEYRLQKGAGFHLDLFCVAVLMLLTSALGLPWYVSATVISLAHMDSLRRESRACAPGERPNFLGIREQRLTGLVVFILTGASIFLAPVLKFIPMPVLYGIFLYMGVAALSSIQFTNRVKLLLMPAKHQPDLLLLRHVPLTRVHLFTAIQLACLGLLWIIKSTPAAIIFPLMLLGLVGVRKALERVFSPQELLWLDELMPEEERSIPEKGLEPEHSFSGSDSEDSELMYQPKAPEINISVN

SEQ ID NO: 81764 - protein, 983 aa, Homo sapiens
  Payload ID: 16281
  Gene Symbol: SLC4A9
  Gene Name: solute carrier family 4, sodium bicarbonate cotransporter, member 9
  Uniprot ID: Q96Q91
  ENSP ID: ENSP00000427661
MEMKLPGQEGFEASSAPRNIPSGELDSNPDPGTGPSPDGPSDTESKELGVPKDPLLFIQLNELLGWPQALEWRETGSSSASLLLDMGEMPSITLSTHLHHRWVLFEEKLEVAAGRWSAPHVPTLALPSLQKLRSLLAEGLVLLDCPAQSLLELVEQVTRVESLSPELRGQLQALLLQRPQHYNQTTGTRPCWGSTHPRKASDNEEAPLREQCQNPLRQKLPPGAEAGTVLAGELGFLAQPLGAFVRLRNPVVLGSLTEVSLPSRFFCLLLGPCMLGKGYHEMGRAAAVLLSDPQFQWSVRRASNLHDLLAALDAFLEEVTVLPPGRWDPTARIPPPKCLPSQHKRLPSQQREIRGPAVPRLTSAEDRHRHGPHAHSPELQRTGRLFGGLIQDVRRKVPWYPSDFLDALHLQCFSAVLYIYLATVTNAITFGGLLGDATDGAQGVLESFLGTAVAGAAFCLMAGQPLTILSSTGPVLVFERLLFSFSRDYSLDYLPFRLWVGIWVATFCLVLVATEASVLVRYFTRFTEEGFCALISLIFIYDAVGKMLNLTHTYPIQKPGSSAYGCLCQYPGPGGNESQWIRTRPKDRDDIVSMDLGLINASLLPPPECTRQGGHPRGPGCHTVPDIAFFSLLLFLTSFFFAMALKCVKTSRFFPSVVRKGLSDFSSVLAILLGCGLDAFLGLATPKLMVPREFKPTLPGRGWLVSPFGANPWWWSVAAALPALLLSILIFMDQQITAVILNRMEYRLQKGAGFHLDLFCVAVLMLLTSALGLPWYVSATVISLAHMDSLRRESRACAPGERPNFLGIREQRLTGLVVFILTGASIFLAPVLKFIPMPVLYGIFLYMGVAALSSIQFTNRVKLLLMPAKHQPDLLLLRHVPLTRVHLFTAIQLACLGLLWIIKSTPAAIIFPLMLLGLVGVRKALERVFSPQELLWLDELMPEEERSIPEKGLEPEHSFSGSDSEDSELMYQPKAPEINISVN

SEQ ID NO: 81765 - protein, 1106 aa, Homo sapiens
  Payload ID: 16282
  Gene Symbol: SLC4A10
  Gene Name: solute carrier family 4, sodium bicarbonate transporter, member 10
  ENSP ID: ENSP00000272716
MEIKDQGAQMEPLLPTRNDEEAVVDRGGTRSILKTHFEKEDLEGHRTLFIGVHVPLGGRKSHRRHRHRGHKHRKRDRERDSGLEDGRESPSFDTPSQRVQFILGTEDDDEEHIPHDLFTELDEICWREGEDAEWRETARWLKFEEDVEDGGERWSKPYVATLSLHSLFELRSCILNGTVLLDMHANTLEEIADMVLDQQVSSGQLNEDVRHRVHEALMKQHHHQNQKKLTNRIPIVRSFADIGKKQSEPNSMDKNAGQVVSPQSAPACVENKNDVSRENSTVDFSKVDLHFMKKIPPGAEASNILVGELEFLDRTVVAFVRLSPAVLLQGLAEVPIPTRFLFILLGPLGKGQQYHEIGRSIATLMTDEVFHDVAYKAKDRNDLVSGIDEFLDQVTVLPPGEWDPSIRIEPPKNVPSQEKRKIPAVPNGTAAHGEAEPHGGHSGPELQRTGRIFGGLILDIKRKAPYFWSDFRDAFSLQCLASFLFLYCACMSPVITFGGLLGEATEGRISAIESLFGASMTGIAYSLFGGQPLTILGSTGPVLVFEKILFKFCKEYGLSYLSLRASIGLWTATLCIILVATDASSLVCYITRFTEEAFASLICIIFIYEALEKLFELSEAYPINMHNDLELLTQYSCNCVEPHNPSNGTLKEWRESNISASDIIWENLTVSECKSLHGEYVGRACGHDHPYVPDVLFWSVILFFSTVTLSATLKQFKTSRYFPTKVRSIVSDFAVFLTILCMVLIDYAIGIPSPKLQVPSVFKPTRDDRGWFVTPLGPNPWWTVIAAIIPALLCTILIFMDQQITAVIINRKEHKLKKGCGYHLDLLMVAVMLGVCSIMGLPWFVAATVLSITHVNSLKLESECSAPGEQPKFLGIREQRVTGLMIFILMGSSVFMTSILKFIPMPVLYGVFLYMGASSLKGIQFFDRIKLFWMPAKHQPDFIYLRHVPLRKVHLFTIIQMSCLGLLWIIKVSRAAIVFPMMVLALVFVRKLMDLLFTKRELSWLDDLMPESKKKKLEDAEKEEEQSMLAMEDEGTVQLPLEGHYRDDPSVINISDEMSKTALWRNLLITADNSKDKESSFPSKSIESRKEKKADSGKGVDRETCL

SEQ ID NO: 81766 - protein, 1099 aa, Homo sapiens
  Payload ID: 16282
  Gene Symbol: SLC4A10
  Gene Name: solute carrier family 4, sodium bicarbonate transporter, member 10
  Uniprot ID: Q6U841
  ENSP ID: ENSP00000364664
MQSLGVSGNRKVMQSGTCEPFQSLSHQRNDEEAVVDRGGTRSILKTHFEKEDLEGHRTLFIGVHVPLGGRKSHRRHRHRGHKHRKRDRERDSGLEDGRESPSFDTPSQRVQFILGTEDDDEEHIPHDLFTELDEICWREGEDAEWRETARWLKFEEDVEDGGERWSKPYVATLSLHSLFELRSCILNGTVLLDMHANTLEEIADMVLDQQVSSGQLNEDVRHRVHEALMKQHHHQNQKKLTNRIPIVRSFADIGKKQSEPNSMDKNAGQVVSPQSAPACVENKNDVSRENSTVDFSKVDLHFMKKIPPGAEASNILVGELEFLDRTVVAFVRLSPAVLLQGLAEVPIPTRFLFILLGPLGKGQQYHEIGRSIATLMTDEVFHDVAYKAKDRNDLVSGIDEFLDQVTVLPPGEWDPSIRIEPPKNVPSQEKRKIPAVPNGTAAHGEAEPHGGHSGPELQRTGRIFGGLILDIKRKAPYFWSDFRDAFSLQCLASFLFLYCACMSPVITFGGLLGEATEGRISAIESLFGASMTGIAYSLFGGQPLTILGSTGPVLVFEKILFKFCKEYGLSYLSLRASIGLWTATLCIILVATDASSLVCYITRFTEEAFASLICIIFIYEALEKLFELSEAYPINMHNDLELLTQYSCNCVEPHNPSNGTLKEWRESNISASDIIWENLTVSECKSLHGEYVGRACGHDHPYVPDVLFWSVILFFSTVTLSATLKQFKTSRYFPTKVRSIVSDFAVFLTILCMVLIDYAIGIPSPKLQVPSVFKPTRDDRGWFVTPLGPNPWWTVIAAIIPALLCTILIFMDQQITAVIINRKEHKLKKGCGYHLDLLMVAVMLGVCSIMGLPWFVAATVLSITHVNSLKLESECSAPGEQPKFLGIREQRVTGLMIFILMGSSVFMTSILKFIPMPVLYGVFLYMGASSLKGIQFFDRIKLFWMPAKHQPDFIYLRHVPLRKVHLFTIIQMSCLGLLWIIKVSRAAIVFPMMVLALVFVRKLMDLLFTKRELSWLDDLMPESKKKKLEDAEKEEEQSMLAMEDEGTVQLPLEGHYRDDPSVINISDEMSKTALWRNLLITADNSKDKESSFPSKSSPS

SEQ ID NO: 81767 - protein, 469 aa, Homo sapiens
  Payload ID: 16282
  Gene Symbol: SLC4A10
  Gene Name: solute carrier family 4, sodium bicarbonate transporter, member 10
  ENSP ID: ENSP00000389180
MEIKDQGAQMEPLLPTRNDEEAVVDRGGTRSILKTHFEKEDLEGHRTLFIGVHVPLGGRKSHRRHRHRGHKHRKRDRERDSGLEDGRESPSFDTPSQRVQFILGTEDDDEEHIPHDLFTELDEICWREGEDAEWRETARWLKFEEDVEDGGERWSKPYVATLSLHSLFELRSCILNGTVLLDMHANTLEEIADMVLDQQVSSGQLNEDVRHRVHEALMKQHHHQNQKKLTNRIPIVRSFADIGKKQSEPNSMDKNAGQVVSPQSAPACVENKNDVSRENSTVDFSKVDLHFMKKIPPGAEASNILVGELEFLDRTVVAFVRLSPAVLLQGLAEVPIPTRFLFILLGPLGKGQQYHEIGRSIATLMTDEVFHDVAYKAKDRNDLVSGIDEFLDQVTVLPPGEWDPSIRIEPPKNVPSQEKRKIPAVPNGTAAHGEAEPHGGHSGPELQRTGRSPISGIFASPEFFHRFCC

SEQ ID NO: 81768 - protein, 1118 aa, Homo sapiens
  Payload ID: 16282
  Gene Symbol: SLC4A10
  Gene Name: solute carrier family 4, sodium bicarbonate transporter, member 10
  Uniprot ID: Q6U841
  ENSP ID: ENSP00000393066
MEIKDQGAQMEPLLPTRNDEEAVVDRGGTRSILKTHFEKEDLEGHRTLFIGVHVPLGGRKSHRRHRHRGHKHRKRDRERDSGLEDGRESPSFDTPSQRVQFILGTEDDDEEHIPHDLFTELDEICWREGEDAEWRETARWLKFEEDVEDGGERWSKPYVATLSLHSLFELRSCILNGTVLLDMHANTLEEIADMVLDQQVSSGQLNEDVRHRVHEALMKQHHHQNQKKLTNRIPIVRSFADIGKKQSEPNSMDKNAGQVVSPQSAPACVENKNDVSRENSTVDFSKGLGGQQKGHTSPCGMKQRHEKGPPHQQEREVDLHFMKKIPPGAEASNILVGELEFLDRTVVAFVRLSPAVLLQGLAEVPIPTRFLFILLGPLGKGQQYHEIGRSIATLMTDEVFHDVAYKAKDRNDLVSGIDEFLDQVTVLPPGEWDPSIRIEPPKNVPSQEKRKIPAVPNGTAAHGEAEPHGGHSGPELQRTGRIFGGLILDIKRKAPYFWSDFRDAFSLQCLASFLFLYCACMSPVITFGGLLGEATEGRISAIESLFGASMTGIAYSLFGGQPLTILGSTGPVLVFEKILFKFCKEYGLSYLSLRASIGLWTATLCIILVATDASSLVCYITRFTEEAFASLICIIFIYEALEKLFELSEAYPINMHNDLELLTQYSCNCVEPHNPSNGTLKEWRESNISASDIIWENLTVSECKSLHGEYVGRACGHDHPYVPDVLFWSVILFFSTVTLSATLKQFKTSRYFPTKVRSIVSDFAVFLTILCMVLIDYAIGIPSPKLQVPSVFKPTRDDRGWFVTPLGPNPWWTVIAAIIPALLCTILIFMDQQITAVIINRKEHKLKKGCGYHLDLLMVAVMLGVCSIMGLPWFVAATVLSITHVNSLKLESECSAPGEQPKFLGIREQRVTGLMIFILMGSSVFMTSILKFIPMPVLYGVFLYMGASSLKGIQFFDRIKLFWMPAKHQPDFIYLRHVPLRKVHLFTIIQMSCLGLLWIIKVSRAAIVFPMMVLALVFVRKLMDLLFTKRELSWLDDLMPESKKKKLEDAEKEEEQSMLAMEDEGTVQLPLEGHYRDDPSVINISDEMSKTALWRNLLITADNSKDKESSFPSKSSPS

SEQ ID NO: 81769 - protein, 1088 aa, Homo sapiens
  Payload ID: 16282
  Gene Symbol: SLC4A10
  Gene Name: solute carrier family 4, sodium bicarbonate transporter, member 10
  Uniprot ID: Q6U841
  ENSP ID: ENSP00000395797
MEIKDQGAQMEPLLPTRNDEEAVVDRGGTRSILKTHFEKEDLEGHRTLFIGVHVPLGGRKSHRRHRHRGHKHRKRDRERDSGLEDGRESPSFDTPSQRVQFILGTEDDDEEHIPHDLFTELDEICWREGEDAEWRETARWLKFEEDVEDGGERWSKPYVATLSLHSLFELRSCILNGTVLLDMHANTLEEIADMVLDQQVSSGQLNEDVRHRVHEALMKQHHHQNQKKLTNRIPIVRSFADIGKKQSEPNSMDKNAGQVVSPQSAPACVENKNDVSRENSTVDFSKVDLHFMKKIPPGAEASNILVGELEFLDRTVVAFVRLSPAVLLQGLAEVPIPTRFLFILLGPLGKGQQYHEIGRSIATLMTDEVFHDVAYKAKDRNDLVSGIDEFLDQVTVLPPGEWDPSIRIEPPKNVPSQEKRKIPAVPNGTAAHGEAEPHGGHSGPELQRTGRIFGGLILDIKRKAPYFWSDFRDAFSLQCLASFLFLYCACMSPVITFGGLLGEATEGRISAIESLFGASMTGIAYSLFGGQPLTILGSTGPVLVFEKILFKFCKEYGLSYLSLRASIGLWTATLCIILVATDASSLVCYITRFTEEAFASLICIIFIYEALEKLFELSEAYPINMHNDLELLTQYSCNCVEPHNPSNGTLKEWRESNISASDIIWENLTVSECKSLHGEYVGRACGHDHPYVPDVLFWSVILFFSTVTLSATLKQFKTSRYFPTKVRSIVSDFAVFLTILCMVLIDYAIGIPSPKLQVPSVFKPTRDDRGWFVTPLGPNPWWTVIAAIIPALLCTILIFMDQQITAVIINRKEHKLKKGCGYHLDLLMVAVMLGVCSIMGLPWFVAATVLSITHVNSLKLESECSAPGEQPKFLGIREQRVTGLMIFILMGSSVFMTSILKFIPMPVLYGVFLYMGASSLKGIQFFDRIKLFWMPAKHQPDFIYLRHVPLRKVHLFTIIQMSCLGLLWIIKVSRAAIVFPMMVLALVFVRKLMDLLFTKRELSWLDDLMPESKKKKLEDAEKEEEQSMLAMEDEGTVQLPLEGHYRDDPSVINISDEMSKTALWRNLLITADNSKDKESSFPSKSSPS

SEQ ID NO: 81770 - protein, 1054 aa, Homo sapiens
  Payload ID: 16282
  Gene Symbol: SLC4A10
  Gene Name: solute carrier family 4, sodium bicarbonate transporter, member 10
  ENSP ID: ENSP00000404486
MEIKDQGAQMEPLLPTRNDEEAVVDRGGTRSILKTHFEKEDLEGHRTLFIGVHVPLGGRKSHRRHRHRGHKHRKRDRERDSGLEDGRESPSFDTPSQRVQFILGTEDDDEEHIPHDLFTELDEICWREGEDAEWRETARWLKFEEDVEDGGERWSKPYVATLSLHSLFELRSCILNGTVLLDMHANTLEEIADMVLDQQVSSGQLNEDVRHRVHEALMKQHHHQNQKKLTNRIPIVRSFADIGKKQSEPNSMDKNAGQVVSPQSAPACVENKNDVSRENSTVDFSKGLGGQQKGHTSPCGMKQRHEKGPPHQQEREVDLHFMKKIPPGAEASNILVGELEFLDRTVVAFVRLSPAVLLQGLAEVPIPTRFLFILLGPLGKGQQYHEIGRSIATLMTDEVFHDVAYKAKDRNDLVSGIDEFLDQVTVLPPGEWDPSIRIEPPKNVPSQEKRKIPAVPNGTAAHGEAEPHGGHSGPELQRTGRIFGGLILDIKRKAPYFWSDFRDAFSLQCLASFLFLYCACMSPVITFGGLLGEATEGRISAIESLFGASMTGIAYSLFGGQPLTILGSTGPVLVFEKILFKFCKEYGLSYLSLRASIGLWTATLCIILVATDASSLVCYITRFTEEAFASLICIIFIYEALEKLFELSEAYPINMHNDLELLTQYSCNCVEPHNPSNGTLKEWRESNISASDIIWENLTVSECKSLHGEYVGRACGHDHPYVPDVLFWSVILFFSTVTLSATLKQFKTSRYFPTKVRSIVSDFAVFLTILCMVLIDYAIGIPSPKLQVPSVFKPTRDDRGWFVTPLGPNPWWTVIAAIIPALLCTILIFMDQQITAVIINRKEHKLKKGCGYHLDLLMVAVMLGVCSIMGLPWFVAATVLSITHVNSLKLESECSAPGEQPKFLGIREQRVTGLMIFILMGSSVFMTSILKFIPMPVLYGVFLYMGASSLKGIQFFDRIKLFWMPAKHQPDFIYLRHVPLRKVHLFTIIQMSCLGLLWIIKVSRAAIVFPMMVLALVFVRKLMDLLFTKRELSWLDDLMPESKKKKLEDAEKEH

SEQ ID NO: 81771 - protein, 891 aa, Homo sapiens
  Payload ID: 16283
  Gene Symbol: SLC4A11
  Gene Name: solute carrier family 4, sodium borate transporter, member 11
  Uniprot ID: Q8NBS3
  ENSP ID: ENSP00000369396
MSQVGGRGDRCTQEVQGLVHGAGDLSASLAENSPTMSQNGYFEDSSYYKCDTDDTFEAREEILGDEAFDTANSSIVSGESIRFFVNVNLEMQATNTENEATSGGCVLLHTSRKYLKLKNFKEEIRAHRDLDGFLAQASIVLNETATSLDNVLRTMLRRFARDPDNNEPNCNLDLLMAMLFTDAGAPMRGKVHLLSDTIQGVTATVTGVRYQQSWLCIICTMKALQKRHVCISRLVRPQNWGENSCEVRFVILVLAPPKMKSTKTAMEVARTFATMFSDIAFRQKLLETRTEEEFKEALVHQRQLLTMVSHGPVAPRTKERSTVSLPAHRHPEPPKCKDFVPFGKGIREDIARRFPLYPLDFTDGIIGKNKAVGKYITTTLFLYFACLLPTIAFGSLNDENTDGAIDVQKTIAGQSIGGLLYALFSGQPLVILLTTAPLALYIQVIRVICDDYDLDFNSFYAWTGLWNSFFLALYAFFNLSLVMSLFKRSTEEIIALFISITFVLDAVKGTVKIFWKYYYGHYLDDYHTKRTSSLVSLSGLGASLNASLHTALNASFLASPTELPSATHSGQATAVLSLLIMLGTLWLGYTLYQFKKSPYLHPCVREILSDCALPIAVLAFSLISSHGFREIEMSKFRYNPSESPFAMAQIQSLSLRAVSGAMGLGFLLSMLFFIEQNLVAALVNAPENRLVKGTAYHWDLLLLAIINTGLSLFGLPWIHAAYPHSPLHVRALALVEERVENGHIYDTIVNVKETRLTSLGASVLVGLSLLLLPVPLQWIPKPVLYGLFLYIALTSLDGNQLVQRVALLLKEQTAYPPTHYIRRVPQRKIHYFTGLQVLQLLLLCAFGMSSLPYMKMIFPLIMIAMIPIRYILLPRIIEAKYLDVMDAEHRP

SEQ ID NO: 81772 - protein, 918 aa, Homo sapiens
  Payload ID: 16283
  Gene Symbol: SLC4A11
  Gene Name: solute carrier family 4, sodium borate transporter, member 11
  Uniprot ID: Q8NBS3
  ENSP ID: ENSP00000369399
MGVYGPQDRSESEKRDVQRDPPPWHPRREGERPARARSLPLAAAGQGFLRKTWISEHENSPTMSQNGYFEDSSYYKCDTDDTFEAREEILGDEAFDTANSSIVSGESIRFFVNVNLEMQATNTENEATSGGCVLLHTSRKYLKLKNFKEEIRAHRDLDGFLAQASIVLNETATSLDNVLRTMLRRFARDPDNNEPNCNLDLLMAMLFTDAGAPMRGKVHLLSDTIQGVTATVTGVRYQQSWLCIICTMKALQKRHVCISRLVRPQNWGENSCEVRFVILVLAPPKMKSTKTAMEVARTFATMFSDIAFRQKLLETRTEEEFKEALVHQRQLLTMVSHGPVAPRTKERSTVSLPAHRHPEPPKCKDFVPFGKGIREDIARRFPLYPLDFTDGIIGKNKAVGKYITTTLFLYFACLLPTIAFGSLNDENTDGAIDVQKTIAGQSIGGLLYALFSGQPLVILLTTAPLALYIQVIRVICDDYDLDFNSFYAWTGLWNSFFLALYAFFNLSLVMSLFKRSTEEIIALFISITFVLDAVKGTVKIFWKYYYGHYLDDYHTKRTSSLVSLSGLGASLNASLHTALNASFLASPTELPSATHSGQATAVLSLLIMLGTLWLGYTLYQFKKSPYLHPCVREILSDCALPIAVLAFSLISSHGFREIEMSKFRYNPSESPFAMAQIQSLSLRAVSGAMGLGFLLSMLFFIEQNLVAALVNAPENRLVKGTAYHWDLLLLAIINTGLSLFGLPWIHAAYPHSPLHVRALALVEERVENGHIYDTIVNVKETRLTSLGASVLVGLSLLLLPVPLQWIPKPVLYGLFLYIALTSLDGNQLVQRVALLLKEQTAYPPTHYIRRVPQRKIHYFTGLQVLQLLLLCAFGMSSLPYMKMIFPLIMIAMIPIRYILLPRIIEAKYLDVMDAEHRP

SEQ ID NO: 81773 - protein, 104 aa, Homo sapiens
  Payload ID: 16283
  Gene Symbol: SLC4A11
  Gene Name: solute carrier family 4, sodium borate transporter, member 11
  ENSP ID: ENSP00000404271
MSQNGYFEDSSYYKCDTDDTFEAREEILGDEAFDTANSSIVSGESIRFFVNVNLEMQATNTENEATSGGCVLLHTSRKYLKLKNFKEEIRAHRDLDGFLAQASI

SEQ ID NO: 81774 - protein, 875 aa, Homo sapiens
  Payload ID: 16283
  Gene Symbol: SLC4A11
  Gene Name: solute carrier family 4, sodium borate transporter, member 11
  Uniprot ID: Q8NBS3
  ENSP ID: ENSP00000441370
MAAATRRVFHLQPCENSPTMSQNGYFEDSSYYKCDTDDTFEAREEILGDEAFDTANSSIVSGESIRFFVNVNLEMQATNTENEATSGGCVLLHTSRKYLKLKNFKEEIRAHRDLDGFLAQASIVLNETATSLDNVLRTMLRRFARDPDNNEPNCNLDLLMAMLFTDAGAPMRGKVHLLSDTIQGVTATVTGVRYQQSWLCIICTMKALQKRHVCISRLVRPQNWGENSCEVRFVILVLAPPKMKSTKTAMEVARTFATMFSDIAFRQKLLETRTEEEFKEALVHQRQLLTMVSHGPVAPRTKERSTVSLPAHRHPEPPKCKDFVPFGKGIREDIARRFPLYPLDFTDGIIGKNKAVGKYITTTLFLYFACLLPTIAFGSLNDENTDGAIDVQKTIAGQSIGGLLYALFSGQPLVILLTTAPLALYIQVIRVICDDYDLDFNSFYAWTGLWNSFFLALYAFFNLSLVMSLFKRSTEEIIALFISITFVLDAVKGTVKIFWKYYYGHYLDDYHTKRTSSLVSLSGLGASLNASLHTALNASFLASPTELPSATHSGQATAVLSLLIMLGTLWLGYTLYQFKKSPYLHPCVREILSDCALPIAVLAFSLISSHGFREIEMSKFRYNPSESPFAMAQIQSLSLRAVSGAMGLGFLLSMLFFIEQNLVAALVNAPENRLVKGTAYHWDLLLLAIINTGLSLFGLPWIHAAYPHSPLHVRALALVEERVENGHIYDTIVNVKETRLTSLGASVLVGLSLLLLPVPLQWIPKPVLYGLFLYIALTSLDGNQLVQRVALLLKEQTAYPPTHYIRRVPQRKIHYFTGLQVLQLLLLCAFGMSSLPYMKMIFPLIMIAMIPIRYILLPRIIEAKYLDVMDAEHRP

SEQ ID NO: 81775 - protein, 574 aa, Homo sapiens
  Payload ID: 16283
  Gene Symbol: SLC4A11
  Gene Name: solute carrier family 4, sodium borate transporter, member 11
  ENSP ID: ENSP00000476859
MSQNGYFEDSSYYKCDTDDTFEAREEILGDEAFDTANSSIVSGESIRFFVNVNLEMQATNTENEATSGGCVLLHTSRKYLKLKNFKEEIRAHRDLDGFLAQASIVLNETATSLDNVLRTMLRRFARDPDNNEPNCNLDLLMAMLFTDAGAPMRGKVHLLSDTIQGVTATVTGVRYQQSWLCIICTMKALQKRHVCISRLVRPQNWGENSCEVRFVILVLAPPKMKSTKTAMEVARTFATMFSDIAFRQKLLETRTEEEFKEALVHQRQLLTMVSHGPVAPRTKERSTVSLPAHRHPEPPKCKDFVPFGKGIREDIARRFPLYPLDFTDGIIGKNKAVGKYITTTLFLYFACLLPTIAFGSLNDENTDGAIDVQKTIAGQSIGGLLYALFSGQPLVILLTTAPLALYIQVIRVICDDYDLDFNSFYAWTGLWNSFFLALYAFFNLSLVMSLFKRSTEEIIALFISITFVLDAVKGTVKTCQASAPASTPASTLPSTPASSPAPRSCPRPHTQARRPPCSASSSCWARSGWATPSTNSRRAPTCTPACERSCPTAPCPSRCSPSPSSAPMASGKSR

SEQ ID NO: 81776 - protein, 571 aa, Homo sapiens
  Payload ID: 16284
  Gene Symbol: SLC40A1
  Gene Name: solute carrier family 40 (iron-regulated transporter), member 1
  Uniprot ID: Q9NP59
  ENSP ID: ENSP00000261024
MTRAGDHNRQRGCCGSLADYLTSAKFLLYLGHSLSTWGDRMWHFAVSVFLVELYGNSLLLTAVYGLVVAGSVLVLGAIIGDWVDKNARLKVAQTSLVVQNVSVILCGIILMMVFLHKHELLTMYHGWVLTSCYILIITIANIANLASTATAITIQRDWIVVVAGEDRSKLANMNATIRRIDQLTNILAPMAVGQIMTFGSPVIGCGFISGWNLVSMCVEYVLLWKVYQKTPALAVKAGLKEEETELKQLNLHKDTEPKPLEGTHLMGVKDSNIHELEHEQEPTCASQMAEPFRTFRDGWVSYYNQPVFLAGMGLAFLYMTVLGFDCITTGYAYTQGLSGSILSILMGASAITGIMGTVAFTWLRRKCGLVRTGLISGLAQLSCLILCVISVFMPGSPLDLSVSPFEDIRSRFIQGESITPTKIPEITTEIYMSNGSNSANIVPETSPESVPIISVSLLFAGVIAARIGLWSFDLTVTQLLQENVIESERGIINGVQNSMNYLLDLLHFIMVILAPNPEAFGLLVLISVSFVAMGHIMYFRFAQNTLGNKLFACGPDAKEVRKENQANTSVV

SEQ ID NO: 81777 - protein, 200 aa, Homo sapiens
  Payload ID: 16284
  Gene Symbol: SLC40A1
  Gene Name: solute carrier family 40 (iron-regulated transporter), member 1
  ENSP ID: ENSP00000390005
MTRAGDHNRQRGCCGSLADYLTSAKFLLYLGHSLSTWGDRMWHFAVSVFLVELYGNSLLLTAVYGLVVAGSVLVLGAIIGDWVDKNARLKVAQTSLVVQNVSVILCGIILMMVFLHKHELLTMYHGWVLTSCYILIITIANIANLASTATAITIQRDWIVVVAGEDRSKLANMNATIRRIDQLTNILAPMAVGQIMTFGS

SEQ ID NO: 81778 - protein, 25 aa, Homo sapiens
  Payload ID: 16284
  Gene Symbol: SLC40A1
  Gene Name: solute carrier family 40 (iron-regulated transporter), member 1
  ENSP ID: ENSP00000392730
MTRAGDHNRQRGCCGSLADYLTSAK

SEQ ID NO: 81779 - protein, 25 aa, Homo sapiens
  Payload ID: 16284
  Gene Symbol: SLC40A1
  Gene Name: solute carrier family 40 (iron-regulated transporter), member 1
  ENSP ID: ENSP00000396134
MTRAGDHNRQRGCCGSLADYLTSAK

SEQ ID NO: 81780 - protein, 55 aa, Homo sapiens
  Payload ID: 16284
  Gene Symbol: SLC40A1
  Gene Name: solute carrier family 40 (iron-regulated transporter), member 1
  ENSP ID: ENSP00000413549
MTRAGDHNRQRGCCGSLADYLTSAKFLLYLGHSLSTWGDRMWHFAVSVFLVELYG

SEQ ID NO: 81781 - protein, 513 aa, Homo sapiens
  Payload ID: 16285
  Gene Symbol: SLC41A1
  Gene Name: solute carrier family 41 (magnesium transporter), member 1
  Uniprot ID: Q8IVJ1
  ENSP ID: ENSP00000356105
MSSKPEPKDVHQLNGTGPSASPCSSDGPGREPLAGTSEFLGPDGAGVEVVIESRANAKGVREEDALLENGSQSNESDDVSTDRGPAPPSPLKETSFSIGLQVLFPFLLAGFGTVAAGMVLDIVQHWEVFQKVTEVFILVPALLGLKGNLEMTLASRLSTAANIGHMDTPKELWRMITGNMALIQVQATVVGFLASIAAVVFGWIPDGHFSIPHAFLLCASSVATAFIASLVLGMIMIGVIIGSRKIGINPDNVATPIAASLGDLITLALLSGISWGLYLELNHWRYIYPLVCAFFVALLPVWVVLARRSPATREVLYSGWEPVIIAMAISSVGGLILDKTVSDPNFAGMAVFTPVINGVGGNLVAVQASRISTFLHMNGMPGENSEQAPRRCPSPCTTFFSPDVNSRSARVLFLLVVPGHLVFLYTISCMQGGHTTLTLIFIIFYMTAALLQVLILLYIADWMVHWMWGRGLDPDNFSIPYLTALGDLLGTGLLALSFHVLWLIGDRDTDVGD

SEQ ID NO: 81782 - protein, 573 aa, Homo sapiens
  Payload ID: 16286
  Gene Symbol: SLC41A2
  Gene Name: solute carrier family 41 (magnesium transporter), member 2
  Uniprot ID: Q96JW4
  ENSP ID: ENSP00000258538
MTNSKGRSITDKTSGGPSSGGGFVDWTLRLNTIQSDKFLNLLLSMVPVIYQKNQEDRHKKANGIWQDGLSTAVQTFSNRSEQHMEYHSFSEQSFHANNGHASSSCSQKYDDYANYNYCDGRETSETTAMLQDEDISSDGDEDAIVEVTPKLPKESSGIMALQILVPFLLAGFGTVSAGMVLDIVQHWEVFRKVTEVFILVPALLGLKGNLEMTLASRLSTAVNIGKMDSPIEKWNLIIGNLALKQVQATVVGFLAAVAAIILGWIPEGKYYLDHSILLCSSSVATAFIASLLQGIIMVGVIVGSKKTGINPDNVATPIAASFGDLITLAILAWISQGLYSCLETYYYISPLVGVFFLALTPIWIIIAAKHPATRTVLHSGWEPVITAMVISSIGGLILDTTVSDPNLVGIVVYTPVINGIGGNLVAIQASRISTYLHLHSIPGELPDEPKGCYYPFRTFFGPGVNNKSAQVLLLLVIPGHLIFLYTIHLMKSGHTSLTIIFIVVYLFGAVLQVFTLLWIADWMVHHFWRKGKDPDSFSIPYLTALGDLLGTALLALSFHFLWLIGDRDGDVGD

SEQ ID NO: 81783 - protein, 149 aa, Homo sapiens
  Payload ID: 16286
  Gene Symbol: SLC41A2
  Gene Name: solute carrier family 41 (magnesium transporter), member 2
  ENSP ID: ENSP00000391377
  MOD_RES (1)..(1): Any amino acid
XDDYANYNYCDGRETSETTAMLQDEDISSDGDEDAIVEVTPKLPKESSGIMALQILVPFLLAGFGTVSAGMVLDIVQVNIGKMDSPIEKWNLIIGNLALKQVQATVVGFLAAVAAIILGWIPEGKYYLDHSILLCSSSVATAFIASLLQ

SEQ ID NO: 81784 - protein, 76 aa, Homo sapiens
  Payload ID: 16286
  Gene Symbol: SLC41A2
  Gene Name: solute carrier family 41 (magnesium transporter), member 2
  ENSP ID: ENSP00000395550
MTNSKGRSITDKTSGGPSSGGGFVDWTLRLNTIQSDKFLNLLLSMVPVIYQKNQEDRHKKANGIWQDGLSTAVQTF

SEQ ID NO: 81785 - protein, 46 aa, Homo sapiens
  Payload ID: 16286
  Gene Symbol: SLC41A2
  Gene Name: solute carrier family 41 (magnesium transporter), member 2
  ENSP ID: ENSP00000396297
MTNSKGRSITDKTSGGPSSGGGFVDWTLRLNTIQSDKFLNLLLSMV

SEQ ID NO: 81786 - protein, 143 aa, Homo sapiens
  Payload ID: 16286
  Gene Symbol: SLC41A2
  Gene Name: solute carrier family 41 (magnesium transporter), member 2
  ENSP ID: ENSP00000396429
MTNSKGRSITDKTSGGPSSGGGFVDWTLRLNTIQSDKFLNLLLSMVPVIYQKNQEDRHKKANGIWQDGLSTAVQTFSNRSEQHMEYHSFSEQSFHANNGHASSSCSQKYDDYANYNYCDGRETSETTAMLQDEDISSDGDEDA

SEQ ID NO: 81787 - protein, 72 aa, Homo sapiens
  Payload ID: 16286
  Gene Symbol: SLC41A2
  Gene Name: solute carrier family 41 (magnesium transporter), member 2
  ENSP ID: ENSP00000397315
MTNSKGRSITDKTSGGPSSGGGFVDWTLRLNTIQSDKFLNLLLSMVPVIYQKNQEDRHKKANGIWQDGLSTA

SEQ ID NO: 81788 - protein, 122 aa, Homo sapiens
  Payload ID: 16286
  Gene Symbol: SLC41A2
  Gene Name: solute carrier family 41 (magnesium transporter), member 2
  ENSP ID: ENSP00000407898
MTNSKGRSITDKTSGGPSSGGGFVDWTLRLNTIQSDKFLNLLLSMVPVIYQKNQEDRHKKANGIWQDGLSTAVQTFSNRSEQHMEYHSFSEQSFHANNGHASSSCSQKYDDYANYNYCDGRE

SEQ ID NO: 81789 - protein, 12 aa, Homo sapiens
  Payload ID: 16286
  Gene Symbol: SLC41A2
  Gene Name: solute carrier family 41 (magnesium transporter), member 2
  ENSP ID: ENSP00000410625
MTNSKGRSITDK

SEQ ID NO: 81790 - protein, 94 aa, Homo sapiens
  Payload ID: 16286
  Gene Symbol: SLC41A2
  Gene Name: solute carrier family 41 (magnesium transporter), member 2
  ENSP ID: ENSP00000414526
MTNSKGRSITDKTSGGPSSGGGFVDWTLRLNTIQSDKFLNLLLSMVPVIYQKNQEDRHKKANGIWQDGLSTAVQTFSNRSEQHMEYHSFSEQSF

SEQ ID NO: 81791 - protein, 471 aa, Homo sapiens
  Payload ID: 16287
  Gene Symbol: SLC41A3
  Gene Name: solute carrier family 41, member 3
  Uniprot ID: Q96GZ6
  ENSP ID: ENSP00000264471
MDGTETRQRRLDSCGKPGELGLPHPLSTGGLPVASEDGALRAPESQSVTPKPLETEPSRETTWSIGLQVTVPFMFAGLGLSWAGMLLDYFQANTGQIDDPQEQHRVISSNLALIQVQATVVGLLAAVAALLLGVVSREEVDVAKVELLCASSVLTAFLAAFALGVLMVCIVIGARKLGVNPDNIATPIAASLGDLITLSILALVSSFFYRHKDSRYLTPLVCLSFAALTPVWVLIAKQSPPIVKILKFGWFPIILAMVISSFGGLILSKTVSKQQYKGMAIFTPVICGVGGNLVAIQTSRISTYLHMWSAPGVLPLQMKKFWPNPCSTFCTSEINSMSARVLLLLVVPGHLIFFYIIYLVEGQSVINSQTFVVLYLLAGLIQVTILLYLAEVMVRLTWHQALDPDNHCIPYLTGLGDLLGSSSVGHTAAVPRRCTASPGWGLIQPFICTQHLIVSLLSFYFPFCLLAKTSI

SEQ ID NO: 81792 - protein, 507 aa, Homo sapiens
  Payload ID: 16287
  Gene Symbol: SLC41A3
  Gene Name: solute carrier family 41, member 3
  Uniprot ID: Q96GZ6
  ENSP ID: ENSP00000326070
MDGTETRQRRLDSCGKPGELGLPHPLSTGGLPVASEDGALRAPESQSVTPKPLETEPSRETTWSIGLQVTVPFMFAGLGLSWAGMLLDYFQHWPVFVEVKDLLTLVPPLVGLKGNLEMTLASRLSTAANTGQIDDPQEQHRVISSNLALIQVQATVVGLLAAVAALLLGVVSREEVDVAKVELLCASSVLTAFLAAFALGVLMVCIVIGARKLGVNPDNIATPIAASLGDLITLSILALVSSFFYRHKDSRYLTPLVCLSFAALTPVWVLIAKQSPPIVKILKFGWFPIILAMVISSFGGLILSKTVSKQQYKGMAIFTPVICGVGGNLVAIQTSRISTYLHMWSAPGVLPLQMKKFWPNPCSTFCTSEINSMSARVLLLLVVPGHLIFFYIIYLVEGQSVINSQTFVVLYLLAGLIQVTILLYLAEVMVRLTWHQALDPDNHCIPYLTGLGDLLGSSSVGHTAAVPRRCTASPGWGLIQPFICTQHLIVSLLSFYFPFCLLAKTSI

SEQ ID NO: 81793 - protein, 487 aa, Homo sapiens
  Payload ID: 16287
  Gene Symbol: SLC41A3
  Gene Name: solute carrier family 41, member 3
  Uniprot ID: Q96GZ6
  ENSP ID: ENSP00000353533
MDGTETRQRRLDSCGKPGELGLPHPLSTGGLPVASEDGALRAPESQSVTPKPLETEPSRETTWSIGLQVTVPFMFAGLGLSWAGMLLDYFQHWPVFVEVKDLLTLVPPLVGLKGNLEMTLASRLSTAANTGQIDDPQEQHRVISSNLALIQVQATVVGLLAAVAALLLGVVSREEVDVAKVELLCASSVLTAFLAAFALGVLMVCIVIGARKLGVNPDNIATPIAASLGDLITLSILALVSSFFYRHKDSRYLTPLVCLSFAALTPVWVLIAKQSPPIVKILKFGWFPIILAMVISSFGGLILSKTVSKQQYKGMAIFTPVICGVGGNLVAIQTSRISTYLHMWSAPGVLPLQMKKFWPNPCSTFCTSEINSMSARVLLLLVVPGHLIFFYIIYLVEGQSVINSQTFVVLYLLAGLIQVTILLYLAEVMVRLTWHQALDPDNHCIPYLTGLGDLLGTGLLALCFFTDWLLKSKAELGGISELASGPP

SEQ ID NO: 81794 - protein, 461 aa, Homo sapiens
  Payload ID: 16287
  Gene Symbol: SLC41A3
  Gene Name: solute carrier family 41, member 3
  Uniprot ID: Q96GZ6
  ENSP ID: ENSP00000373092
MVVTQLNLEFCFQGKKLRGFSCELTRSPHGVLPESFFTIMCQVVVPILLSGLCMMTAGLVMNTIQHWPVFVEVKDLLTLVPPLVGLKGNLEMTLASRLSTAANTGQIDDPQEQHRVISSNLALIQVQATVVGLLAAVAALLLGVVSREEVDVAKVELLCASSVLTAFLAAFALGVLMVCIVIGARKLGVNPDNIATPIAASLGDLITLSILALVSSFFYRHKDSRYLTPLVCLSFAALTPVWVLIAKQSPPIVKILKFGWFPIILAMVISSFGGLILSKTVSKQQYKGMAIFTPVICGVGGNLVAIQTSRISTYLHMWSAPGVLPLQMKKFWPNPCSTFCTSEINSMSARVLLLLVVPGHLIFFYIIYLVEGQSVINSQTFVVLYLLAGLIQVTILLYLAEVMVRLTWHQALDPDNHCIPYLTGLGDLLGTGLLALCFFTDWLLKSKAELGGISELASGPP

SEQ ID NO: 81795 - protein, 201 aa, Homo sapiens
  Payload ID: 16287
  Gene Symbol: SLC41A3
  Gene Name: solute carrier family 41, member 3
  ENSP ID: ENSP00000421008
MDGTETRQRRLDSCGKPGELGLPHPLSTGGLPVASEDGALRAPESQSVTPKPLETEPSRETTWSIGLQVTVPFMFAGLGLSWAGMLLDYFQHWPVFVEVKDLLTLVPPLVGLKGNLEMTLASRLSTAANTGQIDDPQEQHRVISSNLALIQVQATVVGLLAAVAALLLGVVSREEVDVAKVELLCASSVLTAFLAAFALGE

SEQ ID NO: 81796 - protein, 152 aa, Homo sapiens
  Payload ID: 16287
  Gene Symbol: SLC41A3
  Gene Name: solute carrier family 41, member 3
  ENSP ID: ENSP00000421940
MDGTETRQRRLDSCGKPGELGLPHPLSTGGLPVASEDGALRAPESQSVTPKPLETEPSRETTWSIGLQVTVPFMFAGLGLSWAGMLLDYFQHWPVFVEVKDLLTLVPPLVGLKGNLEMTLASRLSTAANTGQIDDPQEQHRVISSNLALIQV

SEQ ID NO: 81797 - protein, 85 aa, Homo sapiens
  Payload ID: 16287
  Gene Symbol: SLC41A3
  Gene Name: solute carrier family 41, member 3
  ENSP ID: ENSP00000422150
MDGTETRQRRLDSCGKPGELGLPHPLSTGGLPVASEDGALRAPESQSVTPKPLETEPSRETTWSIGLQVTVPFMFAGLGLSWAGM

SEQ ID NO: 81798 - protein, 137 aa, Homo sapiens
  Payload ID: 16287
  Gene Symbol: SLC41A3
  Gene Name: solute carrier family 41, member 3
  ENSP ID: ENSP00000422458
MDGTETRQRRLDSCGKPGELGLPHPLSTGGLPVASEDGALRAPESQSVTPKPLETEPSRETTWSIGLQVTVPFMFAGLGLSWAGMLLDYFQANTGQIDDPQEQHRVISSNLALIQVQATVVGLLAAVAALLLGVVSR

SEQ ID NO: 81799 - protein, 152 aa, Homo sapiens; identical to SEQ ID NO: 81796
  Payload ID: 16287
  Gene Symbol: SLC41A3
  Gene Name: solute carrier family 41, member 3
  ENSP ID: ENSP00000422531

SEQ ID NO: 81800 - protein, 294 aa, Homo sapiens
  Payload ID: 16287
  Gene Symbol: SLC41A3
  Gene Name: solute carrier family 41, member 3
  ENSP ID: ENSP00000422828
MDGTETRQRRLDSCGKPGELGLPHPLSTGGLPVASEDGALRAPESQSVTPKPLETEPSRETTWSIGLQVTVPFMFAGLGLSWAGMLLDYFQHWPVFVEVKDLLTLVPPLVGLKGNLEMTLASRLSTAVSGHLDIRGGHNVRQANTGQIDDPQEQHRVISSNLALIQVQATVVGLLAAVAALLLGVVSREEVDVAKVELLCASSVLTAFLAAFALGVLMVCIVIGARKLGVNPDNIATPIAASLGDLITLSILALVSSFFYRHKDSRYLTPLVCLSFAALTPVWVLIAKQSPPIV

SEQ ID NO: 81801 - protein, 152 aa, Homo sapiens; identical to SEQ ID NO: 81796
  Payload ID: 16287
  Gene Symbol: SLC41A3
  Gene Name: solute carrier family 41, member 3
  ENSP ID: ENSP00000423154

SEQ ID NO: 81802 - protein, 174 aa, Homo sapiens
  Payload ID: 16287
  Gene Symbol: SLC41A3
  Gene Name: solute carrier family 41, member 3
  ENSP ID: ENSP00000423524
MDGTETRQRRLDSCGKPGELGLPHPLSTGGLPVASEDGALRAPESQSVTPKPLETEPSRETTWSIGLQVTVPFMFAGLGLSWAGMLLDYFQHWPVFVEVKDLLTLVPPLVGLKGNLEMTLASRLSTAVSGHLDIRGGHNVRQVQATVVGLLAAVAALLLGVVSREEVDVAKVEL

SEQ ID NO: 81803 - protein, 138 aa, Homo sapiens
  Payload ID: 16287
  Gene Symbol: SLC41A3
  Gene Name: solute carrier family 41, member 3
  ENSP ID: ENSP00000424882
MDGTETRQRRLDSCGKPGELGLPHPLSTGGLPVASEDGALRAPESQSVTPKPLETEPSRETTWSIGLQVTVPFMFAGLGLSWAGMLLDYFQHWPVFVEVKDLLTLVPPLVGLKGNLEMTLASRLSTAANTGQIDDPQE

SEQ ID NO: 81804 - protein, 65 aa, Homo sapiens
  Payload ID: 16287
  Gene Symbol: SLC41A3
  Gene Name: solute carrier family 41, member 3
  ENSP ID: ENSP00000425311
MTLASRLSTAANTGQIDDPQEQHRVISSNLALIQVQATVVGLLAAVAALLLGVVSREEVDVAKGC

SEQ ID NO: 81805 - protein, 288 aa, Homo sapiens
  Payload ID: 16287
  Gene Symbol: SLC41A3
  Gene Name: solute carrier family 41, member 3
  ENSP ID: ENSP00000425373
MDGTETRQRRLDSCGKPGELGLPHPLSTGGLPVASEDGALRAPESQSVTPKPLETEPSRETTWSIGLQVTVPFMFAGLGLSWAGMLLDYFQGKKLRGFSCELTRSPHGVLPESFFTIMCQVVVPILLSGLCMMTAGLVMNTIQHWPVFVEVKDLLTLVPPLVGLKGNLEMTLASRLSTAANTGQIDDPQEQHRVISSNLALIQVQATVVGLLAAVAALLLGVVSREEVDVAKVELLCASSVLTAFLAAFALGVLMVCIVIGARKLGVNPDNIATPIAASLGDLITLSI

SEQ ID NO: 81806 - protein, 92 aa, Homo sapiens
  Payload ID: 16287
  Gene Symbol: SLC41A3
  Gene Name: solute carrier family 41, member 3
  ENSP ID: ENSP00000427254
MDGTETRQRRLDSCGKPGELGLPHPLSTGGLPVASEDGALRAPESQSVTPKPLETEPSRETTWSIGLQVTVPFMFAGLGLSWAGMLLDYFQF

SEQ ID NO: 81807 - protein, 370 aa, Homo sapiens
  Payload ID: 16287
  Gene Symbol: SLC41A3
  Gene Name: solute carrier family 41, member 3
  Uniprot ID: Q96GZ6
  ENSP ID: ENSP00000427409
MTLASRLSTAANTGQIDDPQEQHRVISSNLALIQVQATVVGLLAAVAALLLGVVSREEVDVAKVELLCASSVLTAFLAAFALGVLMVCIVIGARKLGVNPDNIATPIAASLGDLITLSILALVSSFFYRHKDSRYLTPLVCLSFAALTPVWVLIAKQSPPIVKILKFGWFPIILAMVISSFGGLILSKTVSKQQYKGMAIFTPVICGVGGNLVAIQTSRISTYLHMWSAPGVLPLQMKKFWPNPCSTFCTSEINSMSARVLLLLVVPGHLIFFYIIYLVEGQSVINSQTFVVLYLLAGLIQVTILLYLAEVMVRLTWHQALDPDNHCIPYLTGLGDLLGTGLLALCFFTDWLLKSKAELGGISELASGPP

SEQ ID NO: 81808 - protein, 500 aa, Homo sapiens
  Payload ID: 16287
  Gene Symbol: SLC41A3
  Gene Name: solute carrier family 41, member 3
  Uniprot ID: Q96GZ6
  ENSP ID: ENSP00000480188
MDGTETRQRRLDSCGKPGELGLPHPLSTGGLPVASEDGALRAPESQSVTPKPLETEPSRETTWSIGLQVTVPFMFAGLGLSWAGMLLDYFQHWPVFVEVKDLLTLVPPLVGLKGNLEMTLASRLSTAANTGQIDDPQEQHRVISSNLALIQVQATVVGLLAAVAALLLGVVSREEVDVAKVELLCASSVLTAFLAAFALGVLMVCIVIGARKLGVNPDNIATPIAASLGDLITLSILALVSSFFYRHKDSRYLTPLVCLSFAALTPVWVLIAKQSPPIVKILKFGWFPIILAMVISSFGGLILSKTVSKQQYKGMAIFTPVICGVGGNLVAIQTSRISTYLHMWSAPGVLPLQMKKFWPNPCSTFCTSEINSMSARVLLLLVVPGHLIFFYIIYLVEGQSVINSQTFVVLYLLAGLIQVTILLYLAEVMVRLTWHQALDPDNHCIPYLTGLGDLLGSSSVGHTAAVPRRCTASPGWGLIQPFICTQHLIVSLLSFYFPFC

SEQ ID NO: 81809 - protein, 559 aa, Homo sapiens
  Payload ID: 16288
  Gene Symbol: SLC43A1
  Gene Name: solute carrier family 43 (amino acid system L transporter), member 1
  Uniprot ID: O75387
  ENSP ID: ENSP00000278426
MAPTLQQAYRRRWWMACTAVLENLFFSAVLLGWGSLLIILKNEGFYSSTCPAESSTNTTQDEQRRWPGCDQQDEMLNLGFTIGSFVLSATTLPLGILMDRFGPRPVRLVGSACFTASCTLMALASRDVEALSPLIFLALSLNGFGGICLTFTSLTLPNMFGNLRSTLMALMIGSYASSAITFPGIKLIYDAGVAFVVIMFTWSGLACLIFLNCTLNWPIEAFPAPEEVNYTKKIKLSGLALDHKVTGDLFYTHVTTMGQRLSQKAPSLEDGSDAFMSPQDVRGTSENLPERSVPLRKSLCSPTFLWSLLTMGMTQLRIIFYMAAVNKMLEYLVTGGQEHETNEQQQKVAETVGFYSSVFGAMQLLCLLTCPLIGYIMDWRIKDCVDAPTQGTVLGDARDGVATKSIRPRYCKIQKLTNAISAFTLTNLLLVGFGITCLINNLHLQFVTFVLHTIVRGFFHSACGSLYAAVFPSNHFGTLTGLQSLISAVFALLQQPLFMAMVGPLKGEPFWVNLGLLLFSLLGFLLPSYLFYYRARLQQEYAANGMGPLKVLSGSEVTA

SEQ ID NO: 81810 - protein, 58 aa, Homo sapiens
  Payload ID: 16288
  Gene Symbol: SLC43A1
  Gene Name: solute carrier family 43 (amino acid system L transporter), member 1
  ENSP ID: ENSP00000432241
MAPTLQQAYRRRWWMACTAVLENLFFSAVLLGWGSLLIILKNEGFYSSTCPAVPGVMC

SEQ ID NO: 81811 - protein, 58 aa, Homo sapiens; identical to SEQ ID NO: 81810
  Payload ID: 16288
  Gene Symbol: SLC43A1
  Gene Name: solute carrier family 43 (amino acid system L transporter), member 1
  ENSP ID: ENSP00000432361

SEQ ID NO: 81812 - protein, 171 aa, Homo sapiens
  Payload ID: 16288
  Gene Symbol: SLC43A1
  Gene Name: solute carrier family 43 (amino acid system L transporter), member 1
  ENSP ID: ENSP00000434312
MAPTLQQAYRRRWWMACTAVLENLFFSAVLLGWGSLLIILKNEGFYSSTCPAESSTNTTQDEQRRWPGCDQQDEMLNLGFTIGSFVLSATTLPLGILMDRFGPRPVRLVGSACFTASCTLMALASRDVEALSPLIFLALSLNGFGGICLTFTSLTEEDQAEWAGPGPQGDR

SEQ ID NO: 81813 - protein, 110 aa, Homo sapiens
  Payload ID: 16288
  Gene Symbol: SLC43A1
  Gene Name: solute carrier family 43 (amino acid system L transporter), member 1
  ENSP ID: ENSP00000435486
MAPTLQQAYRRRWWMACTAVLENLFFSAVLLGWGSLLIILKNEGFYSSTCPAESSTNTTQDEQRRWPGCDQQDEMLNLGFTIGSFVLSATTLPLGILMDRFGPRPVRLVG

SEQ ID NO: 81814 - protein, 259 aa, Homo sapiens
  Payload ID: 16288
  Gene Symbol: SLC43A1
  Gene Name: solute carrier family 43 (amino acid system L transporter), member 1
  ENSP ID: ENSP00000435647
MAPTLQQAYRRRWWMACTAVLENLFFSAVLLGWGSLLIILKNEGFYSSTCPAESSTNTTQDEQRRWPGCDQQDEMLNLGFTIGSFVLSATTLPLGILMDRFGPRPVRLVGSACFTASCTLMALASRDVEALSPLIFLALSLNGFGGICLTFTSLTLIYDAGVAFVVIMFTWSGLACLIFLNCTLNWPIEAFPAPEEVNYTKKIKLSGLALDHKVTGDLFYTHVTTMGQRLSQKAPSLEDGSDAFMSPQDVRGTSENLPE

SEQ ID NO: 81815 - protein, 559 aa, Homo sapiens; identical to SEQ ID NO: 81809
  Payload ID: 16288
  Gene Symbol: SLC43A1
  Gene Name: solute carrier family 43 (amino acid system L transporter), member 1
  Uniprot ID: O75387
  ENSP ID: ENSP00000435673

SEQ ID NO: 81816 - protein, 186 aa, Homo sapiens
  Payload ID: 16288
  Gene Symbol: SLC43A1
  Gene Name: solute carrier family 43 (amino acid system L transporter), member 1
  ENSP ID: ENSP00000435803
  MOD_RES (1)..(1): Any amino acid
XTNTTQDEQRRWPGCDQQDEMLNLGFTIGSFVLSATTLPLGILMDRFGPRPVRLVGSACFTASCTLMALASRDVEALSPLIFLALSLNGFGGICLTFTSLTGRGCYQIHQTTLLQDPKAHQCHQCLHPDQPAACGFWHHLSHQQLTPPVCDLCPAHHCSRFLPLSLWESLCCSVPIQPLWDADRPA

SEQ ID NO: 81817 - protein, 569 aa, Homo sapiens
  Payload ID: 16289
  Gene Symbol: SLC43A2
  Gene Name: solute carrier family 43 (amino acid system L transporter), member 2
  Uniprot ID: Q8N370
  ENSP ID: ENSP00000301335
MAPTLATAHRRRWWMACTAVLENLLFSAVLLGWGSLLIMLKSEGFYSYLCTEPENVTNGTVGGTAEPGHEEVSWMNGWLSCQAQDEMLNLAFTVGSFLLSAITLPLGIVMDKYGPRKLRLLGSACFAVSCLLIAYGASKPNALSVLIFIALALNGFGGMCMTFTSLTLPNMFGDLRSTFIALMIGSYASSAVTFPGIKLIYDAGVSFIVVLVVWAGCSGLVFLNCFFNWPLEPFPGPEDMDYSVKIKFSWLGFDHKITGKQFYKQVTTVGRRLSVGSSMRSAKEQVALQEGHKLCLSTVDLEVKCQPDAAVAPSFMHSVFSPILLLSLVTMCVTQLRLIFYMGAMNNILKFLVSGDQKTVGLYTSIFGVLQLLCLLTAPVIGYIMDWRLKECEDASEEPEEKDANQGEKKKKKRDRQIQKITNAMRAFAFTNLLLVGFGVTCLIPNLPLQILSFILHTIVRGFIHSAVGGLYAAVYPSTQFGSLTGLQSLISALFALLQQPLFLAMMGPLQGDPLWVNVGLLLLSLLGFCLPLYLICYRRQLERQLQQRQEDDKLFLKINGSSNQEAFV

SEQ ID NO: 81818 - protein, 432 aa, Homo sapiens
  Payload ID: 16289
  Gene Symbol: SLC43A2
  Gene Name: solute carrier family 43 (amino acid system L transporter), member 2
  Uniprot ID: Q8N370
  ENSP ID: ENSP00000371582
MTYGSPQANASPSDAVALDHGEVSRRQQQELPNMFGDLRSTFIALMIGSYASSAVTFPGIKLIYDAGVSFIVVLVVWAGCSGLVFLNCFFNWPLEPFPGPEDMDYSVKIKFSWLGFDHKITGKQFYKQVTTVGRRLSVGSSMRSAKEQVALQEGHKLCLSTVDLEVKCQPDAAVAPSFMHSVFSPILLLSLVTMCVTQLRLIFYMGAMNNILKFLVSGDQKTVGLYTSIFGVLQLLCLLTAPVIGYIMDWRLKECEDASEEPEEKDANQGEKKKKKRDRQIQKITNAMRAFAFTNLLLVGFGVTCLIPNLPLQILSFILHTIVRGFIHSAVGGLYAAVYPSTQFGSLTGLQSLISALFALLQQPLFLAMMGPLQGDPLWVNVGLLLLSLLGFCLPLYLICYRRQLERQLQQRQEDDKLFLKINGSSNQEAFV

SEQ ID NO: 81819 - protein, 432 aa, Homo sapiens; identical to SEQ ID NO: 81818
  Payload ID: 16289
  Gene Symbol: SLC43A2
  Gene Name: solute carrier family 43 (amino acid system L transporter), member 2
  Uniprot ID: Q8N370
  ENSP ID: ENSP00000408284

SEQ ID NO: 81820 - protein, 56 aa, Homo sapiens
  Payload ID: 16289
  Gene Symbol: SLC43A2
  Gene Name: solute carrier family 43 (amino acid system L transporter), member 2
  ENSP ID: ENSP00000460388
MTYGSPQANASPSDAVALDHGEVSRRQQQESCGSCQRTLPSLAMPRSSLTRRFSLL

SEQ ID NO: 81821 - protein, 62 aa, Homo sapiens
  Payload ID: 16289
  Gene Symbol: SLC43A2
  Gene Name: solute carrier family 43 (amino acid system L transporter), member 2
  ENSP ID: ENSP00000461298
MAPTLATAHRRRWWMACTAVLENLLFSAVLLGWGSLLIMLKSEGFYSYLCTEPAPASRFPAC

SEQ ID NO: 81822 - protein, 573 aa, Homo sapiens
  Payload ID: 16289
  Gene Symbol: SLC43A2
  Gene Name: solute carrier family 43 (amino acid system L transporter), member 2
  Uniprot ID: Q8N370
  ENSP ID: ENSP00000461382
MAPTLATAHRRRWWMACTAVLENLLFSAVLLGWGSLLIMLKSEGFYSYLCTEPENVTNGTVGGTAEPGHEEVSWMNGWLSCQAQDEMLNLAFTVGSFLLSAITLPLGIVMDKYGPRKLRLLGSACFAVSCLLIAYGASKPNALSVLIFIALALNGFGGMCMTFTSLTLPNMFGDLRSTFIALMIGSYASSAVTFPGIKLIYDAGVSFIVVLVVWAGCSGLVFLNCFFNWPLEPFPGPEDMDYSVKIKFSWLGFDHKITGKQFYKQVTTVGRRLSVGSSMRSAKEQVALQEGHKLCLSTVDLEVKCQPDAAVAPSFMHSVFSPILLLSLVTMCVTQLRLIFYMGAMNNILKFLVSGDQKTVMATVGLYTSIFGVLQLLCLLTAPVIGYIMDWRLKECEDASEEPEEKDANQGEKKKKKRDRQIQKITNAMRAFAFTNLLLVGFGVTCLIPNLPLQILSFILHTIVRGFIHSAVGGLYAAVYPSTQFGSLTGLQSLISALFALLQQPLFLAMMGPLQGDPLWVNVGLLLLSLLGFCLPLYLICYRRQLERQLQQRQEDDKLFLKINGSSNQEAFV

SEQ ID NO: 81823 - protein, 109 aa, Homo sapiens
  Payload ID: 16289
  Gene Symbol: SLC43A2
  Gene Name: solute carrier family 43 (amino acid system L transporter), member 2
  ENSP ID: ENSP00000461553
MAPTLATAHRRRWWMACTAVLENLLFSAVLLGWGSLLIMLKSEGFYSYLCTEPENVTNGTVGGTAEPGHEECHHPAPGYRHGQVWPEEAQAAGQRLLRGFLLADCVRSK

SEQ ID NO: 81824 - protein, 573 aa, Homo sapiens; identical to SEQ ID NO: 81822
  Payload ID: 16289
  Gene Symbol: SLC43A2
  Gene Name: solute carrier family 43 (amino acid system L transporter), member 2
  Uniprot ID: Q8N370
  ENSP ID: ENSP00000483848

SEQ ID NO: 81825 - protein, 573 aa, Homo sapiens; identical to SEQ ID NO: 81822
  Payload ID: 16289
  Gene Symbol: SLC43A2
  Gene Name: solute carrier family 43 (amino acid system L transporter), member 2
  Uniprot ID: Q8N370
  ENSP ID: ENSP00000484291

SEQ ID NO: 81826 - protein, 109 aa, Homo sapiens; identical to SEQ ID NO: 81823
  Payload ID: 16289
  Gene Symbol: SLC43A2
  Gene Name: solute carrier family 43 (amino acid system L transporter), member 2
  ENSP ID: ENSP00000487841

SEQ ID NO: 81827 - protein, 56 aa, Homo sapiens; identical to SEQ ID NO: 81820
  Payload ID: 16289
  Gene Symbol: SLC43A2
  Gene Name: solute carrier family 43 (amino acid system L transporter), member 2
  ENSP ID: ENSP00000487944

SEQ ID NO: 81828 - protein, 569 aa, Homo sapiens; identical to SEQ ID NO: 81817
  Payload ID: 16289
  Gene Symbol: SLC43A2
  Gene Name: solute carrier family 43 (amino acid system L transporter), member 2
  Uniprot ID: Q8N370
  ENSP ID: ENSP00000488355

SEQ ID NO: 81829 - protein, 62 aa, Homo sapiens; identical to SEQ ID NO: 81821
  Payload ID: 16289
  Gene Symbol: SLC43A2
  Gene Name: solute carrier family 43 (amino acid system L transporter), member 2
  ENSP ID: ENSP00000488706

SEQ ID NO: 81830 - protein, 491 aa, Homo sapiens
  Payload ID: 16290
  Gene Symbol: SLC43A3
  Gene Name: solute carrier family 43, member 3
  Uniprot ID: Q8NBI5
  ENSP ID: ENSP00000337561
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFFYTTATLIIAFTSAGSAVLLFLAMPMLTIGGILFLITNLQIGNLFGQHRSTIITLYNGAFDSSSAVFLIIKLLYEKGISLRASFIFISVCSTWHVARTFLLMPRGHIPYPLPPNYSYGLCPGNGTTKEEKETAEHENRELQSKEFLSAKEETPGAGQKQELRSFWSYAFSRRFAWHLVWLSVIQLWHYLFIGTLNSLLTNMAGGDMARVSTYTNAFAFTQFGVLCAPWNGLLMDRLKQKYQKEARKTGSSTLAVALCSTVPSLALTSLLCLGFALCASVPILPLQYLTFILQVISRSFLYGSNAAFLTLAFPSEHFGKLFGLVMALSAVVSLLQFPIFTLIKGSLQNDPFYVNVMFMLAILLTFFHPFLVYRECRTWKESPSAIA

SEQ ID NO: 81831 - protein, 491 aa, Homo sapiens; identical to SEQ ID NO: 81830
  Payload ID: 16290
  Gene Symbol: SLC43A3
  Gene Name: solute carrier family 43, member 3
  Uniprot ID: Q8NBI5
  ENSP ID: ENSP00000378555

SEQ ID NO: 81832 - protein, 491 aa, Homo sapiens; identical to SEQ ID NO: 81830
  Payload ID: 16290
  Gene Symbol: SLC43A3
  Gene Name: solute carrier family 43, member 3
  Uniprot ID: Q8NBI5
  ENSP ID: ENSP00000378556

SEQ ID NO: 81833 - protein, 82 aa, Homo sapiens
  Payload ID: 16290
  Gene Symbol: SLC43A3
  Gene Name: solute carrier family 43, member 3
  ENSP ID: ENSP00000431367
MAGQGLPLHVATLLTGLLECLGFAGVLFGWPSLVFVFKNEDYFKDLCGPDAGPIGNATGQAGRLGCMGDLFSTPDCKAQDER

SEQ ID NO: 81834 - protein, 109 aa, Homo sapiens
  Payload ID: 16290
  Gene Symbol: SLC43A3
  Gene Name: solute carrier family 43, member 3
  ENSP ID: ENSP00000431762
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFFYT

SEQ ID NO: 81835 - protein, 44 aa, Homo sapiens
  Payload ID: 16290
  Gene Symbol: SLC43A3
  Gene Name: solute carrier family 43, member 3
  ENSP ID: ENSP00000431765
MAGQGLPLHVATLLTGLLECLGFAGVLFGWPSLVFVFKNEDYFK

SEQ ID NO: 81836 - protein, 137 aa, Homo sapiens
  Payload ID: 16290
  Gene Symbol: SLC43A3
  Gene Name: solute carrier family 43, member 3
  ENSP ID: ENSP00000433078
  MOD_RES (1)..(1): Any amino acid
XTTKEEKETAEHENRELQSKEFLSAKEETPGAGQKQELRSFWSYAFSRRFAWHLVWLSVIQLWHYLFIGTLNSLLTNMAGGDMARVSTYTNAFAFTQFGVLCAPWNGLLMDRLKQKYQKEARKTVSLQSTLASSLGW

SEQ ID NO: 81837 - protein, 22 aa, Homo sapiens
  Payload ID: 16290
  Gene Symbol: SLC43A3
  Gene Name: solute carrier family 43, member 3
  ENSP ID: ENSP00000433393
MAGQGLPLHVATLLTGLLECLG

SEQ ID NO: 81838 - protein, 119 aa, Homo sapiens
  Payload ID: 16290
  Gene Symbol: SLC43A3
  Gene Name: solute carrier family 43, member 3
  ENSP ID: ENSP00000433974
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFFYTTATLIIAFTS

SEQ ID NO: 81839 - protein, 126 aa, Homo sapiens
  Payload ID: 16290
  Gene Symbol: SLC43A3
  Gene Name: solute carrier family 43, member 3
  ENSP ID: ENSP00000434293
MGDLFSTPDCKAQDERFSLIFTLGSFMNNFMTFPTGYIFDRFKTTVARLIAIFFYTTATLIIAFTSAGSAVLLFLAMPMLTIGGILFLITNLQIGNLFGQHRSTIITLYNGAFDSSSAVFLIIKLL

SEQ ID NO: 81840 - protein, 1 aa, Homo sapiens
  Payload ID: 16290
  Gene Symbol: SLC43A3
  Gene Name: solute carrier family 43, member 3
  ENSP ID: ENSP00000434371
M

SEQ ID NO: 81841 - protein, 504 aa, Homo sapiens
  Payload ID: 16290
  Gene Symbol: SLC43A3
  Gene Name: solute carrier family 43, member 3
  Uniprot ID: Q8NBI5
  ENSP ID: ENSP00000434515
MAGQGLPLHVATLLTGLLECLGFAGVLFGWPSLVFVFKNEDYFKDLCGPDAGPIGNATGQAGRLGCMGDLFSTPDCKAQDERFSLIFTLGSFMNNFMTFPTGYIFDRFKTTVARLIAIFFYTTATLIIAFTSAGSAVLLFLAMPMLTIGGILFLITNLQIGNLFGQHRSTIITLYNGAFDSSSAVFLIIKLLYEKGISLRASFIFISVCSTWHVARTFLLMPRGHIPYPLPPNYSYGLCPGNGTTKEEKETAEHENRELQSKEFLSAKEETPGAGQKQELRSFWSYAFSRRFAWHLVWLSVIQLWHYLFIGTLNSLLTNMAGGDMARVSTYTNAFAFTQFGVLCAPWNGLLMDRLKQKYQKEARKTGSSTLAVALCSTVPSLALTSLLCLGFALCASVPILPLQYLTFILQVISRSFLYGSNAAFLTLAFPSEHFGKLFGLVMALSAVVSLLQFPIFTLIKGSLQNDPFYVNVMFMLAILLTFFHPFLVYRECRTWKESPSAIA

SEQ ID NO: 81842 - protein, 101 aa, Homo sapiens
  Payload ID: 16290
  Gene Symbol: SLC43A3
  Gene Name: solute carrier family 43, member 3
  ENSP ID: ENSP00000434569
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVAR

SEQ ID NO: 81843 - protein, 63 aa, Homo sapiens
  Payload ID: 16290
  Gene Symbol: SLC43A3
  Gene Name: solute carrier family 43, member 3
  ENSP ID: ENSP00000434710
MAGQGLPLHVATLLTGLLECLGFAGVLFGWPSLVFVFKNEDYFKDLCGPDAGPIGNATGQAGR

SEQ ID NO: 81844 - protein, 148 aa, Homo sapiens
  Payload ID: 16290
  Gene Symbol: SLC43A3
  Gene Name: solute carrier family 43, member 3
  ENSP ID: ENSP00000434913
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFFYTTATLIIAFTSAGSAVLLFLAMPMLTIGGILFLITNLQIG

SEQ ID NO: 81845 - protein, 97 aa, Homo sapiens
  Payload ID: 16290
  Gene Symbol: SLC43A3
  Gene Name: solute carrier family 43, member 3
  ENSP ID: ENSP00000435109
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKT

SEQ ID NO: 81846 - protein, 107 aa, Homo sapiens
  Payload ID: 16290
  Gene Symbol: SLC43A3
  Gene Name: solute carrier family 43, member 3
  ENSP ID: ENSP00000435156
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFF

SEQ ID NO: 81847 - protein, 133 aa, Homo sapiens
  Payload ID: 16290
  Gene Symbol: SLC43A3
  Gene Name: solute carrier family 43, member 3
  ENSP ID: ENSP00000435273
MAGQGLPLHVATLLTGLLECLGFAGVLFGWPSLVFVFKNEDYFKDLCGPDAGPIGNATGQAGRLGCMGDLFSTPDCKAQDERFSLIFTLGSFMNNFMTFPTGYIFDRFKTTVARLIAIFFYTTATLIIAFTSA

SEQ ID NO: 81848 - protein, 78 aa, Homo sapiens
  Payload ID: 16290
  Gene Symbol: SLC43A3
  Gene Name: solute carrier family 43, member 3
  ENSP ID: ENSP00000435490
MAGQGLPLHVATLLTGLLECLGFAGVLFGWPSLVFVFKNEDYFKDLCGPDAGPIGNATGQADCKAQDERFSLIFTLGS

SEQ ID NO: 81849 - protein, 331 aa, Homo sapiens
  Payload ID: 16290
  Gene Symbol: SLC43A3
  Gene Name: solute carrier family 43, member 3
  ENSP ID: ENSP00000435893
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFFYTTATLIIAFTSAGSAVLLFLAMPMLTIGGILFLITNLQIGNLFGQHRSTIITLYNGAFDSSSAVFLIIKLLYEKGISLRASFIFISVCSTWHVARTFLLMPRGHIPYPLPPNYSYGLCPGNGTTKEEKETAEHENRELQSKEFLSAKEETPGAGQKQELRSFWSYAFSRRFAWHLVWLSVIQLWHYLFIGTLNSLLTNMAGGDMARVSTYTNAFAFTQFGVLC

SEQ ID NO: 81850 - protein, 169 aa, Homo sapiens
  Payload ID: 16290
  Gene Symbol: SLC43A3
  Gene Name: solute carrier family 43, member 3
  ENSP ID: ENSP00000436055
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFFYTTATLIIAFTSAGSAVLLFLAMPMLTIGGILFLITNLQIGNLFGQHRSTIITLYNGAFDSS

SEQ ID NO: 81851 - protein, 491 aa, Homo sapiens; identical to SEQ ID NO: 81830
  Payload ID: 16290
  Gene Symbol: SLC43A3
  Gene Name: solute carrier family 43, member 3
  Uniprot ID: Q8NBI5
  ENSP ID: ENSP00000436254

SEQ ID NO: 81852 - protein, 657 aa, Homo sapiens
  Payload ID: 16291
  Gene Symbol: SLC44A1
  Gene Name: solute carrier family 44 (choline transporter), member 1
  Uniprot ID: Q8WWI5
  ENSP ID: ENSP00000363852
MGCCSSASSAAQSSKREWKPLEDRSCTDIPWLLLFILFCIGMGFICGFSIATGAAARLVSGYDSYGNICGQKNTKLEAIPNSGMDHTQRKYVFFLDPCNLDLINRKIKSVALCVAACPRQELKTLSDVQKFAEINGSALCSYNLKPSEYTTSPKSSVLCPKLPVPASAPIPFFHRCAPVNISCYAKFAEALITFVSDNSVLHRLISGVMTSKEIILGLCLLSLVLSMILMVIIRYISRVLVWILTILVILGSLGGTGVLWWLYAKQRRSPKETVTPEQLQIAEDNLRALLIYAISATVFTVILFLIMLVMRKRVALTIALFHVAGKVFIHLPLLVFQPFWTFFALVLFWVYWIMTLLFLGTTGSPVQNEQGFVEFKISGPLQYMWWYHVVGLIWISEFILACQQMTVAGAVVTYYFTRDKRNLPFTPILASVNRLIRYHLGTVAKGSFIITLVKIPRMILMYIHSQLKGKENACARCVLKSCICCLWCLEKCLNYLNQNAYTATAINSTNFCTSAKDAFVILVENALRVATINTVGDFMLFLGKVLIVCSTGLAGIMLLNYQQDYTVWVLPLIIVCLFAFLVAHCFLSIYEMVVDVLFLCFAIDTKYNDGSPGREFYMDKVLMEFVENSRKAMKEAGKGGVADSRELKPMASGASSA

SEQ ID NO: 81853 - protein, 652 aa, Homo sapiens
  Payload ID: 16291
  Gene Symbol: SLC44A1
  Gene Name: solute carrier family 44 (choline transporter), member 1
  Uniprot ID: Q8WWI5
  ENSP ID: ENSP00000363855
MGCCSSASSAAQSSKREWKPLEDRSCTDIPWLLLFILFCIGMGFICGFSIATGAAARLVSGYDSYGNICGQKNTKLEAIPNSGMDHTQRKYVFFLDPCNLDLINRKIKSVALCVAACPRQELKTLSDVQKFAEINGSALCSYNLKPSEYTTSPKSSVLCPKLPVPASAPIPFFHRCAPVNISCYAKFAEALITFVSDNSVLHRLISGVMTSKEIILGLCLLSLVLSMILMVIIRYISRVLVWILTILVILGSLGGTGVLWWLYAKQRRSPKETVTPEQLQIAEDNLRALLIYAISATVFTVILFLIMLVMRKRVALTIALFHVAGKVFIHLPLLVFQPFWTFFALVLFWVYWIMTLLFLGTTGSPVQNEQGFVEFKISGPLQYMWWYHVVGLIWISEFILACQQMTVAGAVVTYYFTRDKRNLPFTPILASVNRLIRYHLGTVAKGSFIITLVKIPRMILMYIHSQLKGKENACARCVLKSCICCLWCLEKCLNYLNQNAYTATAINSTNFCTSAKDAFVILVENALRVATINTVGDFMLFLGKVLIVCSTGLAGIMLLNYQQDYTVWVLPLIIVCLFAFLVAHCFLSIYEMVVDVLFLCFAIDTKYNDGSPGREFYMDKVLMEFVENSRKAMKEAGKGGVADSRELKPMIK

SEQ ID NO: 81854 - protein, 654 aa, Homo sapiens
  Payload ID: 16291
  Gene Symbol: SLC44A1
  Gene Name: solute carrier family 44 (choline transporter), member 1
  Uniprot ID: Q8WWI5
  ENSP ID: ENSP00000363856
MGCCSSASSAAQSSKREWKPLEDRSCTDIPWLLLFILFCIGMGFICGFSIATGAAARLVSGYDSYGNICGQKNTKLEAIPNSGMDHTQRKYVFFLDPCNLDLINRKIKSVALCVAACPRQELKTLSDVQKFAEINGSALCSYNLKPSEYTTSPKSSVLCPKLPVPASAPIPFFHRCAPVNISCYAKFAEALITFVSDNSVLHRLISGVMTSKEIILGLCLLSLVLSMILMVIIRYISRVLVWILTILVILGSLGGTGVLWWLYAKQRRSPKETVTPEQLQIAEDNLRALLIYAISATVFTVILFLIMLVMRKRVALTIALFHVAGKVFIHLPLLVFQPFWTFFALVLFWVYWIMTLLFLGTTGSPVQNEQGFVEFKISGPLQYMWWYHVVGLIWISEFILACQQMTVAGAVVTYYFTRDKRNLPFTPILASVNRLIRYHLGTVAKGSFIITLVKIPRMILMYIHSQLKGKENACARCVLKSCICCLWCLEKCLNYLNQNAYTATAINSTNFCTSAKDAFVILVENALRVATINTVGDFMLFLGKVLIVCSTGLAGIMLLNYQQDYTVWVLPLIIVCLFAFLVAHCFLSIYEMVVDVLFLCFAIDTKYNDGSPGREFYMDKVLMEFVENSRKAMKEAGKGGVADSRELKPMLKKR

SEQ ID NO: 81855 - protein, 657 aa, Homo sapiens; identical to SEQ ID NO: 81852
  Payload ID: 16291
  Gene Symbol: SLC44A1
  Gene Name: solute carrier family 44 (choline transporter), member 1
  Uniprot ID: Q8WWI5
  ENSP ID: ENSP00000433072

SEQ ID NO: 81856 - protein, 706 aa, Homo sapiens
  Payload ID: 16292
  Gene Symbol: SLC44A2
  Gene Name: solute carrier family 44 (choline transporter), member 2
  Uniprot ID: Q8IWA5
  ENSP ID: ENSP00000336888
MGDERPHYYGKHGTPQKYDPTFKGPIYNRGCTDIICCVFLLLAIVGYVAVGIIAWTHGDPRKVIYPTDSRGEFCGQKGTKNENKPYLFYFNIVKCASPLVLLEFQCPTPQICVEKCPDRYLTYLNARSSRDFEYYKQFCVPGFKNNKGVAEVLQDGDCPAVLIPSKPLARRCFPAIHAYKGVLMVGNETTYEDGHGSRKNITDLVEGAKKANGVLEARQLAMRIFEDYTVSWYWIIIGLVIAMAMSLLFIILLRFLAGIMVWVMIIMVILVLGYGIFHCYMEYSRLRGEAGSDVSLVDLGFQTDFRVYLHLRQTWLAFMIILSILEVIIILLLIFLRKRILIAIALIKEASRAVGYVMCSLLYPLVTFFLLCLCIAYWASTAVFLSTSNEAVYKIFDDSPCPFTAKTCNPETFPSSNESRQCPNARCQFAFYGGESGYHRALLGLQIFNAFMFFWLANFVLALGQVTLAGAFASYYWALRKPDDLPAFPLFSAFGRALRYHTGSLAFGALILAIVQIIRVILEYLDQRLKAAENKFAKCLMTCLKCCFWCLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFLEDLERNDGSAERPYFMSSTLKKLLNKTNKKAAES

SEQ ID NO: 81857 - protein, 704 aa, Homo sapiens
  Payload ID: 16292
  Gene Symbol: SLC44A2
  Gene Name: solute carrier family 44 (choline transporter), member 2
  Uniprot ID: Q8IWA5
  ENSP ID: ENSP00000385135
MEDERKNGAYGTPQKYDPTFKGPIYNRGCTDIICCVFLLLAIVGYVAVGIIAWTHGDPRKVIYPTDSRGEFCGQKGTKNENKPYLFYFNIVKCASPLVLLEFQCPTPQICVEKCPDRYLTYLNARSSRDFEYYKQFCVPGFKNNKGVAEVLQDGDCPAVLIPSKPLARRCFPAIHAYKGVLMVGNETTYEDGHGSRKNITDLVEGAKKANGVLEARQLAMRIFEDYTVSWYWIIIGLVIAMAMSLLFIILLRFLAGIMVWVMIIMVILVLGYGIFHCYMEYSRLRGEAGSDVSLVDLGFQTDFRVYLHLRQTWLAFMIILSILEVIIILLLIFLRKRILIAIALIKEASRAVGYVMCSLLYPLVTFFLLCLCIAYWASTAVFLSTSNEAVYKIFDDSPCPFTAKTCNPETFPSSNESRQCPNARCQFAFYGGESGYHRALLGLQIFNAFMFFWLANFVLALGQVTLAGAFASYYWALRKPDDLPAFPLFSAFGRALRYHTGSLAFGALILAIVQIIRVILEYLDQRLKAAENKFAKCLMTCLKCCFWCLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFLEDLERNDGSAERPYFMSSTLKKLLNKTNKKAAES

SEQ ID NO: 81858 - protein, 10 aa, Homo sapiens
  Payload ID: 16292
  Gene Symbol: SLC44A2
  Gene Name: solute carrier family 44 (choline transporter), member 2
  ENSP ID: ENSP00000465547
MVGNETTYED

SEQ ID NO: 81859 - protein, 124 aa, Homo sapiens
  Payload ID: 16292
  Gene Symbol: SLC44A2
  Gene Name: solute carrier family 44 (choline transporter), member 2
  ENSP ID: ENSP00000466575
  MOD_RES (1)..(1): Any amino acid
XAENKFAKCLMTCLKCCFWCLEKFIKFLNRNAYIMIAIYGTNFCTSARNAFFLLMRNIIRDPGFLLLHPPYQDRAGYSTTPQLLLGSYTDGDRWLLLDCTRFLQRLWHVCGHAVPLLLGGPGEE

SEQ ID NO: 81860 - protein, 42 aa, Homo sapiens
  Payload ID: 16292
  Gene Symbol: SLC44A2
  Gene Name: solute carrier family 44 (choline transporter), member 2
  ENSP ID: ENSP00000466612
MGDERPHYYGKHGTPQKYDPTFKGPIYNSLDSWRPSKGDLPH

SEQ ID NO: 81861 - protein, 711 aa, Homo sapiens
  Payload ID: 16292
  Gene Symbol: SLC44A2
  Gene Name: solute carrier family 44 (choline transporter), member 2
  Uniprot ID: Q8IWA5
  ENSP ID: ENSP00000466664
MGDERPHYYGKHGTPQKYDPTFKGPIYNRGCTDIICCVFLLLAIVGYVAVGIIAWTHGDPRKVIYPTDSRGEFCGQKGTKNENKPYLFYFNIVKCASPLVLLEFQCPTPQICVEKCPDRYLTYLNARSSRDFEYYKQFCVPGFKNNKGVAEVLQDGDCPAVLIPSKPLARRCFPAIHAYKGVLMVGNETTYEDGHGSRKNITDLVEGAKKANGVLEARQLAMRIFEDYTVSWYWIIIGLVIAMAMSLLFIILLRFLAGIMVWVMIIMVILVLGYGIFHCYMEYSRLRGEAGSDVSLVDLGFQTDFRVYLHLRQTWLAFMIILSILEVIIILLLIFLRKRILIAIALIKEASRAVGYVMCSLLYPLVTFFLLCLCIAYWASTAVFLSTSNEAVYKIFDDSPCPFTAKTCNPETFPSSNESRQCPNARCQFAFYGGESGYHRALLGLQIFNAFMFFWLANFVLALGQVTLAGAFASYYWALRKPDDLPAFPLFSAFGRALRYHTGSLAFGALILAIVQIIRVILEYLDQRLKAAENKFAKCLMTCLKCCFWCLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFCEDLERNDGSQERPYFMSPELRDILLKGSAEEGKRAEAEE

SEQ ID NO: 81862 - protein, 146 aa, Homo sapiens
  Payload ID: 16292
  Gene Symbol: SLC44A2
  Gene Name: solute carrier family 44 (choline transporter), member 2
  ENSP ID: ENSP00000467552
MGDERPHYYGKHGTPQKYDPTFKGPIYNRNKPYLFYFNIVKCASPLVLLEFQCPTPQICVEKCPDRYLTYLNARSSRDFEYYKQFCVPGFKNNKGVAEVLQDGDCPAVLIPSKPLARRCFPAIHAYKGVLMVGNETTYEDGHGSRK

SEQ ID NO: 81863 - protein, 95 aa, Homo sapiens
  Payload ID: 16292
  Gene Symbol: SLC44A2
  Gene Name: solute carrier family 44 (choline transporter), member 2
  ENSP ID: ENSP00000468070
MGDERPHYYGKHGTPQKYDPTFKGPIYNRGCTDIICCVFLLLAIVGYVAVGIIAWTHGDPRKVIYPTDSRGEFCGQKGTKNENISLLHGVLPTAW

SEQ ID NO: 81864 - protein, 170 aa, Homo sapiens
  Payload ID: 16292
  Gene Symbol: SLC44A2
  Gene Name: solute carrier family 44 (choline transporter), member 2
  ENSP ID: ENSP00000468691
MEDERKNGAYGTPQKYDPTFKGPIYNRNKPYLFYFNIVKCASPLVLLEFQCPTPQICVEKCPDRYLTYLNARSSRDFEYYKQFCVPGFKNNKGVAEVLQDGDCPAVLIPSKPLARRCFPAIHAYKGVLMVGNETTYEDGHGSRKNITDLVEGAKKANGVLEARQLAMRIF

SEQ ID NO: 81865 - protein, 148 aa, Homo sapiens
  Payload ID: 16292
  Gene Symbol: SLC44A2
  Gene Name: solute carrier family 44 (choline transporter), member 2
  ENSP ID: ENSP00000468812
  MOD_RES (1)..(1): Any amino acid
XMIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFCEDLERNDGSQERPYFMSPELRDILLKGSAEEGKRAEAEE

SEQ ID NO: 81866 - protein, 653 aa, Homo sapiens
  Payload ID: 16293
  Gene Symbol: SLC44A3
  Gene Name: solute carrier family 44, member 3
  Uniprot ID: Q8N4M1
  ENSP ID: ENSP00000271227
MHCLGAEYLVSAEGAPRQREWRPQIYRKCTDTAWLFLFFLFWTGLVFIMGYSVVAGAAGRLLFGYDSFGNMCGKKNSPVEGAPLSGQDMTLKKHVFFMNSCNLEVKGTQLNRMALCVSNCPEEQLDSLEEVQFFANTSGSFLCVYSLNSFNYTHSPKADSLCPRLPVPPSKSFPLFNRCVPQTPECYSLFASVLINDVDTLHRILSGIMSGRDTILGLCILALALSLAMMFTFRFITTLLVHIFISLVILGLLFVCGVLWWLYYDYTNDLSIELDTERENMKCVLGFAIVSTGITAVLLVLIFVLRKRIKLTVELFQITNKAISSAPFLLFQPLWTFAILIFFWVLWVAVLLSLGTAGAAQVMEGGQVEYKPLSGIRYMWSYHLIGLIWTSEFILACQQMTIAGAVVTCYFNRSKNDPPDHPILSSLSILFFYHQGTVVKGSFLISVVRIPRIIVMYMQNALKEQQHGALSRYLFRCCYCCFWCLDKYLLHLNQNAYTTTAINGTDFCTSAKDAFKILSKNSSHFTSINCFGDFIIFLGKVLVVCFTVFGGLMAFNYNRAFQVWAVPLLLVAFFAYLVAHSFLSVFETVLDALFLCFAVDLETNDGSSEKPYFMDQEFLSFVKRSNKLNNARAQQDKHSLRNEEGTELQAIVR

SEQ ID NO: 81867 - protein, 617 aa, Homo sapiens
  Payload ID: 16293
  Gene Symbol: SLC44A3
  Gene Name: solute carrier family 44, member 3
  Uniprot ID: Q8N4M1
  ENSP ID: ENSP00000389143
MHCLGAEYLVFIMGYSVVAGAAGRLLFGYDSFGNMCGKKNSPVEGAPLSGQDMTLKKHVFFMNSCNLEVKGTQLNRMALCVSNCPEEQLDSLEEVQFFANTSGSFLCVYSLNSFNYTHSPKADSLCPRLPVPPSKSFPLFNRCVPQTPECYSLFASVLINDVDTLHRILSGIMSGRDTILGLCILALALSLAMMFTFRFITTLLVHIFISLVILGLLFVCGVLWWLYYDYTNDLSIELDTERENMKCVLGFAIVSTGITAVLLVLIFVLRKRIKLTVELFQITNKAISSAPFLLFQPLWTFAILIFFWVLWVAVLLSLGTAGAAQVMEGGQVEYKPLSGIRYMWSYHLIGLIWTSEFILACQQMTIAGAVVTCYFNRSKNDPPDHPILSSLSILFFYHQGTVVKGSFLISVVRIPRIIVMYMQNALKEQQHGALSRYLFRCCYCCFWCLDKYLLHLNQNAYTTTAINGTDFCTSAKDAFKILSKNSSHFTSINCFGDFIIFLGKVLVVCFTVFGGLMAFNYNRAFQVWAVPLLLVAFFAYLVAHSFLSVFETVLDALFLCFAVDLETNDGSSEKPYFMDQEFLSFVKRSNKLNNARAQQDKHSLRNEEGTELQAIVR

SEQ ID NO: 81868 - protein, 163 aa, Homo sapiens
  Payload ID: 16293
  Gene Symbol: SLC44A3
  Gene Name: solute carrier family 44, member 3
  ENSP ID: ENSP00000410832
MGYSVVAGAAGRLLFGYDSFGNMCGKKNSPVEGAPLSGQDMTLKKHVFFMNSCNLEVKGTQLNRMALCVSNCPEEQLDSLEEVQFFANTSGSFLCVYSLNSFNYTHSPKADSLCPRLPVPPSKSFPLFNRCVPQTPECYSLFASVLINDVDTLHRILSGIMSG

SEQ ID NO: 81869 - protein, 620 aa, Homo sapiens
  Payload ID: 16293
  Gene Symbol: SLC44A3
  Gene Name: solute carrier family 44, member 3
  Uniprot ID: Q8N4M1
  ENSP ID: ENSP00000431836
MHCLGAEYLVSAEGAPRQREWRPQIYRKCTDTAWLFLFFLFWTGLVFIMGYSVVAGAAGRLLFGYDSFGNMCGKKNSPVEGAPLSGQDMTLKKHVFFMNSCNLEVKGSFLCVYSLNSFNYTHSPKADSLCPRLPVPPSKSFPLFNRCVPQTPECYSLFASVLINDVDTLHRILSGIMSGRDTILGLCILALALSLAMMFTFRFITTLLVHIFISLVILGLLFVCGVLWWLYYDYTNDLSIELDTERENMKCVLGFAIVSTGITAVLLVLIFVLRKRIKLTVELFQITNKAISSAPFLLFQPLWTFAILIFFWVLWVAVLLSLGTAGAAQVMEGGQVEYKPLSGIRYMWSYHLIGLIWTSEFILACQQMTIAGAVVTCYFNRSKNDPPDHPILSSLSILFFYHQGTVVKGSFLISVVRIPRIIVMYMQNALKEQHGALSRYLFRCCYCCFWCLDKYLLHLNQNAYTTTAINGTDFCTSAKDAFKILSKNSSHFTSINCFGDFIIFLGKVLVVCFTVFGGLMAFNYNRAFQVWAVPLLLVAFFAYLVAHSFLSVFETVLDALFLCFAVDLETNDGSSEKPYFMDQEFLSFVKRSNKLNNARAQQDKHSLRNEEGTELQAIVR

SEQ ID NO: 81870 - protein, 605 aa, Homo sapiens
  Payload ID: 16293
  Gene Symbol: SLC44A3
  Gene Name: solute carrier family 44, member 3
  Uniprot ID: Q8N4M1
  ENSP ID: ENSP00000432789
MGYSVVAGAAGRLLFGYDSFGNMCGKKNSPVEGAPLSGQDMTLKKHVFFMNSCNLEVKGTQLNRMALCVSNCPEEQLDSLEEVQFFANTSGSFLCVYSLNSFNYTHSPKADSLCPRLPVPPSKSFPLFNRCVPQTPECYSLFASVLINDVDTLHRILSGIMSGRDTILGLCILALALSLAMMFTFRFITTLLVHIFISLVILGLLFVCGVLWWLYYDYTNDLSIELDTERENMKCVLGFAIVSTGITAVLLVLIFVLRKRIKLTVELFQITNKAISSAPFLLFQPLWTFAILIFFWVLWVAVLLSLGTAGAAQVMEGGQVEYKPLSGIRYMWSYHLIGLIWTSEFILACQQMTIAGAVVTCYFNRSKNDPPDHPILSSLSILFFYHQGTVVKGSFLISVVRIPRIIVMYMQNALKEQQHGALSRYLFRCCYCCFWCLDKYLLHLNQNAYTTTAINGTDFCTSAKDAFKILSKNSSHFTSINCFGDFIIFLGKVLVVCFTVFGGLMAFNYNRAFQVWAVPLLLVAFFAYLVAHSFLSVFETVLDALFLCFAVDLETNDGSSEKPYFMDQEFLSFVKRSNKLNNARAQQDKHSLRNEEGTELQAIVR

SEQ ID NO: 81871 - protein, 109 aa, Homo sapiens
  Payload ID: 16293
  Gene Symbol: SLC44A3
  Gene Name: solute carrier family 44, member 3
  ENSP ID: ENSP00000432880
QHGALSRYLFRCCYCCFWCLDKYLLHLNQNAYTTTAINGTDFCTSAKDAFKILSKNSSHFTSINCFGDFIIFLGKSFVKRSNKLNNARAQQDKHSLRNEEGTELQAIVR

SEQ ID NO: 81872 - protein, 585 aa, Homo sapiens
  Payload ID: 16293
  Gene Symbol: SLC44A3
  Gene Name: solute carrier family 44, member 3
  Uniprot ID: Q8N4M1
  ENSP ID: ENSP00000433641
MHCLGAEYLVFIMGYSVVAGAAGRLLFGYDSFGNMCGKKNSPVEGAPLSGQDMTLKKHVFFMNSCNLEVKGSFLCVYSLNSFNYTHSPKADSLCPRLPVPPSKSFPLFNRCVPQTPECYSLFASVLINDVDTLHRILSGIMSGRDTILGLCILALALSLAMMFTFRFITTLLVHIFISLVILGLLFVCGVLWWLYYDYTNDLSIELDTERENMKCVLGFAIVSTGITAVLLVLIFVLRKRIKLTVELFQITNKAISSAPFLLFQPLWTFAILIFFWVLWVAVLLSLGTAGAAQVMEGGQVEYKPLSGIRYMWSYHLIGLIWTSEFILACQQMTIAGAVVTCYFNRSKNDPPDHPILSSLSILFFYHQGTVVKGSFLISVVRIPRIIVMYMQNALKEQQHGALSRYLFRCCYCCFWCLDKYLLHLNQNAYTTTAINGTDFCTSAKDAFKILSKNSSHFTSINCFGDFIIFLGKVLVVCFTVFGGLMAFNYNRAFQVWAVPLLLVAFFAYLVAHSFLSVFETVLDALFLCFAVDLETNDGSSEKPYFMDQEFLSFVKRSNKLNNARAQQDKHSLRNEEGTELQAIVR

SEQ ID NO: 81873 - protein, 83 aa, Homo sapiens
  Payload ID: 16293
  Gene Symbol: SLC44A3
  Gene Name: solute carrier family 44, member 3
  ENSP ID: ENSP00000434457
  MOD_RES (1)..(1): Any amino acid
XFIMGYSVVAGAAGRLLFGYDSFGNMCGKKNSPVEGAPLSGQDMTLKKATYKEDRRRKGDLDAHVLPFHIVFIMQCQQTVIPG

SEQ ID NO: 81874 - protein, 573 aa, Homo sapiens
  Payload ID: 16293
  Gene Symbol: SLC44A3
  Gene Name: solute carrier family 44, member 3
  ENSP ID: ENSP00000436661
MGYSVVAGAAGRLLFGYDSFGNMCGKKNSPVEGAPLSGQDMTLKKHVFFMNSCNLEVKGSFLCVYSLNSFNYTHSPKADSLCPRLPVPPSKSFPLFNRCVPQTPECYSLFASVLINDVDTLHRILSGIMSGRDTILGLCILALALSLAMMFTFRFITTLLVHIFISLVILGLLFVCGVLWWLYYDYTNDLSIELDTERENMKCVLGFAIVSTGITAVLLVLIFVLRKRIKLTVELFQITNKAISSAPFLLFQPLWTFAILIFFWVLWVAVLLSLGTAGAAQVMEGGQVEYKPLSGIRYMWSYHLIGLIWTSEFILACQQMTIAGAVVTCYFNRSKNDPPDHPILSSLSILFFYHQGTVVKGSFLISVVRIPRIIVMYMQNALKEQQHGALSRYLFRCCYCCFWCLDKYLLHLNQNAYTTTAINGTDFCTSAKDAFKILSKNSSHFTSINCFGDFIIFLGKVLVVCFTVFGGLMAFNYNRAFQVWAVPLLLVAFFAYLVAHSFLSVFETVLDALFLCFAVDLETNDGSSEKPYFMDQEFLSFVKRSNKLNNARAQQDKHSLRNEEGTELQAIVR

SEQ ID NO: 81875 - protein, 710 aa, Homo sapiens
  Payload ID: 16294
  Gene Symbol: SLC44A4
  Gene Name: solute carrier family 44, member 4
  Uniprot ID: Q53GD3
  ENSP ID: ENSP00000229729
MGGKQRDEDDEAYGKPVKYDPSFRGPIKNRSCTDVICCVLFLLFILGYIVVGIVAWLYGDPRQVLYPRNSTGAYCGMGENKDKPYLLYFNIFSCILSSNIISVAENGLQCPTPQVCVSSCPEDPWTVGKNEFSQTVGEVFYTKNRNFCLPGVPWNMTVITSLQQELCPSFLLPSAPALGRCFPWTNVTPPALPGITNDTTIQQGISGLIDSLNARDISVKIFEDFAQSWYWILVALGVALVLSLLFILLLRLVAGPLVLVLILGVLGVLAYGIYYCWEEYRVLRDKGASISQLGFTTNLSAYQSVQETWLAALIVLAVLEAILLLMLIFLRQRIRIAIALLKEASKAVGQMMSTMFYPLVTFVLLLICIAYWAMTALYLATSGQPQYVLWASNISSPGCEKVPINTSCNPTAHLVNSSCPGLMCVFQGYSSKGLIQRSVFNLQIYGVLGLFWTLNWVLALGQCVLAGAFASFYWAFHKPQDIPTFPLISAFIRTLRYHTGSLAFGALILTLVQIARVILEYIDHKLRGVQNPVARCIMCCFKCCLWCLEKFIKFLNRNAYIMIAIYGKNFCVSAKNAFMLLMRNIVRVVVLDKVTDLLLFFGKLLVVGGVGVLSFFFFSGRIPGLGKDFKSPHLNYYWLPIMTSILGAYVIASGFFSVFGMCVDTLFLCFLEDLERNNGSLDRPYYMSKSLLKILGKKNEAPPDNKKRKK

SEQ ID NO: 81876 - protein, 668 aa, Homo sapiens
  Payload ID: 16294
  Gene Symbol: SLC44A4
  Gene Name: solute carrier family 44, member 4
  Uniprot ID: Q53GD3
  ENSP ID: ENSP00000364712
MGGKQRDEDDEAYGKPVKYDPSFRGPIKNRSCTDVICCVLFLLFILGYIVVGIVAWLYGDPRQVLYPRNSTGAYCGMGENKDKPYLLYFNIFSCILSSNIISVAENGLQCPTPQTVITSLQQELCPSFLLPSAPALGRCFPWTNVTPPALPGITNDTTIQQGISGLIDSLNARDISVKIFEDFAQSWYWILVALGVALVLSLLFILLLRLVAGPLVLVLILGVLGVLAYGIYYCWEEYRVLRDKGASISQLGFTTNLSAYQSVQETWLAALIVLAVLEAILLLMLIFLRQRIRIAIALLKEASKAVGQMMSTMFYPLVTFVLLLICIAYWAMTALYLATSGQPQYVLWASNISSPGCEKVPINTSCNPTAHLVNSSCPGLMCVFQGYSSKGLIQRSVFNLQIYGVLGLFWTLNWVLALGQCVLAGAFASFYWAFHKPQDIPTFPLISAFIRTLRYHTGSLAFGALILTLVQIARVILEYIDHKLRGVQNPVARCIMCCFKCCLWCLEKFIKFLNRNAYIMIAIYGKNFCVSAKNAFMLLMRNIVRVVVLDKVTDLLLFFGKLLVVGGVGVLSFFFFSGRIPGLGKDFKSPHLNYYWLPIMTSILGAYVIASGFFSVFGMCVDTLFLCFLEDLERNNGSLDRPYYMSKSLLKILGKKNEAPPDNKKRKK

SEQ ID NO: 81877 - protein, 710 aa, Homo sapiens; identical to SEQ ID NO: 81875
  Payload ID: 16294
  Gene Symbol: SLC44A4
  Gene Name: solute carrier family 44, member 4
  Uniprot ID: Q53GD3
  ENSP ID: ENSP00000372870

SEQ ID NO: 81878 - protein, 710 aa, Homo sapiens [sequence omitted]

SEQ ID NO: 81879 - protein, 411 aa, Homo sapiens
  Payload ID: 16294
  Gene Symbol: SLC44A4
  Gene Name: solute carrier family 44, member 4
  ENSP ID: ENSP00000392054
  MOD_RES (1)..(1): Any amino acid
XRDEDDEAYGKPVKYDPSFRGPIKNRSCTDVICCVLFLLFILGYIVVGIVAWLYGDPRQVLYPRNSTGAYCGMGENKDKPYLLYFNIFSCILSSNIISVAENGLQCPTPQVCVSSCPEDPWTVGKNEFSQTVGEVFYTKNRNFCLPGVPWNMTVITSLQQELCPSFLLPSAPALGRCFPWTNVTPPALPGITNDTTIQQGISGLIDSLNARDISVKIFEDFAQSWYWILVAVGQMMSTMFYPLVTFVLLLICIAYWAMTALYLATSGQPQYVLWASNISSPGCEKVPINTSCNPTAHLVNSSCPGLMCVFQGYSSKGLIQRSVFNLQIYGVLGLFWTLNWVLALGQCVLAGAFASFYWAFHKPQDIPTFPLISAFIRTLRYHTGSLAFGALILTLVQIARVILEYIDHKLR

SEQ ID NO: 81880 - protein, 710 aa, Homo sapiens; identical to SEQ ID NO: 81875
  Payload ID: 16294
  Gene Symbol: SLC44A4
  Gene Name: solute carrier family 44, member 4
  Uniprot ID: Q53GD3
  ENSP ID: ENSP00000393939

SEQ ID NO: 81881 - protein, 411 aa, Homo sapiens; identical to SEQ ID NO: 81879
  Payload ID: 16294
  Gene Symbol: SLC44A4
  Gene Name: solute carrier family 44, member 4
  ENSP ID: ENSP00000398764
  MOD_RES (1)..(1): Any amino acid

SEQ ID NO: 81882 - protein, 710 aa, Homo sapiens [sequence omitted]

SEQ ID NO: 81883 - protein, 411 aa, Homo sapiens; identical to SEQ ID NO: 81879
  Payload ID: 16294
  Gene Symbol: SLC44A4
  Gene Name: solute carrier family 44, member 4
  ENSP ID: ENSP00000398901
  MOD_RES (1)..(1): Any amino acid

SEQ ID NO: 81884 - protein, 710 aa, Homo sapiens; identical to SEQ ID NO: 81875
  Payload ID: 16294
  Gene Symbol: SLC44A4
  Gene Name: solute carrier family 44, member 4
  Uniprot ID: Q53GD3
  ENSP ID: ENSP00000399161

SEQ ID NO: 81885 - protein, 411 aa, Homo sapiens
  Payload ID: 16294
  Gene Symbol: SLC44A4
  Gene Name: solute carrier family 44, member 4
  ENSP ID: ENSP00000400263
  MOD_RES (1)..(1): Any amino acid
XRDEDDEAYGKPVKYDPSFRGPIKNRSCTDVICCVLFLLFILGYIVVGIVAWLYGDPRQVLYPRNSTGAYCGMGENKDKPYLLYFNIFSCILSSNIISVAENGLQCPTPQVCVSSCPEDPWTVGKNEFSQTVGEVFYTKNRNFCLPGVPWNMTVITSLQQELCPSFLLPSAPALGRCFPWTNITPPALPGITNDTTIQQGISGLIDSLNARDISVKIFEDFAQSWYWILVAVGQMMSTMFYPLVTFVLLLICIAYWAMTALYLATSGQPQYVLWASNISSPGCEKVPINTSCNPTAHLVNSSCPGLMCVFQGYSSKGLIQRSVFNLQIYGVLGLFWTLNWVLALGQCVLAGAFASFYWAFHKPQDIPTFPLISAFIRTLRYHTGSLAFGALILTLVQIARVILEYIDHKLR

SEQ ID NO: 81886 - protein, 411 aa, Homo sapiens; identical to SEQ ID NO: 81879
  Payload ID: 16294
  Gene Symbol: SLC44A4
  Gene Name: solute carrier family 44, member 4
  ENSP ID: ENSP00000404572
  MOD_RES (1)..(1): Any amino acid

SEQ ID NO: 81887 - protein, 710 aa, Homo sapiens [sequence omitted]

SEQ ID NO: 81888 - protein, 411 aa, Homo sapiens; identical to SEQ ID NO: 81885
  Payload ID: 16294
  Gene Symbol: SLC44A4
  Gene Name: solute carrier family 44, member 4
  ENSP ID: ENSP00000414296
  MOD_RES (1)..(1): Any amino acid

SEQ ID NO: 81889 - protein, 411 aa, Homo sapiens; identical to SEQ ID NO: 81885
  Payload ID: 16294
  Gene Symbol: SLC44A4
  Gene Name: solute carrier family 44, member 4
  ENSP ID: ENSP00000415708
  MOD_RES (1)..(1): Any amino acid

SEQ ID NO: 81890 - protein, 634 aa, Homo sapiens
  Payload ID: 16294
  Gene Symbol: SLC44A4
  Gene Name: solute carrier family 44, member 4
  Uniprot ID: Q53GD3
  ENSP ID: ENSP00000444109
MGENKDKPYLLYFNIFSCILSSNIISVAENGLQCPTPQVCVSSCPEDPWTVGKNEFSQTVGEVFYTKNRNFCLPGVPWNMTVITSLQQELCPSFLLPSAPALGRCFPWTNVTPPALPGITNDTTIQQGISGLIDSLNARDISVKIFEDFAQSWYWILVALGVALVLSLLFILLLRLVAGPLVLVLILGVLGVLAYGIYYCWEEYRVLRDKGASISQLGFTTNLSAYQSVQETWLAALIVLAVLEAILLLMLIFLRQRIRIAIALLKEASKAVGQMMSTMFYPLVTFVLLLICIAYWAMTALYLATSGQPQYVLWASNISSPGCEKVPINTSCNPTAHLVNSSCPGLMCVFQGYSSKGLIQRSVFNLQIYGVLGLFWTLNWVLALGQCVLAGAFASFYWAFHKPQDIPTFPLISAFIRTLRYHTGSLAFGALILTLVQIARVILEYIDHKLRGVQNPVARCIMCCFKCCLWCLEKFIKFLNRNAYIMIAIYGKNFCVSAKNAFMLLMRNIVRVVVLDKVTDLLLFFGKLLVVGGVGVLSFFFFSGRIPGLGKDFKSPHLNYYWLPIMTSILGAYVIASGFFSVFGMCVDTLFLCFLEDLERNNGSLDRPYYMSKSLLKILGKKNEAPPDNKKRKK

SEQ ID NO: 81891 - protein, 634 aa, Homo sapiens
  Payload ID: 16294
  Gene Symbol: SLC44A4
  Gene Name: solute carrier family 44, member 4
  ENSP ID: ENSP00000446935
MGENKDKPYLLYFNIFSCILSSNIISVAENGLQCPTPQVCVSSCPEDPWTVGKNEFSQTVGEVFYTKNRNFCLPGVPWNMTVITSLQQELCPSFLLPSAPALGRCFPWTNITPPALPGITNDTTIQQGISGLIDSLNARDISVKIFEDFAQSWYWILVALGVALVLSLLFILLLRLVAGPLVLVLILGVLGVLAYGIYYCWEEYRVLRDKGASISQLGFTTNLSAYQSVQETWLAALIVLAVLEAILLLVLIFLRQRIRIAIALLKEASKAVGQMMSTMFYPLVTFVLLLICIAYWAMTALYLATSGQPQYVLWASNISSPGCEKVPINTSCNPTAHLVNSSCPGLMCVFQGYSSKGLIQRSVFNLQIYGVLGLFWTLNWVLALGQCVLAGAFASFYWAFHKPQDIPTFPLISAFIRTLRYHTGSLAFGALILTLVQIARVILEYIDHKLRGVQNPVARCIMCCFKCCLWCLEKFIKFLNRNAYIMIAIYGKNFCVSAKNAFMLLMRNIVRVVVLDKVTDLLLFFGKLLVVGGVGVLSFFFFSGRIPGLGKDFKSPHLNYYWLPIMTSILGAYVIASGFFSVFGMCVDTLFLCFLEDLERNNGSLDRPYYMSKSLLKILGKKNEAPPDNKKRKK

SEQ ID NO: 81892 - protein, 634 aa, Homo sapiens; identical to SEQ ID NO: 81890
  Payload ID: 16294
  Gene Symbol: SLC44A4
  Gene Name: solute carrier family 44, member 4
  Uniprot ID: Q53GD3
  ENSP ID: ENSP00000447560

SEQ ID NO: 81893 - protein, 668 aa, Homo sapiens [sequence omitted]

SEQ ID NO: 81894 - protein, 668 aa, Homo sapiens; identical to SEQ ID NO: 81876
  Payload ID: 16294
  Gene Symbol: SLC44A4
  Gene Name: solute carrier family 44, member 4
  Uniprot ID: Q53GD3
  ENSP ID: ENSP00000448088

SEQ ID NO: 81895 - protein, 634 aa, Homo sapiens; identical to SEQ ID NO: 81891
  Payload ID: 16294
  Gene Symbol: SLC44A4
  Gene Name: solute carrier family 44, member 4
  ENSP ID: ENSP00000448213

SEQ ID NO: 81896 - protein, 668 aa, Homo sapiens [sequence omitted]

SEQ ID NO: 81897 - protein, 634 aa, Homo sapiens; identical to SEQ ID NO: 81890
  Payload ID: 16294
  Gene Symbol: SLC44A4
  Gene Name: solute carrier family 44, member 4
  Uniprot ID: Q53GD3
  ENSP ID: ENSP00000449039

SEQ ID NO: 81898 - protein, 634 aa, Homo sapiens; identical to SEQ ID NO: 81890
  Payload ID: 16294
  Gene Symbol: SLC44A4
  Gene Name: solute carrier family 44, member 4
  Uniprot ID: Q53GD3
  ENSP ID: ENSP00000449180

SEQ ID NO: 81899 - protein, 668 aa, Homo sapiens [sequence omitted]

SEQ ID NO: 81900 - protein, 668 aa, Homo sapiens; identical to SEQ ID NO: 81876
  Payload ID: 16294
  Gene Symbol: SLC44A4
  Gene Name: solute carrier family 44, member 4
  Uniprot ID: Q53GD3
  ENSP ID: ENSP00000449518

SEQ ID NO: 81901 - protein, 668 aa, Homo sapiens; identical to SEQ ID NO: 81876
  Payload ID: 16294
  Gene Symbol: SLC44A4
  Gene Name: solute carrier family 44, member 4
  Uniprot ID: Q53GD3
  ENSP ID: ENSP00000449642

SEQ ID NO: 81902 - protein, 634 aa, Homo sapiens; identical to SEQ ID NO: 81891
  Payload ID: 16294
  Gene Symbol: SLC44A4
  Gene Name: solute carrier family 44, member 4
  ENSP ID: ENSP00000450005

SEQ ID NO: 81903 - protein, 719 aa, Homo sapiens
  Payload ID: 16295
  Gene Symbol: SLC44A5
  Gene Name: solute carrier family 44, member 5
  ENSP ID: ENSP00000359892
MNDTEKPADTPSEEEDFGDPRTYDPDFKGPVANRSCTDVLCCMIFLLCIIGYIVLGLVAWVHGDPRRAAYPTDSQGHFCGQKGTPNENKTILFYFNLLRCTSPSVLLNLQCPTTQICVSKCPEKFLTYVEMQLLYTKDKSYWEDYRQFCKTTAKPVKSLTQLLLDDDCPTAIFPSKPFLQRCFPDFSTKNGTLTIGSKMMFQDGNGGTRSVVELGIAANGINKLLDAKSLGLKVFEDYARTWYWILIGLTIAMVLSWIFLILLRFIAGCLFWVFMIGVIGIIGYGIWHCYQQYTNLQERPSSVLTIYDIGIQTNISMYFELQQTWFTFMIILCIIEVIVILMLIFLRNRIRVAIILLKEGSKAIGYVPSTLVYPALTFILLSICICYWVVTAVFLATSGVPVYKVIAPGGHCIHENQTCDPEIFNTTEIAKACPGALCNFAFYGGKSLYHQYIPTFHVYNLFVFLWLINFVIALGQCALAGAFATYYWAMKKPDDIPRYPLFTAFGRAIRYHTGSLAFGSLIIALIQMFKIVLEYLDHRLKRTQNTLSKFLQCCLRCCFWCLENAIKFLNRNAYIMIAIYGRNFCRSAKDAFNLLMRNVLKVAVTDEVTYFVLFLGKLLVAGSIGVLAFLFFTQRLPVIAQGPASLNYYWVPLLTVIFGSYLIAHGFFSVYAMCVETIFICFCEDLERNDGSTEKPYFVTPNLHGILIKKQLVPQKQKE

SEQ ID NO: 81904 - protein, 717 aa, Homo sapiens
  Payload ID: 16295
  Gene Symbol: SLC44A5
  Gene Name: solute carrier family 44, member 5
  Uniprot ID: Q8NCS7
  ENSP ID: ENSP00000359896
MNDTEKPADTPSEEEDFGDPRTYDPDFKGPVANRSCTDVLCCMIFLLCIIGYIVLGLVAWVHGDPRRAAYPTDSQGHFCGQKGTPNENKTILFYFNLLRCTSPSVLLNLQCPTTQICVSKCPEKFLTYVEMQLLYTKDKSYWEDYRQFCKTTAKPVKSLTQLLLDDDCPTAIFPSKPFLQRCFPDFSTKNGTLTIGSKMMFQDGNGGTRSVVELGIAANGINKLLDAKSLGLKVFEDYARTWYWILIGLTIAMVLSWIFLILLRFIAGCLFWVFMIGVIGIIGYGIWHCYQQYTNLQERPSSVLTIYDIGIQTNISMYFELQQTWFTFMIILCIIEVIVILMLIFLRNRIRVAIILLKEGSKAIGYVPSTLVYPALTFILLSICICYWVVTAVFLATSGVPVYKVIAPGGHCIHENQTCDPEIFNTTEIAKACPGALCNFAFYGGKSLYHQYIPTFHVYNLFVFLWLINFVIALGQCALAGAFATYYWAMKKPDDIPRYPLFTAFGRAIRYHTGSLAFGSLIIALIQMFKIVLEYLDHRLKRTQNTLSKFLQCCLRCCFWCLENAIKFLNRNAYIMIAIYGRNFCRSAKDAFNLLMRNVLKVAVTDEVTYFVLFLGKLLVAGSIGVLAFLFFTQRLPVIAQGPASLNYYWVPLLTVIFGSYLIAHGFFSVYAMCVETIFICFLEDLERNDGSTARPYYVSQPLLKIFQEENPQTRKQ

SEQ ID NO: 81905 - protein, 748 aa, Homo sapiens
  Payload ID: 16296
  Gene Symbol: SLC45A1
  Gene Name: solute carrier family 45, member 1
  Uniprot ID: Q9Y2W3
  ENSP ID: ENSP00000289877
MIPAASSTPPGDALFPSVAPQDFWRSQVTGYSGSVTRHLSHRANNFKRHPKRRKCIRPSPPPPPNTPCPLELVDFGDLHPQRSFRELLFNGCILFGIEFSYAMETAYVTPVLLQMGLPDQLYSLVWFISPILGFLLQPLLGAWSDRCTSRFGRRRPFILVLAIGALLGLSLLLNGRDIGIALADVTGNHKWGLLLTVCGVVLMDFSADSADNPSHAYMMDVCSPADQDRGLNIHALLAGLGGGFGYVVGGIHWDKTGFGRALGGQLRVIYLFTAVTLSVTTVLTLVSIPERPLRPPSEKRAAMKSPSLPLPPSPPVLPEEGPGDSLPSHTATNFSSPISPPSPLTPKYGSFISRDSSLTGISEFASSFGTANIDSVLIDCFTGGHDSYLAIPGSVPRPPISVSFPRAPDGFYRQDRGLLEGREGALTSGCDGDILRVGSLDTSKPRSSGILKRPQTLAIPDAAGGGGPETSRRRNVTFSQQVANILLNGVKYESELTGSSERAEQPLSVGRLCSTICNMPKALRTLCVNHFLGWLSFEGMLLFYTDFMGEVVFQGDPKAPHTSEAYQKYNSGVTMGCWGMCIYAFSAAFYSAILEKLEEFLSVRTLYFIAYLAFGLGTGLATLSRNLYVVLSLCITYGILFSTLCTLPYSLLCDYYQSKKFAGSSADGTRRGMGVDISLLSCQYFLAQILVSLVLGPLTSAVGSANGVMYFSSLVSFLGCLYSSLFVIYEIPPSDAADEEHRPLLLNV

SEQ ID NO: 81906 - protein, 782 aa, Homo sapiens
  Payload ID: 16296
  Gene Symbol: SLC45A1
  Gene Name: solute carrier family 45, member 1
  ENSP ID: ENSP00000418096
MLQQPGPRPGRQQPSGDRDACRLHPQGRPPALPTMIPAASSTPPGDALFPSVAPQDFWRSQVTGYSGSVTRHLSHRANNFKRHPKRRKCIRPSPPPPPNTPCPLELVDFGDLHPQRSFRELLFNGCILFGIEFSYAMETAYVTPVLLQMGLPDQLYSLVWFISPILGFLLQPLLGAWSDRCTSRFGRRRPFILVLAIGALLGLSLLLNGRDIGIALADVTGNHKWGLLLTVCGVVLMDFSADSADNPSHAYMMDVCSPADQDRGLNIHALLAGLGGGFGYVVGGIHWDKTGFGRALGGQLRVIYLFTAVTLSVTTVLTLVSIPERPLRPPSEKRAAMKSPSLPLPPSPPVLPEEGPGDSLPSHTATNFSSPISPPSPLTPKYGSFISRDSSLTGISEFASSFGTANIDSVLIDCFTGGHDSYLAIPGSVPRPPISVSFPRAPDGFYRQDRGLLEGREGALTSGCDGDILRVGSLDTSKPRSSGILKRPQTLAIPDAAGGGGPETSRRRNVTFSQQVANILLNGVKYESELTGSSERAEQPLSVGRLCSTICNMPKALRTLCVNHFLGWLSFEGMLLFYTDFMGEVVFQGDPKAPHTSEAYQKYNSGVTMGCWGMCIYAFSAAFYSAILEKLEEFLSVRTLYFIAYLAFGLGTGLATLSRNLYVVLSLCITYGILFSTLCTLPYSLLCDYYQSKKFAGSSADGTRRGMGVDISLLSCQYFLAQILVSLVLGPLTSAVGSANGVMYFSSLVSFLGCLYSSLFVIYEIPPSDAADEEHRPLLLNV

SEQ ID NO: 81907 - protein, 530 aa, Homo sapiens
  Payload ID: 16297
  Gene Symbol: SLC45A2
  Gene Name: solute carrier family 45, member 2
  Uniprot ID: Q9UMX9
  ENSP ID: ENSP00000296589
MGSNSGQAGRHIYKSLADDGPFDSVEPPKRPTSRLIMHSMAMFGREFCYAVEAAYVTPVLLSVGLPSSLYSIVWFLSPILGFLLQPVVGSASDHCRSRWGRRRPYILTLGVMMLVGMALYLNGATVVAALIANPRRKLVWAISVTMIGVVLFDFAADFIDGPIKAYLFDVCSHQDKEKGLHYHALFTGFGGALGYLLGAIDWAHLELGRLLGTEFQVMFFFSALVLTLCFTVHLCSISEAPLTEVAKGIPPQQTPQDPPLSSDGMYEYGSIEKVKNGYVNPELAMQGAKNKNHAEQTRRAMTLKSLLRALVNMPPHYRYLCISHLIGWTAFLSNMLFFTDFMGQIVYRGDPYSAHNSTEFLIYERGVEVGCWGLCINSVFSSLYSYFQKVLVSYIGLKGLYFTGYLLFGLGTGFIGLFPNVYSTLVLCSLFGVMSSTLYTVPFNLITEYHREEEKERQQAPGGDPDNSVRGKGMDCATLTCMVQLAQILVGGGLGFLVNTAGTVVVVVITASAVALIGCCFVALFVRYVD

SEQ ID NO: 81908 - protein, 460 aa, Homo sapiens
  Payload ID: 16297
  Gene Symbol: SLC45A2
  Gene Name: solute carrier family 45, member 2
  Uniprot ID: Q9UMX9
  ENSP ID: ENSP00000371534
MGSNSGQAGRHIYKSLADDGPFDSVEPPKRPTSRLIMHSMAMFGREFCYAVEAAYVTPVLLSVGLPSSLYSIVWFLSPILGFLLQPVVGSASDHCRSRWGRRRPYILTLGVMMLVGMALYLNGATVVAALIANPRRKLVWAISVTMIGVVLFDFAADFIDGPIKAYLFDVCSHQDKEKGLHYHALFTGFGGALGYLLGAIDWAHLELGRLLGTEFQVMFFFSALVLTLCFTVHLCSISEAPLTEVAKGIPPQQTPQDPPLSSDGMYEYGSIEKVKNGYVNPELAMQGAKNKNHAEQTRRAMTLKSLLRALVNMPPHYRYLCISHLIGWTAFLSNMLFFTDFMGQIVYRGDPYSAHNSTEFLIYERGVEVGCWGLCINSVFSSLYSYFQKVLVSYIGLKGLYFTGYLLFGLGTGFIGLFPNVYSTLVLCSLFGVMSSTLYTVPFNLITEYHREEEKEVCCH

SEQ ID NO: 81909 - protein, 243 aa, Homo sapiens
  Payload ID: 16297
  Gene Symbol: SLC45A2
  Gene Name: solute carrier family 45, member 2
  ENSP ID: ENSP00000421100
MGSNSGQAGRHIYKSLADDGPFDSVEPPKRPTSRLIMHSMAMFGREFCYAVEAAYVTPVLLSVGLPSSLYSIVWFLSPILGFLLQPVVGSASDHCRSRWGRRRPYILTLGVMMLVGMALYLNGATVVAALIANPRRKLVWAISVTMIGVVLFDFAADFIDGPIKAYLFDVCSHQDKEKGLHYHALFTDSQGNDIKVTAESTGEHASSLPLPLHQPPHWMDSLPVQHAVLHRFHGPDCVPRGSL

SEQ ID NO: 81910 - protein, 246 aa, Homo sapiens
  Payload ID: 16297
  Gene Symbol: SLC45A2
  Gene Name: solute carrier family 45, member 2
  ENSP ID: ENSP00000424010
MALYLNGATVVAGFGGALGYLLGAIDWAHLELGRLLGTEFQVMFFFSALVLTLCFTVHLCSISEAPLTEVAKGIPPQQTPQDPPLSSDGMYEYGSIEKVKNGYVNPELAMQGAKNKNHAEQTRRAMTLKSLLRALVNMPPHYRYLCISHLIGWTAFLSNMLFFTDFMGQIVYRGDPYSAHNSTEFLIYERGVEVGCWGLCINSVFSSLYSYFQKVLVSYIGLKGLYFTGYLLFGLGTGFIGLFPNV

SEQ ID NO: 81911 - protein, 164 aa, Homo sapiens
  Payload ID: 16297
  Gene Symbol: SLC45A2
  Gene Name: solute carrier family 45, member 2
  ENSP ID: ENSP00000485879
TRRAMTLKSLLRALVNMPPHYRYLCISHLIGWTAFLSNMLFFTDFMGQIVYRGDPYSAHNSTEFLIYERGVEVGCWGLCINSVFSSLYSYFQKVLVSYIGLKGLYFTGYLLFGLGTGFIGLFPNVYSTLVLCSLFGVMSSTLYTVPFNLITEYHREEEKEVCCH

SEQ ID NO: 81912 - protein, 56 aa, Homo sapiens
  Payload ID: 16297
  Gene Symbol: SLC45A2
  Gene Name: solute carrier family 45, member 2
  ENSP ID: ENSP00000486006
  MOD_RES (1)..(1): Any amino acid
XSQGNDIKVTAESTGEHASSLPLPLHQPPHWMDSLPVQHAVLHRFHGPDCVPRGSL

SEQ ID NO: 81913 - protein, 125 aa, Homo sapiens
  Payload ID: 16297
  Gene Symbol: SLC45A2
  Gene Name: solute carrier family 45, member 2
  ENSP ID: ENSP00000487529
TRRAMTLKSLLRALVNMPPHYRYLCISHLIGWTAFLSNMLFFTDFMGQIVYRGDPYSAHNSTEFLIYERGVEVGCWGLCINSVFSSLYSYFQKVLVSYIGLKGLYFTGYLLFGLGTGFIGLFPNV

SEQ ID NO: 81914 - protein, 234 aa, Homo sapiens
  Payload ID: 16297
  Gene Symbol: SLC45A2
  Gene Name: solute carrier family 45, member 2
  ENSP ID: ENSP00000487556
TRRAMTLKSLLRALVNMPPHYRYLCISHLIGWTAFLSNMLFFTDFMGQIVYRGDPYSAHNSTEFLIYERGVEVGCWGLCINSVFSSLYSYFQKVLVSYIGLKGLYFTGYLLFGLGTGFIGLFPNVYSTLVLCSLFGVMSSTLYTVPFNLITEYHREEEKERQQAPGGDPDNSVRGKGMDCATLTCMVQLAQILVGGGLGFLVNTAGTVVVVVITASAVALIGCCFVALFVRYVD

SEQ ID NO: 81915 - protein, 553 aa, Homo sapiens
  Payload ID: 16298
  Gene Symbol: SLC45A3
  Gene Name: solute carrier family 45, member 3
  Uniprot ID: Q96JT2
  ENSP ID: ENSP00000356113
MVQRLWVSRLLRHRKAQLLLVNLLTFGLEVCLAAGITYVPPLLLEVGVEEKFMTMVLGIGPVLGLVCVPLLGSASDHWRGRYGRRRPFIWALSLGILLSLFLIPRAGWLAGLLCPDPRPLELALLILGVGLLDFCGQVCFTPLEALLSDLFRDPDHCRQAYSVYAFMISLGGCLGYLLPAIDWDTSALAPYLGTQEECLFGLLTLIFLTCVAATLLVAEEAALGPTEPAEGLSAPSLSPHCCPCRARLAFRNLGALLPRLHQLCCRMPRTLRRLFVAELCSWMALMTFTLFYTDFVGEGLYQGVPRAEPGTEARRHYDEGVRMGSLGLFLQCAISLVFSLVMDRLVQRFGTRAVYLASVAAFPVAAGATCLSHSVAVVTASAALTGFTFSALQILPYTLASLYHREKQVFLPKYRGDTGGASSEDSLMTSFLPGPKPGAPFPNGHVGAGGSGLLPPPPALCGASACDVSVRVVVGEPTEARVVPGRGICLDLAILDSAFLLSQVAPSLFMGSIVQLSQSVTAYMVSAAGLGLVAIYFATQVVFDKSDLAKYSA

SEQ ID NO: 81916 - protein, 798 aa, Homo sapiens
  Payload ID: 16299
  Gene Symbol: SLC45A4
  Gene Name: solute carrier family 45, member 4
  Uniprot ID: Q5BKX6
  ENSP ID: ENSP00000024061
MGKASPASGLSRPKTLVSPLRSNQWSLQKGLPEQYYSLTWFLSPILGLIFTPLIGSASDRCTLSWGRRRPFILALCVGVLFGVALFLNGSAIGLALGDVPNRQPIGIVLTVLGVVVLDFSADATEGPIRAYLLDVVDSEEQDMALNIHAFSAGLGGAIGYVLGGLDWTQTFLGSWFRTQNQVLFFFAAIIFTVSVALHLFSIDEEQYSPQQERSAEEPGALDGGEPHGVPAFPDEVQSEHELALDYPDVDIMRSKSDSALHVPDTALDLEPELLFLHDIEPSIFHDASYPATPRSTSQELAKTKLPRLATFLKEAAKEDETLLDNHLNEAKVPNGSGSPTKDALGGYTRVDTKPSATSSSMRRRRHAFRRQASSTFSYYGKLGSHCYRYRRANAVVLIKPSRSMSDLYDMQKRQRQHRHRNQSGATTSSGDTESEEGEGETTVRLLWLSMLKMPRELMRLCLCHLLTWFSVIAEAVFYTDFMGQVIFEGDPKAPSNSTAWQAYNAGVKMGCWGLVIYAATGAICSALLQKYLDNYDLSVRVIYVLGTLGFSVGTAVMAMFPNVYVAMVTISTMGIVSMSISYCPYALLGQYHDIKQYIHHSPGNSKRGFGIDCAILSCQVYISQILVASALGGVVDAVGTVRVIPMVASVGSFLGFLTATFLVIYPNVSEEAKEEQKGLSSPLAGEGRAGGNSEKPTVLKLTRKEGLQGPVETERLQVLTSVRSRHIGWCRSCWRVFFFMIILEKKFSFPQCGSLRRMTYLLFLSELDTLCPGQPCPWAATAHQSWEEAGPGGLGRRQ

SEQ ID NO: 81917 - protein, 808 aa, Homo sapiens
  Payload ID: 16299
  Gene Symbol: SLC45A4
  Gene Name: solute carrier family 45, member 4
  ENSP ID: ENSP00000428137
MKMAPQNADPESMQVQELSVPLPDPQKAGGAEAENCETISEGSIDRIPMRLWVMHGAVMFGREFCYAMETALVTPILLQIGLPEQYYSLTWFLSPILGLIFTPLIGSASDRCTLSWGRRRPFILALCVGVLFGVALFLNGSAIGLALGDVPNRQPIGIVLTVLGVVVLDFSADATEGPIRAYLLDVVDSEEQDMALNIHAFSAGLGGAIGYVLGGLDWTQTFLGSWFRTQNQVLFFFAAIIFTVSVALHLFSIDEEQYSPQQERSAEEPGALDGGEPHGVPAFPDEVQSEHELALDYPDVDIMRSKSDSALHVPDTALDLEPELLFLHDIEPSIFHDASYPATPRSTSQELAKTKLPRLATFLKEAAKEDETLLDNHLNEAKVPNGSGSPTKDALGGYTRVDTKPSATSSSMRRRRHAFRRQASSTFSYYGKLGSHCYRYRRANAVVLIKPSRSMSDLYDMQKRQRQHRHRNQSGATTSSGDTESEEGEGETTVRLLWLSMLKMPRELMRLCLCHLLTWFSVIAEAVFYTDFMGQVIFEGDPKAPSNSTAWQAYNAGVKMGCWGLVIYAATGAICSALLQKYLDNYDLSVRVIYVLGTLGFSVGTAVMAMFPNVYVAMVTISTMGIVSMSISYCPYALLGQYHDIKQYIHHSPGNSKRGFGIDCAILSCQVYISQILVASALGGVVDAVGTVRVIPMVASVGSFLGFLTATFLVIYPNVSEEAKEEQKGLSSPLAGEGRAGGNSEKPTVLKLTRKEGLQGPVETESVTPAGIDVCQISSHWLVPQLLESIFLYDYFRKKIFFSTMWFS

SEQ ID NO: 81918 - protein, 95 aa, Homo sapiens
  Payload ID: 16299
  Gene Symbol: SLC45A4
  Gene Name: solute carrier family 45, member 4
  ENSP ID: ENSP00000429033
MALNIHAFSAGLGGAIGYVLGGLDWTQTFLGSWFRTQNQVLFFFAAIIFTVSVALHLFSIDEEQYSPQQERSAEEPGALDGGEPHGVPAFPDEVQ

SEQ ID NO: 81919 - protein, 717 aa, Homo sapiens
  Payload ID: 16299
  Gene Symbol: SLC45A4
  Gene Name: solute carrier family 45, member 4
  Uniprot ID: Q5BKX6
  ENSP ID: ENSP00000429059
MGKASPASGLSRPKTLVSPLRSNQWSLQKGLPEQYYSLTWFLSPILGLIFTPLIGSASDRCTLSWGRRRPFILALCVGVLFGVALFLNGSAIGLALGDVPNRQPIGIVLTVLGVVVLDFSADATEGPIRAYLLDVVDSEEQDMALNIHAFSAGLGGAIGYVLGGLDWTQTFLGSWFRTQNQVLFFFAAIIFTVSVALHLFSIDEEQYSPQQERSAEEPGALDGGEPHGVPAFPDEVQSEHELALDYPDVDIMRSKSDSALHVPDTALDLEPELLFLHDIEPSIFHDASYPATPRSTSQELAKTKLPRLATFLKEAAKEDETLLDNHLNEAKVPNGSGSPTKDALGGYTRVDTKPSATSSSMRRRRHAFRRQASSTFSYYGKLGSHCYRYRRANAVVLIKPSRSMSDLYDMQKRQRQHRHRNQSGATTSSGDTESEEGEGETTVRLLWLSMLKMPRELMRLCLCHLLTWFSVIAEAVFYTDFMGQVIFEGDPKAPSNSTAWQAYNAGVKMGCWGLVIYAATGAICSALLQKYLDNYDLSVRVIYVLGTLGFSVGTAVMAMFPNVYVAMVTISTMGIVSMSISYCPYALLGQYHDIKQYIHHSPGNSKRGFGIDCAILSCQVYISQILVASALGGVVDAVGTVRVIPMVASVGSFLGFLTATFLVIYPNVSEEAKEEQKGLSSPLAGEGRAGGNSEKPTVLKLTRKEGLQGPVETESVV

SEQ ID NO: 81920 - protein, 102 aa, Homo sapiens
  Payload ID: 16299
  Gene Symbol: SLC45A4
  Gene Name: solute carrier family 45, member 4
  ENSP ID: ENSP00000429974
MRPLTCNSFTESLPEQYYSLTWFLSPILGLIFTPLIGSASDRCTLSWGRRRPFILALCVGVLFGVALFLNGSAIGLALGDVPNRQPIGIVLTVLGVVVLDFS

SEQ ID NO: 81921 - protein, 32 aa, Homo sapiens
  Payload ID: 16300
  Gene Symbol: SLC46A1
  Gene Name: solute carrier family 46 (folate transporter), member 1
  ENSP ID: ENSP00000462942
MQEVETLTSHWTLYMNVGGFLVGLFSSTLLGA

SEQ ID NO: 81922 - protein, 124 aa, Homo sapiens
  Payload ID: 16300
  Gene Symbol: SLC46A1
  Gene Name: solute carrier family 46 (folate transporter), member 1
  ENSP ID: ENSP00000463339
  MOD_RES (1)..(1): Any amino acid
XLSTPLCWDSKLIGYGSAAQHLPYLTSLLALKLLQYCLADAWVAEIGLAFNILGMVVFAFATITPLMFTGCWKRLILTSSSSSFPRAPDLPGPEDRGQEEQSEHQATGGLQLEAQPTAGQATLV

SEQ ID NO: 81923 - protein, 250 aa, Homo sapiens
  Payload ID: 16300
  Gene Symbol: SLC46A1
  Gene Name: solute carrier family 46 (folate transporter), member 1
  ENSP ID: ENSP00000464190
MQEVETLTSHWTLYMNVGGFLVGLFSSTLLGAWSDSVGRRPLLVLASLGLLLQALVSVFVVQLQLHVGYFVLGRILCALLGDFGGLLAASFASVADVSSSRSRTFRMALLEASIGVAGMLASLLGGHWLRAQGYANPFWLALALLIAMTLYAAFCFGETLKEPKSTRLFTFRHHRSIVQLYVAPAPEKSRKHLALYSLAIFVVITVHFGAQDILTLYELSTPLCWDSKLIGYGSAAQHLPYLTSLLALKL

SEQ ID NO: 81924 - protein, 128 aa, Homo sapiens
  Payload ID: 16300
  Gene Symbol: SLC46A1
  Gene Name: solute carrier family 46 (folate transporter), member 1
  ENSP ID: ENSP00000467416
MNVGGFLVGLFSSTLLGAWSDSVGRRPLLVLASLGLLLQALVSVFVVQLQLHVGYFVLGRILCALLGDFGGLLAASFASVADVSSSRSRTFRMALLEASIGVAGMLASLLGGHWLRAQGYANPFWLAL

SEQ ID NO: 81925 - protein, 459 aa, Homo sapiens
  Payload ID: 16300
  Gene Symbol: SLC46A1
  Gene Name: solute carrier family 46 (folate transporter), member 1
  Uniprot ID: Q96NT5
  ENSP ID: ENSP00000480703
MEGSASPPEKPRARPAAAVLCRGPVEPLVFLANFALVLQGPLTTQYLWHRFSADLGYNGTRQRGGCSNRSADPTMQEVETLTSHWTLYMNVGGFLVGLFSSTLLGAWSDSVGRRPLLVLASLGLLLQALVSVFVVQLQLHVGYFVLGRILCALLGDFGGLLAASFASVADVSSSRSRTFRMALLEASIGVAGMLASLLGGHWLRAQGYANPFWLALALLIAMTLYAAFCFGETLKEPKSTRLFTFRHHRSIVQLYVAPAPEKSRKHLALYSLAIFVVITVHFGAQDILTLYELSTPLCWDSKLIGYGSAAQHLPYLTSLLALKLLQYCLADAWVAEIGLAFNILGMVVFAFATITPLMFTGYGLLFLSLVITPVIRAKLSKLVRETEQGALFSAVACVNSLAMLTASGIFNSLYPATLNFMKGFPFLLGAGLLLIPAVLIGMLEKADPHLEFQQFPQSP

SEQ ID NO: 81926 - protein, 431 aa, Homo sapiens
  Payload ID: 16300
  Gene Symbol: SLC46A1
  Gene Name: solute carrier family 46 (folate transporter), member 1
  Uniprot ID: Q96NT5
  ENSP ID: ENSP00000483652
MEGSASPPEKPRARPAAAVLCRGPVEPLVFLANFALVLQGPLTTQYLWHRFSADLGYNGTRQRGGCSNRSADPTMQEVETLTSHWTLYMNVGGFLVGLFSSTLLGAWSDSVGRRPLLVLASLGLLLQALVSVFVVQLQLHVGYFVLGRILCALLGDFGGLLAASFASVADVSSSRSRTFRMALLEASIGVAGMLASLLGGHWLRAQGYANPFWLALALLIAMTLYAAFCFGETLKEPKSTRLFTFRHHRSIVQLYVAPAPEKSRKHLALYSLAIFVVITVHFGAQDILTLYELSTPLCWDSKLIGYGSAAQHLPYLTSLLALKLLQYCLADAWVAEIGLAFNILGMVVFAFATITPLMFTGALFSAVACVNSLAMLTASGIFNSLYPATLNFMKGFPFLLGAGLLLIPAVLIGMLEKADPHLEFQQFPQSP

SEQ ID NO: 81927 - protein, 475 aa, Homo sapiens
  Payload ID: 16301
  Gene Symbol: SLC46A2
  Gene Name: solute carrier family 46, member 2
  Uniprot ID: Q9BY10
  ENSP ID: ENSP00000363345
MSPEVTCPRRGHLPRFHPRTWVEPVVASSQVAASLYDAGLLLVVKASYGTGGSSNHSASPSPRGALEDQQQRAISNFYIIYNLVVGLSPLLSAYGLGWLSDRYHRKISICMSLLGFLLSRLGLLLKVLLDWPVEVLYGAAALNGLFGGFSAFWSGVMALGSLGSSEGRRSVRLILIDLMLGLAGFCGSMASGHLFKQMAGHSGQGLILTACSVSCASFALLYSLLVLKVPESVAKPSQELPAVDTVSGTVGTYRTLDPDQLDQQYAVGHPPSPGKAKPHKTTIALLFVGAIIYDLAVVGTVDVIPLFVLREPLGWNQVQVGYGMAAGYTIFITSFLGVLVFSRCFRDTTMIMIGMVSFGSGALLLAFVKETYMFYIARAVMLFALIPVTTIRSAMSKLIKGSSYGKVFVILQLSLALTGVVTSTLYNKIYQLTMDMFVGSCFALSSFLSFLAIIPISIVAYKQVPLSPYGDIIEK

SEQ ID NO: 81928 - protein, 341 aa, Homo sapiens
  Payload ID: 16301
  Gene Symbol: SLC46A2
  Gene Name: solute carrier family 46, member 2
  ENSP ID: ENSP00000474847
MSPEVTCPRRGHLPRFHPRTWVEPVVASSQVAASLYDAGLLLVVKASYGTGGSSNHSASPSPRGALEDQQQRAISNFYIIYNLVVGLSPLLSAYGLGWLSDRYHRKISICMSLLGFLLSRLGLLLKVLLDWPVEVLYGAAALNGLFGGFSAFWSGVMALGSLGSSEGRRSVRLILIDLMLGLAGFCGSMASGHLFKQMAGHSGQGLILTACSVSCASFALLYSLLVLKVPESVAKPSQELPAVDTVSGTVGTYRTLDPDQLDQQYAVGHPPSPGKAKPHKTTIALLFVGAIIYDLAVVGTVDVIPLFVLREPLGWNQVQLEPSCCLLSSPSQPSDQLCPNS

SEQ ID NO: 81929 - protein, 461 aa, Homo sapiens
  Payload ID: 16302
  Gene Symbol: SLC46A3
  Gene Name: solute carrier family 46, member 3
  Uniprot ID: Q7Z3Q1
  ENSP ID: ENSP00000266943
MKILFVEPAIFLSAFAMTLTGPLTTQYVYRRIWEETGNYTFSSDSNISECEKNKSSPIFAFQEEVQKKVSRFNLQMDISGLIPGLVSTFILLSISDHYGRKFPMILSSVGALATSVWLCLLCYFAFPFQLLIASTFIGAFCGNYTTFWGACFAYIVDQCKEHKQKTIRIAIIDFLLGLVTGLTGLSSGYFIRELGFEWSFLIIAVSLAVNLIYILFFLGDPVKECSSQNVTMSCSEGFKNLFYRTYMLFKNASGKRRFLLCLLLFTVITYFFVVIGIAPIFILYELDSPLCWNEVFIGYGSALGSASFLTSFLGIWLFSYCMEDIHMAFIGIFTTMTGMAMTAFASTTLMMFLARVPFLFTIVPFSVLRSMLSKVVRSTEQGTLFACIAFLETLGGVTAVSTFNGIYSATVAWYPGFTFLLSAGLLLLPAISLCVVKCTSWNEGSYELLIQEESSEDASDR

SEQ ID NO: 81930 - protein, 463 aa, Homo sapiens
  Payload ID: 16302
  Gene Symbol: SLC46A3
  Gene Name: solute carrier family 46, member 3
  Uniprot ID: Q7Z3Q1
  ENSP ID: ENSP00000370192
MKILFVEPAIFLSAFAMTLTGPLTTQYVYRRIWEETGNYTFSSDSNISECEKNKSSPIFAFQEEVQKKVSRFNLQMDISGLIPGLVSTFILLSISDHYGRKFPMILSSVGALATSVWLCLLCYFAFPFQLLIASTFIGAFCGNYTTFWGACFAYIVDQCKEHKQKTIRIAIIDFLLGLVTGLTGLSSGYFIRELGFEWSFLIIAVSLAVNLIYILFFLGDPVKECSSQNVTMSCSEGFKNLFYRTYMLFKNASGKRRFLLCLLLFTVITYFFVVIGIAPIFILYELDSPLCWNEVFIGYGSALGSASFLTSFLGIWLFSYCMEDIHMAFIGIFTTMTGMAMTAFASTTLMMFLARVPFLFTIVPFSVLRSMLSKVVRSTEQGTLFACIAFLETLGGVTAVSTFNGIYSATVAWYPGFTFLLSAGLLLLPAISLCVVKCTSWNEGSYELLIQEESSEDASDRAC

SEQ ID NO: 81931 - protein, 570 aa, Homo sapiens
  Payload ID: 16303
  Gene Symbol: SLC47A1
  Gene Name: solute carrier family 47 (multidrug and toxin extrusion), member 1
  Uniprot ID: Q96FL8
  ENSP ID: ENSP00000270570
MEAPEEPAPVRGGPEATLEVRGSRCLRLSAFREELRALLVLAGPAFLVQLMVFLISFISSVFCGHLGKLELDAVTLAIAVINVTGVSVGFGLSSACDTLISQTYGSQNLKHVGVILQRSALVLLLCCFPCWALFLNTQHILLLFRQDPDVSRLTQTYVTIFIPALPATFLYMLQVKYLLNQGIVLPQIVTGVAANLVNALANYLFLHQLHLGVIGSALANLISQYTLALLLFLYILGKKLHQATWGGWSLECLQDWASFLRLAIPSMLMLCMEWWAYEVGSFLSGILGMVELGAQSIVYELAIIVYMVPAGFSVAASVRVGNALGAGDMEQARKSSTVSLLITVLFAVAFSVLLLSCKDHVGYIFTTDRDIINLVAQVVPIYAVSHLFEALACTSGGVLRGSGNQKVGAIVNTIGYYVVGLPIGIALMFATTLGVMGLWSGIIICTVFQAVCFLGFIIQLNWKKACQQAQVHANLKVNNVPRSGNSALPQDPLHPGCPENLEGILTNDVGKTGEPQSDQQMRQEEPLPEHPQDGAKLSRKQLVLRRGLLLLGVFLILLVGILVRFYVRIQ

SEQ ID NO: 81932 - protein, 586 aa, Homo sapiens
  Payload ID: 16303
  Gene Symbol: SLC47A1
  Gene Name: solute carrier family 47 (multidrug and toxin extrusion), member 1
  Uniprot ID: Q96FL8
  ENSP ID: ENSP00000378951
MEAPEEPAPVRGGPEATLEVRGSRCLRLSAFREELRALLVLAGPAFLVQLMVFLISFISSVFCGHLGKLELDAVTLAIAVINVTGVSVGFGLSSACDTLISQTYGSQNLKHVGVILQRSALVLLLCCFPCWALFLNTQHILLLFRQDPDVSRLTQTYVTIFIPALPATFLYMLQVKYLLNQGIVLPQIVTGVAANLVNALANYLFLHQLHLGVIGSALANLISQYTLALLLFLYILGKKLHQATWGGWSLECLQDWASFLRLAIPSMLMLCMEWWAYEVGSFLSGILGMVELGAQSIVYELAIIVYMVPAGFSVAASVRVGNALGAGDMEQARKSSTVSLLITVLFAVAFSVLLLSCKDHVGYIFTTDRDIINLVAQVVPIYAVSHLFEALACTSGGVLRGSGNQKVGAIVNTIGYYVVGLPIGIALMFATTLGVMGLWSGIIICTVFQAVCFLGFIIQLNWKKACQQAQVHANLKVNNVPRSGNSALPQDPLHPGCPENLEGILTNDVGKTGEPQSDQQMRQEEPLPEHPQDGAKLSRKQLVLRRGLLLLGVFLILLAGVRWCDHSSLQPRTLGLQAILLCQPPE

SEQ ID NO: 81933 - protein, 443 aa, Homo sapiens
  Payload ID: 16303
  Gene Symbol: SLC47A1
  Gene Name: solute carrier family 47 (multidrug and toxin extrusion), member 1
  ENSP ID: ENSP00000407155
MEAPEEPAPVRGGPEATLEVRGSRCLRLSAFREELRALLVLAGPAFLVQLMVFLISFISSVFCGHLGKLELDAVTLAIATYGSQNLKHVGVILQRSALVLLLCCFPCWALFLNTQHILLLFRQDPDVSRLTQTYVTIFIPALPATFLYMLQVKYLLNQGIVLPQIVTGVAANLVNALANYLFLHQLHLGVIGSALANLISQYTLALLLFLYILGKKLHQATWGGWSLECLQDWASFLRLAIPSMLMLCMEWWAYEVGSFLSGILGMVELGAQSIVYELAIIVYMVPAGFSVAASVRVGNALGAGDMEQARKSSTVSLLITVLFAVAFSVLLLSCKDHVGYIFTTDRDIINLVAQVVPIYAVSHLFEALACTSGGVLRGSGNQKVGAIVNTIGYYVVGLPIGIALMFATTLGVMGSGTRQFESKQRASEWEFCSPSGSASPRVP

SEQ ID NO: 81934 - protein, 268 aa, Homo sapiens
  Payload ID: 16303
  Gene Symbol: SLC47A1
  Gene Name: solute carrier family 47 (multidrug and toxin extrusion), member 1
  ENSP ID: ENSP00000460164
MEAPEEPAPVRGGPEATLEVRGSRCLRLSAFREELRALLVLAGPAFLVQLMVFLISFISSVFCGHLGKLELDAVTLAIAVINVTGVSVGFGLSSACDTLISQTYGSQNLKHVGVILQRSALVLLLCCFPCWALFLNTQHILLLFRQDPDVSRLTQTYVTIFIPALPAQVHANLKVNNVPRSGNSALPQDPLHPGCPENLEGILTNDVGKTGEPQSDQQMRQEEPLPEHPQDGAKLSRKQLVLRRGLLLLGVFLILLVGILVRFYVRIQ

SEQ ID NO: 81935 - protein, 99 aa, Homo sapiens
  Payload ID: 16303
  Gene Symbol: SLC47A1
  Gene Name: solute carrier family 47 (multidrug and toxin extrusion), member 1
  ENSP ID: ENSP00000462225
  MOD_RES (1)..(1): Any amino acid
XLKVNNVPRSGNSALPQDPLHPGCPENLEGILTNDVGKTGEPQSDQQMRQEEPLPEHPQDGAKLSRKQLVLRRGLLLLGVFLILLLVKLRAVSWDQLCP

SEQ ID NO: 81936 - protein, 316 aa, Homo sapiens
  Payload ID: 16303
  Gene Symbol: SLC47A1
  Gene Name: solute carrier family 47 (multidrug and toxin extrusion), member 1
  ENSP ID: ENSP00000462630
MCPGLPRPMSRSSFQLFLQPFFICYKLNICSTRLSSSPMARSPGNVCVPPTGWSLECLQDWASFLRLAIPSMLMLCMEWWAYEVGSFLSGILGMVELGAQSIVYELAIIVYMVPAGFSVAASVRVGNALGAGDMEQARKSSTVSLLITVLFAVAFSVLLLSCKDHVGYIFTTDRDIINLVAQVVPIYAVSHLFEALACTSGGVLRGSGNQKVGAIVNTIGYYVVGLPIGIALMFATTLGVMGCPENLEGILTNDVGKTGEPQSDQQMRQEEPLPEHPQDGAKLSRKQLVLRRGLLLLGVFLILLVGILVRFYVRIQ

SEQ ID NO: 81937 - protein, 602 aa, Homo sapiens
  Payload ID: 16304
  Gene Symbol: SLC47A2
  Gene Name: solute carrier family 47 (multidrug and toxin extrusion), member 2
  Uniprot ID: Q86VL8
  ENSP ID: ENSP00000326671
MDSLQDTVALDHGGCCPALSRLVPRGFGTEMWTLFALSGPLFLFQVLTFMIYIVSTVFCGHLGKVELASVTLAVAFVNVCGVSVGVGLSSACDTLMSQSFGSPNKKHVGVILQRGALVLLLCCLPCWALFLNTQHILLLFRQDPDVSRLTQDYVMIFIPGLPVIFLYNLLAKYLQNQGWLKGQEEESPFQTPGLSILHPSHSHLSRASFHLFQKITWPQVLSGVVGNCVNGVANYALVSVLNLGVRGSAYANIISQFAQTVFLLLYIVLKKLHLETWAGWSSQCLQDWGPFFSLAVPSMLMICVEWWAYEIGSFLMGLLSVVDLSAQAVIYEVATVTYMIPLGLSIGVCVRVGMALGAADTVQAKRSAVSGVLSIVGISLVLGTLISILKNQLGHIFTNDEDVIALVSQVLPVYSVFHVFEAICCVYGGVLRGTGKQAFGAAVNAITYYIIGLPLGILLTFVVRMRIMGLWLGMLACVFLATAAFVAYTARLDWKLAAEEAKKHSGRQQQQRAESTATRPGPEKAVLSSVATGSSPGITLTTYSRSECHVDFFRTPEEAHALSAPTSRLSVKQLVIRRGAALGAASATLMVGLTVRILATRH

SEQ ID NO: 81938 - protein, 580 aa, Homo sapiens
  Payload ID: 16304
  Gene Symbol: SLC47A2
  Gene Name: solute carrier family 47 (multidrug and toxin extrusion), member 2
  Uniprot ID: Q86VL8
  ENSP ID: ENSP00000338084
MDSLQDTVALDHGGCCPALSRLVPRGFGTEMWTLFALSGPLFLFQVLTFMIYIVSTVFCGHLGKVELASVTLAVAFVNVCGVSVGVGLSSACDTLMSQSFGSPNKKHVGVILQRGALVLLLCCLPCWALFLNTQHILLLFRQDPDVSRLTQDYVMIFIPGLPVIFLYNLLAKYLQNQKITWPQVLSGVVGNCVNGVANYALVSVLNLGVRGSAYANIISQFAQTVFLLLYIVLKKLHLETWAGWSSQCLQDWGPFFSLAVPSMLMICVEWWAYEIGSFLMGLLSVVDLSAQAVIYEVATVTYMRHSHRLAYAAHVTRIPLGLSIGVCVRVGMALGAADTVQAKRSAVSGVLSIVGISLVLGTLISILKNQLGHIFTNDEDVIALVSQVLPVYSVFHVFEAICCVYGGVLRGTGKQAFGAAVNAITYYIIGLPLGILLTFVVRMRIMGLWLGMLACVFLATAAFVAYTARLDWKLAAEEAKKHSGRQQQQRAESTATRPGPEKAVLSSVATGSSPGITLTTYSRSECHVDFFRTPEEAHALSAPTSRLSVKQLVIRRGAALGAASATLMVGLTVRILATRH

SEQ ID NO: 81939 - protein, 363 aa, Homo sapiens
  Payload ID: 16304
  Gene Symbol: SLC47A2
  Gene Name: solute carrier family 47 (multidrug and toxin extrusion), member 2
  ENSP ID: ENSP00000391848
MDSLQDTVALDHGGCCPALSRLVPRGFGTEMWTLFALSGPLFLFQVLTFMIYIVSTVFCGHLGKVELASVTLAVAFVNVCGVSVGVGLSSACDTLMSQSFGSPNKKHVGVILQRGALVLLLCCLPCWALFLNTQHILLLFRQDPDVSRLTQDYVMIFIPGLPVIFLYNLLAKYLQNQKITWPQVLSGVVGNCVNGVANYALVSVLNLGVRGSAYANIISQFAQTVFLLLYIVLKKLHLETWAGWSSQCLQDWGPFFSLAVPSMLMICVEWWAYEIGSFLMGLLSVVDLSAQAVIYEVATVTYMIPLGLSIGVCVRVGMALGAADTVQAKRSAVSGVLSIVGISLVLGTLISILKNQLGHIFTN

SEQ ID NO: 81940 - protein, 219 aa, Homo sapiens
  Payload ID: 16304
  Gene Symbol: SLC47A2
  Gene Name: solute carrier family 47 (multidrug and toxin extrusion), member 2
  Uniprot ID: Q86VL8
  ENSP ID: ENSP00000458694
MDSLQDTVALDHGGCCPALSRLVPRGFGTEMWTLFALSGPLFLFQVLTFMIYIVSTVFCGHLGKVELASVTLAVAFVNVCGVSVGVGLSSACDTLMSQSFGSPNKKHVGVILQRGALVLLLCCLPCWALFLNTQHILLLFRQDPDVSRLTQDYVMIFIPGLPVIFLYNLLAKYLQNQAGERLCVPASSNSSTGMAEGAGGGVPIPNPGFVHPPSISLTP

SEQ ID NO: 81941 - protein, 89 aa, Homo sapiens
  Payload ID: 16305
  Gene Symbol: SLC48A1
  Gene Name: solute carrier family 48 (heme transporter), member 1
  Uniprot ID: Q6P1K1
  ENSP ID: ENSP00000410134
MYMQDYWRTWLKGLRGFFFVGVLFSAVSIAAFCTFLVLAITRHQSLTDPTSYYLSSVWSFISFKWAFLLSLYAHRYRADFADISILSDF

SEQ ID NO: 81942 - protein, 146 aa, Homo sapiens
  Payload ID: 16305
  Gene Symbol: SLC48A1
  Gene Name: solute carrier family 48 (heme transporter), member 1
  Uniprot ID: Q6P1K1
  ENSP ID: ENSP00000415998
MAPSRLQLGLRAAYSGISSVAGFSIFLVWTVVYRQPGTAAMGGLAGVLALWVLVTHVMYMQDYWRTWLKGLRGFFFVGVLFSAVSIAAFCTFLVLAITRHQSLTDPTSYYLSSVWSFISFKWAFLLSLYAHRYRADFADISILSDF

SEQ ID NO: 81943 - protein, 16 aa, Homo sapiens
  Payload ID: 16305
  Gene Symbol: SLC48A1
  Gene Name: solute carrier family 48 (heme transporter), member 1
  ENSP ID: ENSP00000446686
MYMQDYWRTWLKGLRG

SEQ ID NO: 81944 - protein, 89 aa, Homo sapiens; identical to SEQ ID NO: 81941
  Payload ID: 16305
  Gene Symbol: SLC48A1
  Gene Name: solute carrier family 48 (heme transporter), member 1
  Uniprot ID: Q6P1K1
  ENSP ID: ENSP00000446739

SEQ ID NO: 81945 - protein, 52 aa, Homo sapiens
  Payload ID: 16305
  Gene Symbol: SLC48A1
  Gene Name: solute carrier family 48 (heme transporter), member 1
  ENSP ID: ENSP00000449036
MAPSRLQLGLRAAYSGISSVAGFSIFLVWTVVYRQPGTAAMGGLGCWHCGSW

SEQ ID NO: 81946 - protein, 36 aa, Homo sapiens
  Payload ID: 16305
  Gene Symbol: SLC48A1
  Gene Name: solute carrier family 48 (heme transporter), member 1
  ENSP ID: ENSP00000450234
MYMQDYWRTWLKGLRGFFFVGVLFSAVSIAAFCTFL

SEQ ID NO: 81947 - protein, 659 aa, Homo sapiens
  Payload ID: 16306
  Gene Symbol: SLC5A4
  Gene Name: solute carrier family 5 (glucose activated ion channel), member 4
  Uniprot ID: Q9NY91
  ENSP ID: ENSP00000266086
MASTVSPSTIAETPEPPPLSDHIRNAADISVIVIYFLVVMAVGLWAMLKTNRGTIGGFFLAGRDMAWWPMGASLFASNIGSNHYVGLAGTGAASGVATVTFEWTSSVMLLILGWIFVPIYIKSGVMTMPEYLKKRFGGERLQVYLSILSLFICVVLLISADIFAGAIFIKLALGLDLYLAIFILLAMTAVYTTTGGLASVIYTDTLQTIIMLIGSFILMGFAFNEVGGYESFTEKYVNATPSVVEGDNLTISASCYTPRADSFHIFRDAVTGDIPWPGIIFGMPITALWYWCTNQVIVQRCLCGKDMSHVKAACIMCAYLKLLPMFLMVMPGMISRILYTDMVACVVPSECVKHCGVDVGCTNYAYPTMVLELMPQGLRGLMLSVMLASLMSSLTSIFNSASTLFTIDLYTKMRKQASEKELLIAGRIFVLLLTVVSIVWVPLVQVSQNGQLIHYTESISSYLGPPIAAVFVLAIFCKRVNEQGAFWGLMVGLAMGLIRMITEFAYGTGSCLAPSNCPKIICGVHYLYFSIVLFFGSMLVTLGISLLTKPIPDVHLYRLCWVLRNSTEERIDIDAEEKSQEETDDGVEEDYPEKSRGCLKKAYDLFCGLQKGPKLTKEEEEALSKKLTDTSERPSWRTIVNINAILLLAVVVFIHGYYA

SEQ ID NO: 81948 - protein, 580 aa, Homo sapiens
  Payload ID: 16307
  Gene Symbol: SLC5A7
  Gene Name: solute carrier family 5 (sodium/choline cotransporter), member 7
  Uniprot ID: Q9GZV3
  ENSP ID: ENSP00000264047
MAFHVEGLIAIIVFYLLILLVGIWAAWRTKNSGSAEERSEAIIVGGRDIGLLVGGFTMTATWVGGGYINGTAEAVYVPGYGLAWAQAPIGYSLSLILGGLFFAKPMRSKGYVTMLDPFQQIYGKRMGGLLFIPALMGEMFWAAAIFSALGATISVIIDVDMHISVIISALIATLYTLVGGLYSVAYTDVVQLFCIFVGLWISVPFALSHPAVADIGFTAVHAKYQKPWLGTVDSSEVYSWLDSFLLLMLGGIPWQAYFQRVLSSSSATYAQVLSFLAAFGCLVMAIPAILIGAIGASTDWNQTAYGLPDPKTTEEADMILPIVLQYLCPVYISFFGLGAVSAAVMSSADSSILSASSMFARNIYQLSFRQNASDKEIVWVMRITVFVFGASATAMALLTKTVYGLWYLSSDLVYIVIFPQLLCVLFVKGTNTYGAVAGYVSGLFLRITGGEPYLYLQPLIFYPGYYPDDNGIYNQKFPFKTLAMVTSFLTNICISYLAKYLFESGTLPPKLDVFDAVVARHSEENMDKTILVKNENIKLDELALVKPRQSMTLSSTFTNKEAFLDVDSSPEGSGTEDNLQ

SEQ ID NO: 81949 - protein, 580 aa, Homo sapiens; identical to SEQ ID NO: 81948
  Payload ID: 16307
  Gene Symbol: SLC5A7
  Gene Name: solute carrier family 5 (sodium/choline cotransporter), member 7
  Uniprot ID: Q9GZV3
  ENSP ID: ENSP00000387346

SEQ ID NO: 81950 - protein, 664 aa, Homo sapiens
  Payload ID: 16308
  Gene Symbol: SLC5A1
  Gene Name: solute carrier family 5 (sodium/glucose cotransporter), member 1
  Uniprot ID: P13866
  ENSP ID: ENSP00000266088
MDSSTWSPKTTAVTRPVETHELIRNAADISIIVIYFVVVMAVGLWAMFSTNRGTVGGFFLAGRSMVWWPIGASLFASNIGSGHFVGLAGTGAASGIAIGGFEWNALVLVVVLGWLFVPIYIKAGVVTMPEYLRKRFGGQRIQVYLSLLSLLLYIFTKISADIFSGAIFINLALGLNLYLAIFLLLAITALYTITGGLAAVIYTDTLQTVIMLVGSLILTGFAFHEVGGYDAFMEKYMKAIPTIVSDGNTTFQEKCYTPRADSFHIFRDPLTGDLPWPGFIFGMSILTLWYWCTDQVIVQRCLSAKNMSHVKGGCILCGYLKLMPMFIMVMPGMISRILYTEKIACVVPSECEKYCGTKVGCTNIAYPTLVVELMPNGLRGLMLSVMLASLMSSLTSIFNSASTLFTMDIYAKVRKRASEKELMIAGRLFILVLIGISIAWVPIVQSAQSGQLFDYIQSITSYLGPPIAAVFLLAIFWKRVNEPGAFWGLILGLLIGISRMITEFAYGTGSCMEPSNCPTIICGVHYLYFAIILFAISFITIVVISLLTKPIPDVHLYRLCWSLRNSKEERIDLDAEEENIQEGPKETIEIETQVPEKKKGIFRRAYDLFCGLEQHGAPKMTEEEEKAMKMKMTDTSEKPLWRTVLNVNGIILVTVAVFCHAYFA

SEQ ID NO: 81951 - protein, 537 aa, Homo sapiens
  Payload ID: 16308
  Gene Symbol: SLC5A1
  Gene Name: solute carrier family 5 (sodium/glucose cotransporter), member 1
  Uniprot ID: P13866
  ENSP ID: ENSP00000444898
MPEYLRKRFGGQRIQVYLSLLSLLLYIFTKISADIFSGAIFINLALGLNLYLAIFLLLAITALYTITGGLAAVIYTDTLQTVIMLVGSLILTGFAFHEVGGYDAFMEKYMKAIPTIVSDGNTTFQEKCYTPRADSFHIFRDPLTGDLPWPGFIFGMSILTLWYWCTDQVIVQRCLSAKNMSHVKGGCILCGYLKLMPMFIMVMPGMISRILYTEKIACVVPSECEKYCGTKVGCTNIAYPTLVVELMPNGLRGLMLSVMLASLMSSLTSIFNSASTLFTMDIYAKVRKRASEKELMIAGRLFILVLIGISIAWVPIVQSAQSGQLFDYIQSITSYLGPPIAAVFLLAIFWKRVNEPGAFWGLILGLLIGISRMITEFAYGTGSCMEPSNCPTIICGVHYLYFAIILFAISFITIVVISLLTKPIPDVHLYRLCWSLRNSKEERIDLDAEEENIQEGPKETIEIETQVPEKKKGIFRRAYDLFCGLEQHGAPKMTEEEEKAMKMKMTDTSEKPLWRTVLNVNGIILVTVAVFCHAYFA

SEQ ID NO: 81952 - protein, 672 aa, Homo sapiens
  Payload ID: 16309
  Gene Symbol: SLC5A2
  Gene Name: solute carrier family 5 (sodium/glucose cotransporter), member 2
  Uniprot ID: P31639
  ENSP ID: ENSP00000327943
MEEHTEAGSAPEMGAQKALIDNPADILVIAAYFLLVIGVGLWSMCRTNRGTVGGYFLAGRSMVWWPVGASLFASNIGSGHFVGLAGTGAASGLAVAGFEWNALFVVLLLGWLFAPVYLTAGVITMPQYLRKRFGGRRIRLYLSVLSLFLYIFTKISVDMFSGAVFIQQALGWNIYASVIALLGITMIYTVTGGLAALMYTDTVQTFVILGGACILMGYAFHEVGGYSGLFDKYLGAATSLTVSEDPAVGNISSFCYRPRPDSYHLLRHPVTGDLPWPALLLGLTIVSGWYWCSDQVIVQRCLAGKSLTHIKAGCILCGYLKLTPMFLMVMPGMISRILYPDEVACVVPEVCRRVCGTEVGCSNIAYPRLVVKLMPNGLRGLMLAVMLAALMSSLASIFNSSSTLFTMDIYTRLRPRAGDRELLLVGRLWVVFIVVVSVAWLPVVQAAQGGQLFDYIQAVSSYLAPPVSAVFVLALFVPRVNEQGAFWGLIGGLLMGLARLIPEFSFGSGSCVQPSACPAFLCGVHYLYFAIVLFFCSGLLTLTVSLCTAPIPRKHLHRLVFSLRHSKEEREDLDADEQQGSSLPVQNGCPESAMEMNEPQAPAPSLFRQCLLWFCGMSRGGVGSPPPLTQEEAAAAARRLEDISEDPSWARVVNLNALLMMAVAVFLWGFYA

SEQ ID NO: 81953 - protein, 458 aa, Homo sapiens
  Payload ID: 16309
  Gene Symbol: SLC5A2
  Gene Name: solute carrier family 5 (sodium/glucose cotransporter), member 2
  Uniprot ID: P31639
  ENSP ID: ENSP00000410601
MEEHTEAGSAPEMGAQKALIDNPADILVIAAYFLLVIGVGLWSMCRTNRGTVGGYFLAGRSMVWWPVGASLFASNIGSGHFVGLAGTGAASGLAVAGFEWNALFVVLLLGWLFAPVYLTAGVITMPQYLRKRFGGRRIRLYLSVLSLFLYIFTKISVDMFSGAVFIQQALGWNIYASVIALLGITMIYTVTGGLAALMYTDTVQTFVILGGACILMGYAFHEVGGYSGLFDKYLGAATSLTVSEDPAVGNISSFCYRPRPDSYHLLRHPVTGDLPWPALLLGLTIVSGWYWCSDQVIVQRCLAGKSLTHIKAGCILCGYLKLTPMFLMVMPGMISRILYPDEVACVVPEVCRRVCGTEVGCSNIAYPRLVVKLMPNGRLLGTHRGPADGPGTPDSRVLLRLGQLCAALGVPSFPLRRALPLLRHCAVLLLWPPHPHGLPVHRAHPQKAPPPPGLQSPA

SEQ ID NO: 81954 - protein, 148 aa, Homo sapiens
  Payload ID: 16309
  Gene Symbol: SLC5A2
  Gene Name: solute carrier family 5 (sodium/glucose cotransporter), member 2
  ENSP ID: ENSP00000455143
MCRTNRGTVGGYFLAGRSMVWWPVGASLFASNIGSGHFVGLAGTGAASGLAVAGFEWNALFVVLLLGWLFAPVYLTAGVITMPQYLRKRFGGRRIRLYLSVLSLFLYIFTKISVDMFSGAVFIQQALGWNIYASVIALLGITMIYTVT

SEQ ID NO: 81955 - protein, 675 aa, Homo sapiens
  Payload ID: 16310
  Gene Symbol: SLC5A11
  Gene Name: solute carrier family 5 (sodium/inositol cotransporter), member 11
  Uniprot ID: Q8WWX8
  ENSP ID: ENSP00000289932
MESGTSSPQPPQLDPLDAFPQKGLEPGDIAVLVLYFLFVLAVGLWSTVKTKRDTVKGYFLAGGDMVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 81956 - protein, 519 aa, Homo sapiens
  Payload ID: 16310
  Gene Symbol: SLC5A11
  Gene Name: solute carrier family 5 (sodium/inositol cotransporter), member 11
  Uniprot ID: Q8WWX8
  ENSP ID: ENSP00000389606
MVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSDCPADSGCQEPVPCQRRCSDGCIPEGAAPLHNGVPWDGQPHPLPRSSGLCRSRDLPEDLQQPLRLFGHRVSQTRAGTPAHSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 81957 - protein, 640 aa, Homo sapiens
  Payload ID: 16310
  Gene Symbol: SLC5A11
  Gene Name: solute carrier family 5 (sodium/inositol cotransporter), member 11
  Uniprot ID: Q8WWX8
  ENSP ID: ENSP00000416782
MESGTSSPQPPQLDPLDAFPQKGLEPGDIAVLVLYFLFVLAVGLWSTVKTKRDTVKGYFLAGGDMVWWPVGASLFASNVGSGHFIGLAGSGAATGISVSAYELNGLFSVLMLAWIFLPIYIAGQVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 81958 - protein, 605 aa, Homo sapiens
  Payload ID: 16310
  Gene Symbol: SLC5A11
  Gene Name: solute carrier family 5 (sodium/inositol cotransporter), member 11
  Uniprot ID: Q8WWX8
  ENSP ID: ENSP00000441384
MESGTSSPQPPQLDPLDAFPQKGLEPGDIAVLVLYFLFVLAVGLWSTVKTKRDTVKGYFLAGGDMVWWPGLFSVLMLAWIFLPIYIAGQVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 81959 - protein, 640 aa, Homo sapiens; identical to SEQ ID NO: 81957
  Payload ID: 16310
  Gene Symbol: SLC5A11
  Gene Name: solute carrier family 5 (sodium/inositol cotransporter), member 11
  Uniprot ID: Q8WWX8
  ENSP ID: ENSP00000454401

SEQ ID NO: 81960 - protein, 91 aa, Homo sapiens
  Payload ID: 16310
  Gene Symbol: SLC5A11
  Gene Name: solute carrier family 5 (sodium/inositol cotransporter), member 11
  ENSP ID: ENSP00000454732
MESGTSSPQPPQLDPLDAFPQKGLEPGDIAVLVLYFLFVLAVGLWSTVKTKRDTVKGYFLAGGDMVWWPVGASLFASNVGSGHFIGLAGSG

SEQ ID NO: 81961 - protein, 605 aa, Homo sapiens; identical to SEQ ID NO: 81958
  Payload ID: 16310
  Gene Symbol: SLC5A11
  Gene Name: solute carrier family 5 (sodium/inositol cotransporter), member 11
  Uniprot ID: Q8WWX8
  ENSP ID: ENSP00000456234

SEQ ID NO: 81962 - protein, 519 aa, Homo sapiens; identical to SEQ ID NO: 81956
  Payload ID: 16310
  Gene Symbol: SLC5A11
  Gene Name: solute carrier family 5 (sodium/inositol cotransporter), member 11
  Uniprot ID: Q8WWX8
  ENSP ID: ENSP00000456376

SEQ ID NO: 81963 - protein, 611 aa, Homo sapiens
  Payload ID: 16310
  Gene Symbol: SLC5A11
  Gene Name: solute carrier family 5 (sodium/inositol cotransporter), member 11
  Uniprot ID: Q8WWX8
  ENSP ID: ENSP00000457179
MVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 81964 - protein, 62 aa, Homo sapiens
  Payload ID: 16310
  Gene Symbol: SLC5A11
  Gene Name: solute carrier family 5 (sodium/inositol cotransporter), member 11
  ENSP ID: ENSP00000458806
MESGTSSPQPPQLDPLDAFPQKGLEPGDIAVLVLYFLFVLAVGLWVGSPSVAQGTRTQWWQS

SEQ ID NO: 81965 - protein, 643 aa, Homo sapiens
  Payload ID: 16311
  Gene Symbol: SLC5A5
  Gene Name: solute carrier family 5 (sodium/iodide cotransporter), member 5
  Uniprot ID: Q92911
  ENSP ID: ENSP00000222248
MEAVETGERPTFGAWDYGVFALMLLVSTGIGLWVGLARGGQRSAEDFFTGGRRLAALPVGLSLSASFMSAVQVLGVPSEAYRYGLKFLWMCLGQLLNSVLTALLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVQRYVACRTEKQAKLALLINQVGLFLIVSSAACCGIVMFVFYTDCDPLLLGRISAPDQYMPLLVLDIFEDLPGVPGLFLACAYSGTLSTASTSINAMAAVTVEDLIKPRLRSLAPRKLVIISKGLSLIYGSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGTLTTVLCGALISCLTGPTKRSTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 81966 - protein, 396 aa, Homo sapiens
  Payload ID: 16312
  Gene Symbol: SLC5A12
  Gene Name: solute carrier family 5 (sodium/monocarboxylate cotransporter), member 12
  Uniprot ID: Q1EHB4
  ENSP ID: ENSP00000280467
MEVKNFAVWDYVVFAALFFISSGIGVFFAIKERKKATSREFLVGGRQMSFGPVGLSLTASFMSAVTVLGTPSEVYRFGASFLVFFIAYLFVILLTSELFLPVFYRSGITSTYEYLQLRFNKPVRYAATVIYIVQTILYTGVVVYAPALALNQVTGFDLWGSVFATGIVCTFYCTLGGLKAVVWTDAFQMVVMIVGFLTVLIQGSTHAGGFHNVLEQSTNGSRLHIFDFDVDPLRRHTFWTITVGGTFTWLGIYGVNQSTIQRCISCKTEKHAKLALYFNLLGLWIILVCAVFSGLIMYSHFKDCDPWTSGIISAPDQLMPYFVMEIFATMPGLPGLFVACAFSGTLSTVASSINALATVTFEDFVKSCFPHLSDKLSTWISKGLCRYSWWTFYSIS

SEQ ID NO: 81967 - protein, 618 aa, Homo sapiens
  Payload ID: 16312
  Gene Symbol: SLC5A12
  Gene Name: solute carrier family 5 (sodium/monocarboxylate cotransporter), member 12
  Uniprot ID: Q1EHB4
  ENSP ID: ENSP00000379326
MEVKNFAVWDYVVFAALFFISSGIGVFFAIKERKKATSREFLVGGRQMSFGPVGLSLTASFMSAVTVLGTPSEVYRFGASFLVFFIAYLFVILLTSELFLPVFYRSGITSTYEYLQLRFNKPVRYAATVIYIVQTILYTGVVVYAPALALNQVTGFDLWGSVFATGIVCTFYCTLGGLKAVVWTDAFQMVVMIVGFLTVLIQGSTHAGGFHNVLEQSTNGSRLHIFDFDVDPLRRHTFWTITVGGTFTWLGIYGVNQSTIQRCISCKTEKHAKLALYFNLLGLWIILVCAVFSGLIMYSHFKDCDPWTSGIISAPDQLMPYFVMEIFATMPGLPGLFVACAFSGTLSTVASSINALATVTFEDFVKSCFPHLSDKLSTWISKGLCLLFGVMCTSMAVAASVMGGVVQASLSIHGMCGGPMLGLFSLGIVFPFVNWKGALGGLLTGITLSFWVAIGAFIYPAPASKTWPLPLSTDQCIKSNVTATGPPVLSSRPGIADTWYSISYLYYSAVGCLGCIVAGVIISLITGRQRGEDIQPLLIRPVCNLFCFWSKKYKTLCWCGVQHDSGTEQENLENGSARKQGAESVLQNGLRRESLVHVPGYDPKDKSYNNMAFETTHF

SEQ ID NO: 81968 - protein, 150 aa, Homo sapiens
  Payload ID: 16312
  Gene Symbol: SLC5A12
  Gene Name: solute carrier family 5 (sodium/monocarboxylate cotransporter), member 12
  ENSP ID: ENSP00000435053
MVVMIVGFLTVLIQGSTHAGGFHNVLEQSTNGSRLHIFDFDVDPLRRHTFWTITVGGTFTWLGIYGVNQSTIQRCISCKTEKHAKLALYFNLLGLWIILVCAVFSGLIMYSHFKDCDPWTSGIISAPDQLMPYFVMEIFATMPGLPGLFV

SEQ ID NO: 81969 - protein, 277 aa, Homo sapiens
  Payload ID: 16312
  Gene Symbol: SLC5A12
  Gene Name: solute carrier family 5 (sodium/monocarboxylate cotransporter), member 12
  ENSP ID: ENSP00000436011
MVVMIVGFLTVLIQGSTHAGGFHNVLEQSTNGSRLHIFDFDVDPLRRHTFWTITVGGTFTWLGIYGVNQSTIQRCISCKTEKHAKLALYFNLLGLWIILVCAVFSGLIMYSHFKDCDPWTSGIISAPDQLMPYFVMEIFATMPGLPGLFVACAFSGTLSTVASSINALATVTFEDFVKSCFPHLSDKLSTWISKGLCRSLIWRDVYLYGCGCICHGRCCAGFPQHSRHVWRTNAGLILPGNRVPFCELEGCTRRSSYWNHLVILGGHWGLHLPCTSL

SEQ ID NO: 81970 - protein, 610 aa, Homo sapiens
  Payload ID: 16313
  Gene Symbol: SLC5A8
  Gene Name: solute carrier family 5 (sodium/monocarboxylate cotransporter), member 8
  Uniprot ID: Q8N695
  ENSP ID: ENSP00000445340
MDTPRGIGTFVVWDYVVFAGMLVISAAIGIYYAFAGGGQQTSKDFLMGGRRMTAVPVALSLTASFMSAVTVLGTPSEVYRFGAIFSIFAFTYFFVVVISAEVFLPVFYKLGITSTYEYLELRFNKCVRLCGTVLFIVQTILYTGIVIYAPALALNQVTGFDLWGAVVATGVVCTFYCTLGGLKAVIWTDVFQVGIMVAGFASVIIQAVVMQGGISTILNDAYDGGRLNFWNFNPNPLQRHTFWTIIIGGTFTWTSIYGVNQSQVQRYISCKSRFQAKLSLYINLVGLWAILTCSVFCGLALYSRYHDCDPWTAKKVSAPDQLMPYLVLDILQDYPGLPGLFVACAYSGTLSTVSSSINALAAVTVEDLIKPYFRSLSERSLSWISQGMSVVYGALCIGMAALASLMGALLQAALSVFGMVGGPLMGLFALGILVPFANSIGALVGLMAGFAISLWVGIGAQIYPPLPERTLPLHLDIQGCNSTYNETNLMTTTEMPFTTSVFQIYNVQRTPLMDNWYSLSYLYFSTVGTLVTLLVGILVSLSTGGRKQNLDPRYILTKEDFLSNFDIFKKKKHVLSYKSHPVEDGGTDNPAFNHIELNSDQSGKSNGTRL

SEQ ID NO: 81971 - protein, 610 aa, Homo sapiens; identical to SEQ ID NO: 81970
  Payload ID: 16313
  Gene Symbol: SLC5A8
  Gene Name: solute carrier family 5 (sodium/monocarboxylate cotransporter), member 8
  Uniprot ID: Q8N695
  ENSP ID: ENSP00000461697

SEQ ID NO: 81972 - protein, 635 aa, Homo sapiens
  Payload ID: 16314
  Gene Symbol: SLC5A6
  Gene Name: solute carrier family 5 (sodium/multivitamin and iodide cotransporter), member 6
  Uniprot ID: Q9Y289
  ENSP ID: ENSP00000310208
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAHIFIPVFYRLHLTSAYEYLELRFNKTVRVCGTVTFIFQMVIYMGVVLYAPSLALNAVTGFDLWLSVLALGIVCTVYTALGGLKAVIWTDVFQTLVMFLGQLAVIIVGSAKVGGLGRVWAVASQHGRISGFELDPDPFVRHTFWTLAFGGVFMMLSLYGVNQAQVQRYLSSRTEKAAVLSCYAVFPFQQVSLCVGCLIGLVMFAYYQEYPMSIQQAQAAPDQFVLYFVMDLLKGLPGLPGLFIACLFSGSLSTISSAFNSLATVTMEDLIRPWFPEFSEARAIMLSRGLAFGYGLLCLGMAYISSQMGPVLQAAISIFGMVGGPLLGLFCLGMFFPCANPPGAVVGLLAGLVMAFWIGIGSIVTSMGSSMPPSPSNGSSFSLPTNLTVATVTTLMPLTTFSKPTGLQRFYSLSYLWYSAHNSTTVIVVGLIVSLLTGRMRGRSLNPATIYPVLPKLLSLLPLSCQKRLHCRSYGQDHLDTGLFPEKPRNGVLGDSRDKEAMALDGTAYQGSSSTCILQETSL

SEQ ID NO: 81973 - protein, 147 aa, Homo sapiens
  Payload ID: 16314
  Gene Symbol: SLC5A6
  Gene Name: solute carrier family 5 (sodium/multivitamin and iodide cotransporter), member 6
  ENSP ID: ENSP00000384265
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAHIFIPVFYRLHLTSAYEYLELRFNKTVRVCGTV

SEQ ID NO: 81974 - protein, 635 aa, Homo sapiens; identical to SEQ ID NO: 81972
  Payload ID: 16314
  Gene Symbol: SLC5A6
  Gene Name: solute carrier family 5 (sodium/multivitamin and iodide cotransporter), member 6
  Uniprot ID: Q9Y289
  ENSP ID: ENSP00000384853

SEQ ID NO: 81975 - protein, 38 aa, Homo sapiens
  Payload ID: 16314
  Gene Symbol: SLC5A6
  Gene Name: solute carrier family 5 (sodium/multivitamin and iodide cotransporter), member 6
  ENSP ID: ENSP00000399299
MSVGVSTSAPLSPTSGTSVGMSTFSIMDYVVFVLLLVL

SEQ ID NO: 81976 - protein, 115 aa, Homo sapiens
  Payload ID: 16314
  Gene Symbol: SLC5A6
  Gene Name: solute carrier family 5 (sodium/multivitamin and iodide cotransporter), member 6
  ENSP ID: ENSP00000401347
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAH

SEQ ID NO: 81977 - protein, 58 aa, Homo sapiens
  Payload ID: 16314
  Gene Symbol: SLC5A6
  Gene Name: solute carrier family 5 (sodium/multivitamin and iodide cotransporter), member 6
  ENSP ID: ENSP00000402903
MSVGVSTSAPLSPTSGTSVGMSTFSIMDYVVFVLLLVLSLAIGLYHACRGWGRHTVGE

SEQ ID NO: 81978 - protein, 193 aa, Homo sapiens
  Payload ID: 16314
  Gene Symbol: SLC5A6
  Gene Name: solute carrier family 5 (sodium/multivitamin and iodide cotransporter), member 6
  ENSP ID: ENSP00000403851
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAHIFIPVFYRLHLTSAYEYLELRFNKTVRVCGTVTFIFQMVIYMGVVLYAPSLALNAVTGFDLWLSVLALGIVCTVYTAL

SEQ ID NO: 81979 - protein, 78 aa, Homo sapiens
  Payload ID: 16314
  Gene Symbol: SLC5A6
  Gene Name: solute carrier family 5 (sodium/multivitamin and iodide cotransporter), member 6
  ENSP ID: ENSP00000404032
MSVGVSTSAPLSPTSGTSVGMSTFSIMDYVVFVLLLVLSLAIGLYHACRGWGRHTVGELLMADRKMGCLPVALSLLAT

SEQ ID NO: 81980 - protein, 153 aa, Homo sapiens
  Payload ID: 16314
  Gene Symbol: SLC5A6
  Gene Name: solute carrier family 5 (sodium/multivitamin and iodide cotransporter), member 6
  ENSP ID: ENSP00000411361
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAHIFIPVFYRLHLTSAYEYLELRFNKTVRVCGTVTFIFQM

SEQ ID NO: 81981 - protein, 133 aa, Homo sapiens
  Payload ID: 16314
  Gene Symbol: SLC5A6
  Gene Name: solute carrier family 5 (sodium/multivitamin and iodide cotransporter), member 6
  ENSP ID: ENSP00000411536
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAHIFIPVFYRLHLTSAYEYL

SEQ ID NO: 81982 - protein, 27 aa, Homo sapiens
  Payload ID: 16314
  Gene Symbol: SLC5A6
  Gene Name: solute carrier family 5 (sodium/multivitamin and iodide cotransporter), member 6
  ENSP ID: ENSP00000412115
MSVGVSTSAPLSPTSGTSVGMSTFSIM

SEQ ID NO: 81983 - protein, 718 aa, Homo sapiens
  Payload ID: 16315
  Gene Symbol: SLC5A3
  Gene Name: solute carrier family 5 (sodium/myo-inositol cotransporter), member 3
  Uniprot ID: P53794
  ENSP ID: ENSP00000370543
MRAVLDTADIAIVALYFILVMCIGFFAMWKSNRSTVSGYFLAGRSMTWVAIGASLFVSNIGSEHFIGLAGSGAASGFAVGAWEFNALLLLQLLGWVFIPIYIRSGVYTMPEYLSKRFGGHRIQVYFAALSLILYIFTKLSVDLYSGALFIQESLGWNLYVSVILLIGMTALLTVTGGLVAVIYTDTLQALLMIIGALTLMIISIMEIGGFEEVKRRYMLASPDVTSILLTYNLSNTNSCNVSPKKEALKMLRNPTDEDVPWPGFILGQTPASVWYWCADQVIVQRVLAAKNIAHAKGSTLMAGFLKLLPMFIIVVPGMISRILFTDDIACINPEHCMLVCGSRAGCSNIAYPRLVMKLVPVGLRGLMMAVMIAALMSDLDSIFNSASTIFTLDVYKLIRKSASSRELMIVGRIFVAFMVVISIAWVPIIVEMQGGQMYLYIQEVADYLTPPVAALFLLAIFWKRCNEQGAFYGGMAGFVLGAVRLILAFAYRAPECDQPDNRPGFIKDIHYMYVATGLFWVTGLITVIVSLLTPPPTKEQIRTTTFWSKKNLVVKENCSPKEEPYKMQEKSILRCSENNETINHIIPNGKSEDSIKGLQPEDVNLLVTCREEGNPVASLGHSEAETPVDAYSNGQAALMGEKERKKETDDGGRYWKFIDWFCGFKSKSLSKRSLRDLMEEEAVCLQMLEETRQVKVILNIGLFAVCSLGIFMFVYFSL

SEQ ID NO: 81984 - protein, 566 aa, Homo sapiens
  Payload ID: 16316
  Gene Symbol: SLC5A10
  Gene Name: solute carrier family 5 (sodium/sugar cotransporter), member 10
  Uniprot ID: A0PJK1
  ENSP ID: ENSP00000324346
MTWWPIGASLFASSEGSGLFIGLAGSGAAGGLAVAGFEWNATYVLLALAWVFVPIYISSEIVTLPEYIQKRYGGQRIRMYLSVLSLLLSVFTKISLDLYAGALFVHICLGWNFYLSTILTLGITALYTIAAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGMISRALFPGAHVYEERHQVSVSRTDDVGCVVPSECLRACGAEVGCSNIAYPKLVMELMPIGLRGLMIAVMLAALMSSLTSIFNSSSTLFTMDIWRRLRPRSGERELLLVGRTGIPSTPPAPQSRLSFLLPETPPLERYLLGLVVMDLWLVIVALIGVSVAWIPVLQDSNSGQLFIYMQSVTSSLAPPVTAVFVLGVFWRRANEQGAFWGLIAGLVVGATRLVLEFLNPAPPCGEPDTRPAVLGSIHYLHFAVALFALSGAVVVAGSLLTPPPQSVQIENLTWWTLAQDVPLGTKAGDGQTPQKHAFWARVCGFNAILLMCVNIFFYAYFA

SEQ ID NO: 81985 - protein, 569 aa, Homo sapiens
  Payload ID: 16316
  Gene Symbol: SLC5A10
  Gene Name: solute carrier family 5 (sodium/sugar cotransporter), member 10
  Uniprot ID: A0PJK1
  ENSP ID: ENSP00000379005
MAANSTSDLHTPGTQLSVADIIVITVYFALNVAVGIWSSCRASRNTVNGYFLAGRDMTWWPIGASLFASSEGSGLFIGLAGSGAAGGLAVAGFEWNATYVLLALAWVFVPIYISSEIVTLPEYIQKRYGGQRIRMYLSVLSLLLSVFTKISLDLYAGALFVHICLGWNFYLSTILTLGITALYTIAAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGMISRALFPDDVGCVVPSECLRACGAEVGCSNIAYPKLVMELMPIGLRGLMIAVMLAALMSSLTSIFNSSSTLFTMDIWRRLRPRSGERELLLVGRLVIVALIGVSVAWIPVLQDSNSGQLFIYMQSVTSSLAPPVTAVFVLGVFWRRANEQGAFWGLIAGLVVGATRLVLEFLNPAPPCGEPDTRPAVLGSIHYLHFAVALFALSGAVVVAGSLLTPPPQSVQIENLTWWTLAQDVPLGTKAGDGQTPQKHAFWARVCGFNAILLMCVNIFFYAYFA

SEQ ID NO: 81986 - protein, 596 aa, Homo sapiens
  Payload ID: 16316
  Gene Symbol: SLC5A10
  Gene Name: solute carrier family 5 (sodium/sugar cotransporter), member 10
  Uniprot ID: A0PJK1
  ENSP ID: ENSP00000379007
MAANSTSDLHTPGTQLSVADIIVITVYFALNVAVGIWSSCRASRNTVNGYFLAGRDMTWWPIGASLFASSEGSGLFIGLAGSGAAGGLAVAGFEWNATYVLLALAWVFVPIYISSEIVTLPEYIQKRYGGQRIRMYLSVLSLLLSVFTKISLDLYAGALFVHICLGWNFYLSTILTLGITALYTIAGGLAAVIYTDALQTLIMVVGAVILTIKAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGMISRALFPDDVGCVVPSECLRACGAEVGCSNIAYPKLVMELMPIGLRGLMIAVMLAALMSSLTSIFNSSSTLFTMDIWRRLRPRSGERELLLVGRLVIVALIGVSVAWIPVLQDSNSGQLFIYMQSVTSSLAPPVTAVFVLGVFWRRANEQGAFWGLIAGLVVGATRLVLEFLNPAPPCGEPDTRPAVLGSIHYLHFAVALFALSGAVVVAGSLLTPPPQSVQIENLTWWTLAQDVPLGTKAGDGQTPQKHAFWARVCGFNAILLMCVNIFFYAYFA

SEQ ID NO: 81987 - protein, 612 aa, Homo sapiens
  Payload ID: 16316
  Gene Symbol: SLC5A10
  Gene Name: solute carrier family 5 (sodium/sugar cotransporter), member 10
  Uniprot ID: A0PJK1
  ENSP ID: ENSP00000379008
MAANSTSDLHTPGTQLSVADIIVITVYFALNVAVGIWSSCRASRNTVNGYFLAGRDMTWWPIGASLFASSEGSGLFIGLAGSGAAGGLAVAGFEWNATYVLLALAWVFVPIYISSEIVTLPEYIQKRYGGQRIRMYLSVLSLLLSVFTKISLDLYAGALFVHICLGWNFYLSTILTLGITALYTIAGGLAAVIYTDALQTLIMVVGAVILTIKAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGMISRALFPGAHVYEERHQVSVSRTDDVGCVVPSECLRACGAEVGCSNIAYPKLVMELMPIGLRGLMIAVMLAALMSSLTSIFNSSSTLFTMDIWRRLRPRSGERELLLVGRLVIVALIGVSVAWIPVLQDSNSGQLFIYMQSVTSSLAPPVTAVFVLGVFWRRANEQGAFWGLIAGLVVGATRLVLEFLNPAPPCGEPDTRPAVLGSIHYLHFAVALFALSGAVVVAGSLLTPPPQSVQIENLTWWTLAQDVPLGTKAGDGQTPQKHAFWARVCGFNAILLMCVNIFFYAYFA

SEQ ID NO: 81988 - protein, 560 aa, Homo sapiens
  Payload ID: 16316
  Gene Symbol: SLC5A10
  Gene Name: solute carrier family 5 (sodium/sugar cotransporter), member 10
  Uniprot ID: A0PJK1
  ENSP ID: ENSP00000401875
MAANSTSDLHTPGTQLSVADIIVITVYFALNVAVGIWSSCRASRNTVNGYFLAGRDMTWWPIGASLFASSEGSGLFIGLAGSGAAGGLAVAGFEWNATYVLLALAWVFVPIYISSEIVTLPEYIQKRYGGQRIRMYLSVLSLLLSVFTKISLDLYAGALFVHICLGWNFYLSTILTLGITALYTIAGGLAAVIYTDALQTLIMVVGAVILTIKAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGMISRALFPGLRGLMIAVMLAALMSSLTSIFNSSSTLFTMDIWRRLRPRSGERELLLVGRLVIVALIGVSVAWIPVLQDSNSGQLFIYMQSVTSSLAPPVTAVFVLGVFWRRANEQGAFWGLIAGLVVGATRLVLEFLNPAPPCGEPDTRPAVLGSIHYLHFAVALFALSGAVVVAGSLLTPPPQSVQIENLTWWTLAQDVPLGTKAGDGQTPQKHAFWARVCGFNAILLMCVNIFFYAYFA

SEQ ID NO: 81989 - protein, 706 aa, Homo sapiens
  Payload ID: 16317
  Gene Symbol: SLC5A9
  Gene Name: solute carrier family 5 (sodium/sugar cotransporter), member 9
  Uniprot ID: Q2M3M2
  ENSP ID: ENSP00000236495
MSKELAAMGPGASGDGVRTETAPHIALDSRVGLHAYDISVVVIYFVFVIAVGIWSSIRASRGTIGGYFLAGRSMSWWPIGASLMSSNVGSGLFIGLAGTGAAGGLAVGGFEWNMRKSRSGGDRGIHPRSHGRTGVRSQATWLLLALGWVFVPVYIAAGVVTMPQYLKKRFGGQRIQVYMSVLSLILYIFTKISTDIFSGALFIQMALGWNLYLSTGILLVVTAVYTIAGGLMAVIYTDALQTVIMVGGALVLMFLGFQDVGWYPGLEQRYRQAIPNVTVPNTTCHLPRPDAFHILRDPVSGDIPWPGLIFGLTVLATWCWCTDQVIVQRSLSAKSLSHAKGGSVLGGYLKILPMFFIVMPGMISRALFPDEVGCVDPDVCQRICGARVGCSNIAYPKLVMALMPVGLRGLMIAVIMAALMSSLTSIFNSSSTLFTIDVWQRFRRKSTEQELMVVGRVFVVFLVVISILWIPIIQSSNSGQLFDYIQAVTSYLAPPITALFLLAIFCKRVTEPGAFWGLVFGLGVGLLRMILEFSYPAPACGEVDRRPAVLKDFHYLYFAILLCGLTAIVIVIVSLCTTPIPEEQLTRLTWWTRNCPLSELEKEAHESTPEISERPAGECPAGGGAAENSSLGQEQPEAPSRSWGKLLWSWFCGLSGTPEQALSPAEKAALEQKLTSIEEEPLWRHVCNINAVLLLAINIFLWGYFA

SEQ ID NO: 81990 - protein, 173 aa, Homo sapiens
  Payload ID: 16317
  Gene Symbol: SLC5A9
  Gene Name: solute carrier family 5 (sodium/sugar cotransporter), member 9
  ENSP ID: ENSP00000399991
  MOD_RES (1)..(1): Any amino acid
XSKELAAMGPGASGDGVRTETAPHIALDSRVGLHAYDISVVVIYFVFVIAVGIWSSIRASRGTIGGYFLAGRSMSWWPIGASLMSSNVGSGLFIGLAGTGAAGGLAVGGFEWNATWLLLALGWVFVPVYIAAGVVTMPQYLKKRFGGQRIQVYMSVLSLILYIFTKISGSCWW

SEQ ID NO: 81991 - protein, 681 aa, Homo sapiens
  Payload ID: 16317
  Gene Symbol: SLC5A9
  Gene Name: solute carrier family 5 (sodium/sugar cotransporter), member 9
  Uniprot ID: Q2M3M2
  ENSP ID: ENSP00000401730
MSKELAAMGPGASGDGVRTETAPHIALDSRVGLHAYDISVVVIYFVFVIAVGIWSSIRASRGTIGGYFLAGRSMSWWPIGASLMSSNVGSGLFIGLAGTGAAGGLAVGGFEWNATWLLLALGWVFVPVYIAAGVVTMPQYLKKRFGGQRIQVYMSVLSLILYIFTKISTDIFSGALFIQMALGWNLYLSTGILLVVTAVYTIAGGLMAVIYTDALQTVIMVGGALVLMFLGFQDVGWYPGLEQRYRQAIPNVTVPNTTCHLPRPDAFHILRDPVSGDIPWPGLIFGLTVLATWCWCTDQVIVQRSLSAKSLSHAKGGSVLGGYLKILPMFFIVMPGMISRALFPDEVGCVDPDVCQRICGARVGCSNIAYPKLVMALMPVGLRGLMIAVIMAALMSSLTSIFNSSSTLFTIDVWQRFRRKSTEQELMVVGRVFVVFLVVISILWIPIIQSSNSGQLFDYIQAVTSYLAPPITALFLLAIFCKRVTEPGAFWGLVFGLGVGLLRMILEFSYPAPACGEVDRRPAVLKDFHYLYFAILLCGLTAIVIVIVSLCTTPIPEEQLTRLTWWTRNCPLSELEKEAHESTPEISERPAGECPAGGGAAENSSLGQEQPEAPSRSWGKLLWSWFCGLSGTPEQALSPAEKAALEQKLTSIEEEPLWRHVCNINAVLLLAINIFLWGYFA

SEQ ID NO: 81992 - protein, 283 aa, Homo sapiens
  Payload ID: 16317
  Gene Symbol: SLC5A9
  Gene Name: solute carrier family 5 (sodium/sugar cotransporter), member 9
  ENSP ID: ENSP00000404982
MSKELAAMGPGASGDGVRTETAPHIALDSRVGLHAYDISVVVIYFVFVIAVGIWSSIRASRGTIGGYFLAGRSMSWWPIGASLMSSNVGSGLFIGLAGTGAAGGLAVGGFEWNATWLLLALGWVFVPVYIAAGVVTMPQYLKKRFGGQRIQVYMSVLSLILYIFTKISTDIFSGALFIQMALGWNLYLSTGILLVVTAVYTIAGGLMAVIYTDALQTVIMVGGALVLMFLGHCAAVSLGQESVSCQGRLRAGGLPEDPPHVLHRHAWHDQPGPVPRRGGLRGP

SEQ ID NO: 81993 - protein, 76 aa, Homo sapiens
  Payload ID: 16317
  Gene Symbol: SLC5A9
  Gene Name: solute carrier family 5 (sodium/sugar cotransporter), member 9
  ENSP ID: ENSP00000431196
  MOD_RES (1)..(1): Any amino acid
XYPAPACGEVDRRPAVLKDFHYLYFAILLCGLTAIVIVIVSLCTTPIPEEQVPIIFGFTFTTSSRLDPFQFTPREL

SEQ ID NO: 81994 - protein, 702 aa, Homo sapiens
  Payload ID: 16317
  Gene Symbol: SLC5A9
  Gene Name: solute carrier family 5 (sodium/sugar cotransporter), member 9
  Uniprot ID: Q2M3M2
  ENSP ID: ENSP00000431900
MSKELAAMGPGASGDGVRTETAPHIALDSRVGLHAYDISVVVIYFVFVIAVGIWSSIRASRGTIGGYFLAGRSMSWWPIGASLMSSNVGSGLFIGLAGTGAAGGLAVGGFEWNMRKSRSGGDRGIHPRSHGRTGATWLLLALGWVFVPVYIAAGVVTMPQYLKKRFGGQRIQVYMSVLSLILYIFTKISTDIFSGALFIQMALGWNLYLSTGILLVVTAVYTIAGGLMAVIYTDALQTVIMVGGALVLMFLGFQDVGWYPGLEQRYRQAIPNVTVPNTTCHLPRPDAFHILRDPVSGDIPWPGLIFGLTVLATWCWCTDQVIVQRSLSAKSLSHAKGGSVLGGYLKILPMFFIVMPGMISRALFPDEVGCVDPDVCQRICGARVGCSNIAYPKLVMALMPVGLRGLMIAVIMAALMSSLTSIFNSSSTLFTIDVWQRFRRKSTEQELMVVGRVFVVFLVVISILWIPIIQSSNSGQLFDYIQAVTSYLAPPITALFLLAIFCKRVTEPGAFWGLVFGLGVGLLRMILEFSYPAPACGEVDRRPAVLKDFHYLYFAILLCGLTAIVIVIVSLCTTPIPEEQLTRLTWWTRNCPLSELEKEAHESTPEISERPAGECPAGGGAAENSSLGQEQPEAPSRSWGKLLWSWFCGLSGTPEQALSPAEKAALEQKLTSIEEEPLWRHVCNINAVLLLAINIFLWGYFA

SEQ ID NO: 81995 - protein, 167 aa, Homo sapiens
  Payload ID: 16318
  Gene Symbol: SLC50A1
  Gene Name: solute carrier family 50 (sugar efflux transporter), member 1
  Uniprot ID: Q9BRV3
  ENSP ID: ENSP00000306146
MEAGGFLDSLIYGACVVFTLGMFSAGLSDLRHMRMTRSVDNVQFLPFLTTEVNNLGWLSYGALKGDGILIVVNTVGAALQTLYILAYLHYCPRKAKVIQTKSTQCLSYPLTIATLLTSASWCLYGFRLRDPYIMVSNFPGIVTSFIRFWLFWKYPQEQDRNYWLLQT

SEQ ID NO: 81996 - protein, 166 aa, Homo sapiens
  Payload ID: 16318
  Gene Symbol: SLC50A1
  Gene Name: solute carrier family 50 (sugar efflux transporter), member 1
  Uniprot ID: Q9BRV3
  ENSP ID: ENSP00000357386
MRGLHPWHVLRRPLGPQAHANDPECGQRPVPALSHHGSQRVVLLQTATLLGVLLLGYGYFWLLVPNPEARLQQLGLFCSVFTISMYLSPLADLAKVIQTKSTQCLSYPLTIATLLTSASWCLYGFRLRDPYIMVSNFPGIVTSFIRFWLFWKYPQEQDRNYWLLQT

SEQ ID NO: 81997 - protein, 221 aa, Homo sapiens
  Payload ID: 16318
  Gene Symbol: SLC50A1
  Gene Name: solute carrier family 50 (sugar efflux transporter), member 1
  Uniprot ID: Q9BRV3
  ENSP ID: ENSP00000357389
MEAGGFLDSLIYGACVVFTLGMFSAGLSDLRHMRMTRSVDNVQFLPFLTTEVNNLGWLSYGALKGDGILIVVNTVGAALQTLYILAYLHYCPRKRVVLLQTATLLGVLLLGYGYFWLLVPNPEARLQQLGLFCSVFTISMYLSPLADLAKVIQTKSTQCLSYPLTIATLLTSASWCLYGFRLRDPYIMVSNFPGIVTSFIRFWLFWKYPQEQDRNYWLLQT

SEQ ID NO: 81998 - protein, 156 aa, Homo sapiens
  Payload ID: 16318
  Gene Symbol: SLC50A1
  Gene Name: solute carrier family 50 (sugar efflux transporter), member 1
  ENSP ID: ENSP00000420189
MEELGPQAHANDPECGQRPVPALSHHGSQRVVLLQTATLLGVLLLGYGYFWLLVPNPEARLQQLGLFCSVFTISMYLSPLADLAKVIQTKSTQCLSYPLTIATLLTSASWCLYGFRLRDPYIMVSNFPGIVTSFIRFWLFWKYPQEQDRNYWLLQT

SEQ ID NO: 81999 - protein, 175 aa, Homo sapiens
  Payload ID: 16318
  Gene Symbol: SLC50A1
  Gene Name: solute carrier family 50 (sugar efflux transporter), member 1
  ENSP ID: ENSP00000481368
MRGLHPCNLGWLSYGALKGDGILIVVNTVGAALQTLYILAYLHYCPRKRVVLLQTATLLGVLLLGYGYFWLLVPNPEARLQQLGLFCSVFTISMYLSPLADLAKVIQTKSTQCLSYPLTIATLLTSASWCLYGFRLRDPYIMVSNFPGIVTSFIRFWLFWKYPQEQDRNYWLLQT

SEQ ID NO: 82000 - protein, 340 aa, Homo sapiens
  Payload ID: 16319
  Gene Symbol: SLC51A
  Gene Name: solute carrier family 51, alpha subunit
  Uniprot ID: Q86UW1
  ENSP ID: ENSP00000296327
MEPGRTQIKLDPRYTADLLEVLKTNYGIPSACFSQPPTAAQLLRALGPVELALTSILTLLALGSIAIFLEDAVYLYKNTLCPIKRRTLLWKSSAPTVVSVLCCFGLWIPRSLVLVEMTITSFYAVCFYLLMLVMVEGFGGKEAVLRTLRDTPMMVHTGPCCCCCPCCPRLLLTRKKLQLLMLGPFQYAFLKITLTLVGLFLVPDGIYDPADISEGSTALWINTFLGVSTLLALWTLGIISRQARLHLGEQNMGAKFALFQVLLILTALQPSIFSVLANGGQIACSPPYSSKTRSQVMNCHLLILETFLMTVLTRMYYRRKDHKVGYETFSSPDLDLNLKA

SEQ ID NO: 82001 - protein, 58 aa, Homo sapiens
  Payload ID: 16319
  Gene Symbol: SLC51A
  Gene Name: solute carrier family 51, alpha subunit
  ENSP ID: ENSP00000391172
MEPGRTQIKLDPRYTADLLEVLKTNYGIPSACFSQPPTAAQLLRDRVWLCGPGWSAVV

SEQ ID NO: 82002 - protein, 66 aa, Homo sapiens
  Payload ID: 16319
  Gene Symbol: SLC51A
  Gene Name: solute carrier family 51, alpha subunit
  ENSP ID: ENSP00000405414
MLLILMLSLSFNEQASHPAPGPHLPAPPALPHPGACGIAGENAAMEPGRTQIKLDPRYTADLLEVL

SEQ ID NO: 82003 - protein, 23 aa, Homo sapiens
  Payload ID: 16319
  Gene Symbol: SLC51A
  Gene Name: solute carrier family 51, alpha subunit
  ENSP ID: ENSP00000409560
QARLHLGEQNMGAKFALFQQQHG

SEQ ID NO: 82004 - protein, 212 aa, Homo sapiens
  Payload ID: 16319
  Gene Symbol: SLC51A
  Gene Name: solute carrier family 51, alpha subunit
  ENSP ID: ENSP00000413951
  MOD_RES (1)..(1): Any amino acid
XACFSQPPTAAQLLRALGPVELALTSILTLLALGSIAIFLEDAVYLYKNTLCPIKRRTLLWKSSAPTLATFKERCLECVGFASCVLAAKGFRSLRVSLPPSPAPAPSEQVVSVLCCFGLWIPRSLVLVEMTITSFYAVCFYLLMLVMVEGFGGKEAVLRTLRDTPMMVHTGPCCCCCPCCPRLLLTRKKLQLLMLGPFQYAFLKITLTLVGL

SEQ ID NO: 82005 - protein, 128 aa, Homo sapiens
  Payload ID: 16320
  Gene Symbol: SLC51B
  Gene Name: solute carrier family 51, beta subunit
  Uniprot ID: Q86UW2
  ENSP ID: ENSP00000335292
MEHSEGAPGDPAGTVVPQELLEEMLWFFRVEDASPWNHSILALAAVVVIISMVLLGRSIQASRKEKMQPPEKETPEVLHLDEAKDHNSLNNLRETLLSEKPNLAQVELELKERDVLSVFLPDVPETES

SEQ ID NO: 82006 - protein, 448 aa, Homo sapiens
  Payload ID: 16321
  Gene Symbol: SLC52A1
  Gene Name: solute carrier family 52 (riboflavin transporter), member 1
  Uniprot ID: Q9NWF4
  ENSP ID: ENSP00000254853
MAAPTLGRLVLTHLLVALFGMGSWAAVNGIWVELPVVVKDLPEGWSLPSYLSVVVALGNLGLLVVTLWRQLAPGKGEQVPIQVVQVLSVVGTALLAPLWHHVAPVAGQLHSVAFLTLALVLAMACCTSNVTFLPFLSHLPPPFLRSFFLGQGLSALLPCVLALVQGVGRLECPPAPTNGTSGPPLDFPERFPASTFFWALTALLVTSAAAFRGLLLLLPSLPSVTTGGSGPELQLGSPGAEEEEKEEEEALPLQEPPSQAAGTIPGPDPEAHQLFSAHGAFLLGLMAFTSAVTNGVLPSVQSFSCLPYGRLAYHLAVVLGSAANPLACFLAMGVLCRSLAGLVGLSLLGMLFGAYLMALAILSPCPPLVGTTAGVVLVVLSWVLCLCVFSYVKVAASSLLHGGGRPALLAAGVAIQVGSLLGAGAMFPPTSIYHVFQSRKDCVDPCGP

SEQ ID NO: 82007 - protein, 448 aa, Homo sapiens; identical to SEQ ID NO: 82006
  Payload ID: 16321
  Gene Symbol: SLC52A1
  Gene Name: solute carrier family 52 (riboflavin transporter), member 1
  Uniprot ID: Q9NWF4
  ENSP ID: ENSP00000399979

SEQ ID NO: 82008 - protein, 350 aa, Homo sapiens
  Payload ID: 16321
  Gene Symbol: SLC52A1
  Gene Name: solute carrier family 52 (riboflavin transporter), member 1
  ENSP ID: ENSP00000443026
MAAPTLGRLVLTHLLVALFGMGSWAAVNGIWVELPVVVKDLPEGWSLPSYLSVVVALGNLGLLVVTLWRQLAPGKGEQVPIQVVQVLSVVGTALLAPLWHHVAPVAGQLHSVAFLTLALVLAMACCTSNVTFLPFLSHLPPPFLRSFFLGQGLSALLPCVLALVQGVGRLECPPAPTNGTSGPPLDFPERFPASTFFWALTALLVTSAAAFRGLLLLLPSLPSVTTGGSGPELQLGSPGAEEEEKEEEEALPLQEPPSQAAGTIPGPDPEAHQLFSAHGAFLLGLMAFTSAVTNGVLPSVQSFSCLPYGRLAYHLAVVLGSAANPLACFLAMGVLCRCCRGCCVCVCSHM

SEQ ID NO: 82009 - protein, 445 aa, Homo sapiens
  Payload ID: 16322
  Gene Symbol: SLC52A2
  Gene Name: solute carrier family 52 (riboflavin transporter), member 2
  Uniprot ID: Q9HAB3
  ENSP ID: ENSP00000333638
MAAPTPARPVLTHLLVALFGMGSWAAVNGIWVELPVVVKELPEGWSLPSYVSVLVALGNLGLLVVTLWRRLAPGKDEQVPIRVVQVLGMVGTALLASLWHHVAPVAGQLHSVAFLALAFVLALACCASNVTFLPFLSHLPPRFLRSFFLGQGLSALLPCVLALVQGVGRLECPPAPINGTPGPPLDFLERFPASTFFWALTALLVASAAAFQGLLLLLPPPPSVPTGELGSGLQVGAPGAEEEVEESSPLQEPPSQAAGTTPGPDPKAYQLLSARSACLLGLLAATNALTNGVLPAVQSFSCLPYGRLAYHLAVVLGSAANPLACFLAMGVLCRSLAGLGGLSLLGVFCGGYLMALAVLSPCPPLVGTSAGVVLVVLSWVLCLGVFSYVKVAASSLLHGGGRPALLAAGVAIQVGSLLGAVAMFPPTSIYHVFHSRKDCADPCDS

SEQ ID NO: 82010 - protein, 445 aa, Homo sapiens; identical to SEQ ID NO: 82009
  Payload ID: 16322
  Gene Symbol: SLC52A2
  Gene Name: solute carrier family 52 (riboflavin transporter), member 2
  Uniprot ID: Q9HAB3
  ENSP ID: ENSP00000385961

SEQ ID NO: 82011 - protein, 172 aa, Homo sapiens
  Payload ID: 16322
  Gene Symbol: SLC52A2
  Gene Name: solute carrier family 52 (riboflavin transporter), member 2
  ENSP ID: ENSP00000431965
MAAPTPARPVLTHLLVALFGMGSWAAVNGIWVELPVVVKELPEGWSLPSYVSVLVALGNLGLLVVTLWRRLAPGKDEQVPIRVVQVLGMVGTALLASLWHHVAPVAGQLHSVAFLALAFVLALACCASNVTFLPFLSHLPPRFLRSFFLGQGLSALLPCVLALVQGVGRLEC

SEQ ID NO: 82012 - protein, 170 aa, Homo sapiens
  Payload ID: 16322
  Gene Symbol: SLC52A2
  Gene Name: solute carrier family 52 (riboflavin transporter), member 2
  ENSP ID: ENSP00000433583
MAAPTPARPVLTHLLVALFGMGSWAAVNGIWVELPVVVKELPEAAAFQGLLLLLPPPPSVPTGELGSGLQVGAPGAEEEVEESSPLQEPPSQAAGTTPGPDPKAYQLLSARSACLLGLLAATNALTNGVLPAVQSFSCLPYGRLAYHLAVVLGSAANPLACFLAMGVLCR

SEQ ID NO: 82013 - protein, 111 aa, Homo sapiens
  Payload ID: 16322
  Gene Symbol: SLC52A2
  Gene Name: solute carrier family 52 (riboflavin transporter), member 2
  ENSP ID: ENSP00000433796
MAAPTPARPVLTHLLVALFGMGSWAAVNGIWVELPVVVKELPEGAVVGAVSWRVLLREGGSQLPAAWRGPAGIAGSRRGHPGGLSARRCCYVPPDQHLSRVPQQKGLCRPL

SEQ ID NO: 82014 - protein, 69 aa, Homo sapiens
  Payload ID: 16322
  Gene Symbol: SLC52A2
  Gene Name: solute carrier family 52 (riboflavin transporter), member 2
  ENSP ID: ENSP00000434239
MAAPTPARPVLTHLLVALFGMGSWAAVNGIWVELPVVVKELPEGWSLPSYVSVLVALGNLGLLVVTLWR

SEQ ID NO: 82015 - protein, 445 aa, Homo sapiens; identical to SEQ ID NO: 82009
  Payload ID: 16322
  Gene Symbol: SLC52A2
  Gene Name: solute carrier family 52 (riboflavin transporter), member 2
  Uniprot ID: Q9HAB3
  ENSP ID: ENSP00000434728

SEQ ID NO: 82016 - protein, 445 aa, Homo sapiens; identical to SEQ ID NO: 82009
  Payload ID: 16322
  Gene Symbol: SLC52A2
  Gene Name: solute carrier family 52 (riboflavin transporter), member 2
  Uniprot ID: Q9HAB3
  ENSP ID: ENSP00000435820

SEQ ID NO: 82017 - protein, 445 aa, Homo sapiens; identical to SEQ ID NO: 82009
  Payload ID: 16322
  Gene Symbol: SLC52A2
  Gene Name: solute carrier family 52 (riboflavin transporter), member 2
  Uniprot ID: Q9HAB3
  ENSP ID: ENSP00000436768

SEQ ID NO: 82018 - protein, 87 aa, Homo sapiens
  Payload ID: 16322
  Gene Symbol: SLC52A2
  Gene Name: solute carrier family 52 (riboflavin transporter), member 2
  ENSP ID: ENSP00000436917
MAAPTPARPVLTHLLVALFGMGSWAAVNGIWVELPVVVKELPEGWSLPSYVSVLVALGNLGLLVVTLWRRLAPGKDEQVPIRVVQGS

SEQ ID NO: 82019 - protein, 469 aa, Homo sapiens
  Payload ID: 16323
  Gene Symbol: SLC52A3
  Gene Name: solute carrier family 52 (riboflavin transporter), member 3
  Uniprot ID: Q9NQ40
  ENSP ID: ENSP00000217254
MAFLMHLLVCVFGMGSWVTINGLWVELPLLVMELPEGWYLPSYLTVVIQLANIGPLLVTLLHHFRPSCLSEVPIIFTLLGVGTVTCIIFAFLWNMTSWVLDGHHSIAFLVLTFFLALVDCTSSVTFLPFMSRLPTYYLTTFFVGEGLSGLLPALVALAQGSGLTTCVNVTEISDSVPSPVPTRETDIAQGVPRALVSALPGMEAPLSHLESRYLPAHFSPLVFFLLLSIMMACCLVAFFVLQRQPRCWEASVEDLLNDQVTLHSIRPREENDLGPAGTVDSSQGQGYLEEKAAPCCPAHLAFIYTLVAFVNALTNGMLPSVQTYSCLSYGPVAYHLAATLSIVANPLASLVSMFLPNRSLLFLGVLSVLGTCFGGYNMAMAVMSPCPLLQGHWGGEVLIVASWVLFSGCLSYVKVMLGVVLRDLSRSALLWCGAAVQLGSLLGALLMFPLVNVLRLFSSADFCNLHCPA

SEQ ID NO: 82020 - protein, 415 aa, Homo sapiens
  Payload ID: 16323
  Gene Symbol: SLC52A3
  Gene Name: solute carrier family 52 (riboflavin transporter), member 3
  Uniprot ID: Q9NQ40
  ENSP ID: ENSP00000371370
MAFLMHLLVCVFGMGSWVTINGLWVELPLLVMELPEGWYLPSYLTVVIQLANIGPLLVTLLHHFRPSCLSEVPIIFTLLGVGTVTCIIFAFLWNMTSWVLDGHHSIAFLVLTFFLALVDCTSSVTFLPFMSRLPTYYLTTFFVGEGLSGLLPALVALAQGSGLTTCVNVTEISDSVPSPVPTRETDIAQGVPRALVSALPGMEAPLSHLESRYLPAHFSPLVFFLLLSIMMACCLVAFFVLQRQPRCWEASVEDLLNDQVTLHSIRPREENDLGPAGTVDSSQGQGYLEEKAAPCCPAHLAFIYTLVAFVNALTNGMLPSVQTYSCLSYGPVAYHLAATLSIVANPLASLVSMFLPNRSLLFLGVLSVLGTCFGGYNMAMAVMSPCPLLQGHWGGEVLIVSIRPVGLLPLRTPHP

SEQ ID NO: 82021 - protein, 469 aa, Homo sapiens; identical to SEQ ID NO: 82019
  Payload ID: 16323
  Gene Symbol: SLC52A3
  Gene Name: solute carrier family 52 (riboflavin transporter), member 3
  Uniprot ID: Q9NQ40
  ENSP ID: ENSP00000488723

SEQ ID NO: 82022 - protein, 642 aa, Homo sapiens
  Payload ID: 16324
  Gene Symbol: SLC6A14
  Gene Name: solute carrier family 6 (amino acid transporter), member 14
  Uniprot ID: Q9UN76
  ENSP ID: ENSP00000470801
MDKLKCPSFFKCREKEKVSASSENFHVGENDENQDRGNWSKKSDYLLSMIGYAVGLGNVWRFPYLTYSNGGGAFLIPYAIMLALAGLPLFFLECSLGQFASLGPVSVWRILPLFQGVGITMVLISIFVTIYYNVIIAYSLYYMFASFQSELPWKNCSSWSDKNCSRSPIVTHCNVSTVNKGIQEIIQMNKSWVDINNFTCINGSEIYQPGQLPSEQYWNKVALQRSSGMNETGVIVWYLALCLLLAWLIVGAALFKGIKSSGKVVYFTALFPYVVLLILLVRGATLEGASKGISYYIGAQSNFTKLKEAEVWKDAATQIFYSLSVAWGGLVALSSYNKFKNNCFSDAIVVCLTNCLTSVFAGFAIFSILGHMAHISGKEVSQVVKSGFDLAFIAYPEALAQLPGGPFWSILFFFMLLTLGLDSQFASIETITTTIQDLFPKVMKKMRVPITLGCCLVLFLLGLVCVTQAGIYWVHLIDHFCAGWGILIAAILELVGIIWIYGGNRFIEDTEMMIGAKRWIFWLWWRACWFVITPILLIAIFIWSLVQFHRPNYGAIPYPDWGVALGWCMIVFCIIWIPIMAIIKIIQAKGNIFQRLISCCRPASNWGPYLEQHRGERYKDMVDPKKEADHEIPTVSGSRKPE

SEQ ID NO: 82023 - protein, 599 aa, Homo sapiens [sequence omitted]

SEQ ID NO: 82024 - protein, 38 aa, Homo sapiens
  Payload ID: 16325
  Gene Symbol: SLC6A1
  Gene Name: solute carrier family 6 (neurotransmitter transporter), member 1
  ENSP ID: ENSP00000411689
MATNGSKVADGQISTEVSEAPVANDKPKTLVVKVQKKA

SEQ ID NO: 82025 - protein, 632 aa, Homo sapiens
  Payload ID: 16326
  Gene Symbol: SLC6A11
  Gene Name: solute carrier family 6 (neurotransmitter transporter), member 11
  Uniprot ID: P48066
  ENSP ID: ENSP00000254488
MTAEKALPLGNGKAAEEARESEAPGGGCSSGGAAPARHPRVKRDKAVHERGHWNNKVEFVLSVAGEIIGLGNVWRFPYLCYKNGGGAFLIPYVVFFICCGIPVFFLETALGQFTSEGGITCWRKVCPLFEGIGYATQVIEAHLNVYYIIILAWAIFYLSNCFTTELPWATCGHEWNTENCVEFQKLNVSNYSHVSLQNATSPVMEFWEHRVLAISDGIEHIGNLRWELALCLLAAWTICYFCIWKGTKSTGKVVYVTATFPYIMLLILLIRGVTLPGASEGIKFYLYPDLSRLSDPQVWVDAGTQIFFSYAICLGCLTALGSYNNYNNNCYRDCIMLCCLNSGTSFVAGFAIFSVLGFMAYEQGVPIAEVAESGPGLAFIAYPKAVTMMPLSPLWATLFFMMLIFLGLDSQFVCVESLVTAVVDMYPKVFRRGYRRELLILALSVISYFLGLVMLTEGGMYIFQLFDSYAASGMCLLFVAIFECICIGWVYGSNRFYDNIEDMIGYRPPSLIKWCWMIMTPGICAGIFIFFLIKYKPLKYNNIYTYPAWGYGIGWLMALSSMLCIPLWICITVWKTEGTLPEKLQKLTTPSTDLKMRGKLGVSPRMVTVNDCDAKLKSDGTIAAITEKETHF

SEQ ID NO: 82026 - protein, 208 aa, Homo sapiens
  Payload ID: 16326
  Gene Symbol: SLC6A11
  Gene Name: solute carrier family 6 (neurotransmitter transporter), member 11
  Uniprot ID: P48066
  ENSP ID: ENSP00000404120
MTAEKALPLGNGKAAEEARESEAPGGGCSSGGAAPARHPRVKRDKAVHERGHWNNKVEFVLSVAGEIIGLGNVWRFPYLCYKNGGGAFLIPYVVFFICCGIPVFFLETALGQFTSEGGITCWRKVCPLFEGIGYATQVIEAHLNVYYIIILAWAIFYLSNCFTTELPWATCGHEWNTENCVEFQKLNVSNYSHVSLQNATSPVMEFWE

SEQ ID NO: 82027 - protein, 614 aa, Homo sapiens
  Payload ID: 16327
  Gene Symbol: SLC6A12
  Gene Name: solute carrier family 6 (neurotransmitter transporter), member 12
  Uniprot ID: P48065
  ENSP ID: ENSP00000352702
MDGKVAVQECGPPAVSWVPEEGEKLDQEDEDQVKDRGQWTNKMEFVLSVAGEIIGLGNVWRFPYLCYKNGGGAFFIPYFIFFFVCGIPVFFLEVALGQYTSQGSVTAWRKICPLFQGIGLASVVIESYLNVYYIIILAWALFYLFSSFTSELPWTTCNNFWNTEHCTDFLNHSGAGTVTPFENFTSPVMEFWERRVLGITSGIHDLGSLRWELALCLLLAWVICYFCIWKGVKSTGKVVYFTATFPYLMLVILLIRGVTLPGAYQGIIYYLKPDLFRLKDPQVWMDAGTQIFFSFAICQGCLTALGSYNKYHNNCYKDCIALCFLNSATSFVAGFVVFSILGFMSQEQGVPISEVAESGPGLAFIAFPKAVTMMPLSQLWSCLFFIMLIFLGLDSQFVCVECLVTASIDMFPRQLRKSGRRELLILTIAVMCYLIGLFLVTEGGMYIFQLFDYYASSGICLLFLSLFEVVCISWVYGADRFYDNIEDMIGYRPWPLVKISWLFLTPGLCLATFLFSLSKYTPLKYNNVYVYPPWGYSIGWFLALSSMVCVPLFVVITLLKTRGPFRKRLRQLITPDSSLPQPKQHPCLDGSAGRNFGPSPTREGLIAGEKETHL

SEQ ID NO: 82028 - protein, 614 aa, Homo sapiens; identical to SEQ ID NO: 82027
  Payload ID: 16327
  Gene Symbol: SLC6A12
  Gene Name: solute carrier family 6 (neurotransmitter transporter), member 12
  Uniprot ID: P48065
  ENSP ID: ENSP00000380464

SEQ ID NO: 82029 - protein, 614 aa, Homo sapiens; identical to SEQ ID NO: 82027
  Payload ID: 16327
  Gene Symbol: SLC6A12
  Gene Name: solute carrier family 6 (neurotransmitter transporter), member 12
  Uniprot ID: P48065
  ENSP ID: ENSP00000399136

SEQ ID NO: 82030 - protein, 146 aa, Homo sapiens
  Payload ID: 16327
  Gene Symbol: SLC6A12
  Gene Name: solute carrier family 6 (neurotransmitter transporter), member 12
  ENSP ID: ENSP00000439351
MDGKVAVQECGPPAVSWVPEEGEKLDQEDEDQVKDRGQWTNKMEFVLSVAGEIIGLGNVWRFPYLCYKNGGGAFFIPYFIFFFVCGIPVFFLEVALGQYTSQGSVTAWRKICPLFQGIGLASVVIESYLNVYYIIILAWALFYLFS

SEQ ID NO: 82031 - protein, 614 aa, Homo sapiens; identical to SEQ ID NO: 82027
  Payload ID: 16327
  Gene Symbol: SLC6A12
  Gene Name: solute carrier family 6 (neurotransmitter transporter), member 12
  Uniprot ID: P48065
  ENSP ID: ENSP00000444268

SEQ ID NO: 82032 - protein, 81 aa, Homo sapiens
  Payload ID: 16327
  Gene Symbol: SLC6A12
  Gene Name: solute carrier family 6 (neurotransmitter transporter), member 12
  ENSP ID: ENSP00000446082
MDGKVAVQECGPPAVSWVPEEGEKLDQEDEDQEPSSSPTSSSSLSAASRCSSWRWRWANTPAKGVSQPGGRSAPSSRALVW

SEQ ID NO: 82033 - protein, 602 aa, Homo sapiens
  Payload ID: 16328
  Gene Symbol: SLC6A13
  Gene Name: solute carrier family 6 (neurotransmitter transporter), member 13
  Uniprot ID: Q9NSD5
  ENSP ID: ENSP00000339260
MDSRVSGTTSNGETKPVYPVMEKKEEDGTLERGHWNNKMEFVLSVAGEIIGLGNVWRFPYLCYKNGGGAFFIPYLVFLFTCGIPVFLLETALGQYTSQGGVTAWRKICPIFEGIGYASQMIVILLNVYYIIVLAWALFYLFSSFTIDLPWGGCYHEWNTEHCMEFQKTNGSLNGTSENATSPVIEFWERRVLKISDGIQHLGALRWELALCLLLAWVICYFCIWKGVKSTGKVVYFTATFPYLMLVVLLIRGVTLPGAAQGIQFYLYPNLTRLWDPQVWMDAGTQIFFSFAICLGCLTALGSYNKYHNNCYRDCIALCFLNSGTSFVAGFAIFSILGFMSQEQGVPISEVAESGPGLAFIAYPRAVVMLPFSPLWACCFFFMVVLLGLDSQFVCVESLVTALVDMYPHVFRKKNRREVLILGVSVVSFLVGLIMLTEGGMYVFQLFDYYAASGMCLLFVAIFESLCVAWVYGAKRFYDNIEDMIGYRPWPLIKYCWLFLTPAVCTATFLFSLIKYTPLTYNKKYTYPWWGDALGWLLALSSMVCIPAWSLYRLGTLKGPFRERIRQLMCPAEDLPQRNPAGPSAPATPRTSLLRLTELESHC

SEQ ID NO: 82034 - protein, 97 aa, Homo sapiens
  Payload ID: 16328
  Gene Symbol: SLC6A13
  Gene Name: solute carrier family 6 (neurotransmitter transporter), member 13
  Uniprot ID: Q9NSD5
  ENSP ID: ENSP00000389316
MDSRVSGTTSNGETKPVYPVMEKKEEDGTLERGHWNNKMEFVLSVAGEIIGLGNVWRFPYLCYKNGGGEMRALVPPHPLLEGGYFHLLHLRPLWGVP

SEQ ID NO: 82035 - protein, 510 aa, Homo sapiens
  Payload ID: 16328
  Gene Symbol: SLC6A13
  Gene Name: solute carrier family 6 (neurotransmitter transporter), member 13
  Uniprot ID: Q9NSD5
  ENSP ID: ENSP00000407104
MDSRVSGTTSNGETKPVYPVMEKKEEDGTLERGHWNNKMEFVLSVAGEIIGLGNVWRFPYLCYKNGGEHCMEFQKTNGSLNGTSENATSPVIEFWERRVLKISDGIQHLGALRWELALCLLLAWVICYFCIWKGVKSTGKVVYFTATFPYLMLVVLLIRGVTLPGAAQGIQFYLYPNLTRLWDPQVWMDAGTQIFFSFAICLGCLTALGSYNKYHNNCYRDCIALCFLNSGTSFVAGFAIFSILGFMSQEQGVPISEVAESGPGLAFIAYPRAVVMLPFSPLWACCFFFMVVLLGLDSQFVCVESLVTALVDMYPHVFRKKNRREVLILGVSVVSFLVGLIMLTEGGMYVFQLFDYYAASGMCLLFVAIFESLCVAWVYGAKRFYDNIEDMIGYRPWPLIKYCWLFLTPAVCTATFLFSLIKYTPLTYNKKYTYPWWGDALGWLLALSSMVCIPAWSLYRLGTLKGPFRERIRQLMCPAEDLPQRNPAGPSAPATPRTSLLRLTELESHC

SEQ ID NO: 82036 - protein, 123 aa, Homo sapiens
  Payload ID: 16328
  Gene Symbol: SLC6A13
  Gene Name: solute carrier family 6 (neurotransmitter transporter), member 13
  ENSP ID: ENSP00000437386
MDSRVSGTTSNGETKPVYPVMEKKEEDGTLERGHWNNKMEFVLSVAGEIIGLGNVWRFPYLCYKNGGGAFFIPYLVFLFTCGIPVFLLETALGQYTSQGGVTAWRKICPIFEVSPQALAMPPR

SEQ ID NO: 82037 - protein, 69 aa, Homo sapiens
  Payload ID: 16328
  Gene Symbol: SLC6A13
  Gene Name: solute carrier family 6 (neurotransmitter transporter), member 13
  ENSP ID: ENSP00000443466
MIVILLNVYYIIVLAWALFYLFSSFTIDLPWGGCYHEWNTGGDFAQDAYIEMLACLEAADLKSTFPVAI

SEQ ID NO: 82038 - protein, 150 aa, Homo sapiens
  Payload ID: 16328
  Gene Symbol: SLC6A13
  Gene Name: solute carrier family 6 (neurotransmitter transporter), member 13
  ENSP ID: ENSP00000444606
MDSRVSGTTSNGETKPVYPVMEKKEEDGTLERGHWNNKMEFVLSVAGEIIGLGNVWRFPYLCYKNGGEHCMEFQKTNGSLNGTSENATSPVIEFWERRVLKISDGIQHLGALRWELALCLLLAWVICYFCIWKGVKSTGKVVYFTATFPY

SEQ ID NO: 82039 - protein, 628 aa, Homo sapiens
  Payload ID: 16329
  Gene Symbol: SLC6A2
  Gene Name: solute carrier family 6 (neurotransmitter transporter), member 2
  Uniprot ID: P23975
  ENSP ID: ENSP00000219833
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQMKTRQGRRRATNSCQISC

SEQ ID NO: 82040 - protein, 617 aa, Homo sapiens [sequence omitted]

SEQ ID NO: 82041 - protein, 561 aa, Homo sapiens
  Payload ID: 16329
  Gene Symbol: SLC6A2
  Gene Name: solute carrier family 6 (neurotransmitter transporter), member 2
  ENSP ID: ENSP00000394956
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLRLAYGITPENEHHLVAQRDIRQFQLQHWLAI

SEQ ID NO: 82042 - protein, 604 aa, Homo sapiens
  Payload ID: 16329
  Gene Symbol: SLC6A2
  Gene Name: solute carrier family 6 (neurotransmitter transporter), member 2
  ENSP ID: ENSP00000454439
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWEMKTRQGRRRATNSCQISC

SEQ ID NO: 82043 - protein, 200 aa, Homo sapiens
  Payload ID: 16329
  Gene Symbol: SLC6A2
  Gene Name: solute carrier family 6 (neurotransmitter transporter), member 2
  ENSP ID: ENSP00000454603
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHT

SEQ ID NO: 82044 - protein, 572 aa, Homo sapiens
  Payload ID: 16329
  Gene Symbol: SLC6A2
  Gene Name: solute carrier family 6 (neurotransmitter transporter), member 2
  ENSP ID: ENSP00000456210
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 82045 - protein, 295 aa, Homo sapiens
  Payload ID: 16329
  Gene Symbol: SLC6A2
  Gene Name: solute carrier family 6 (neurotransmitter transporter), member 2
  ENSP ID: ENSP00000456377
MLLARMNPQVQPENNGADTGPEQPLRARKTAELLVVKERNGVQCLLAPRDGDAQPRETWGKKIDFLLSVVGFAVDLANVWRFPYLCYKNGGGAFLIPYTLFLIIAGMPLFYMELALGQYNREGAATVWKICPFFKGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVWIDAATQIFFSLGAGFGVLIAFASYNKFDNNCY

SEQ ID NO: 82046 - protein, 512 aa, Homo sapiens
  Payload ID: 16329
  Gene Symbol: SLC6A2
  Gene Name: solute carrier family 6 (neurotransmitter transporter), member 2
  Uniprot ID: P23975
  ENSP ID: ENSP00000457375
MGVQWWSHTQGEVAVGLGLGDSYLTPCPCPGVGYAVILIALYVGFYYNVIIAWSLYYLFSSFTLNLPWTDCGHTWNSPNCTDPKLLNGSVLGNHTKYSKYKFTPAAEFYERGVLHLHESSGIHDIGLPQWQLLLCLMVVVIVLYFSLWKGVKTSGKVVWITATLPYFVLFVLLVHGVTLPGASNGINAYLHIDFYRLKEATVWIDAATQIFFSLGAGFGVLIAFASYNKFDNNCYRDALLTSSINCITSFVSGFAIFSILGYMAHEHKVNIEDVATEGAGLVFILYPEAISTLSGSTFWAVVFFVMLLALGLDSSMGGMEAVITGLADDFQVLKRHRKLFTFGVTFSTFLLALFCITKGGIYVLTLLDTFAAGTSILFAVLMEAIGVSWFYGVDRFSNDIQQMMGFRPGLYWRLCWKFVSPAFLLFVVVVSIINFKPLTYDDYIFPPWANWVGWGIALSSMVLVPIYVIYKFLSTQGSLWERLAYGITPENEHHLVAQRDIRQFQLQHWLAI

SEQ ID NO: 82047 - protein, 617 aa, Homo sapiens [sequence omitted]

SEQ ID NO: 82048 - protein, 58 aa, Homo sapiens
  Payload ID: 16329
  Gene Symbol: SLC6A2
  Gene Name: solute carrier family 6 (neurotransmitter transporter), member 2
  ENSP ID: ENSP00000460214
  MOD_RES (1)..(1): Any amino acid
XVPQHAGLSLGETGLWHHARERAPPGGSEGHQTVPDENETREKESYQLLPDILLNRNP

SEQ ID NO: 82049 - protein, 620 aa, Homo sapiens
  Payload ID: 16330
  Gene Symbol: SLC6A3
  Gene Name: solute carrier family 6 (neurotransmitter transporter), member 3
  Uniprot ID: Q01959
  ENSP ID: ENSP00000270349
MSKSKCSVGLMSSVVAPAKEPNAVGPKEVELILVKEQNGVQLTSSTLTNPRQSPVEAQDRETWGKKIDFLLSVIGFAVDLANVWRFPYLCYKNGGGAFLVPYLLFMVIAGMPLFYMELALGQFNREGAAGVWKICPILKGVGFTVILISLYVGFFYNVIIAWALHYLFSSFTTELPWIHCNNSWNSPNCSDAHPGDSSGDSSGLNDTFGTTPAAEYFERGVLHLHQSHGIDDLGPPRWQLTACLVLVIVLLYFSLWKGVKTSGKVVWITATMPYVVLTALLLRGVTLPGAIDGIRAYLSVDFYRLCEASVWIDAATQVCFSLGVGFGVLIAFSSYNKFTNNCYRDAIVTTSINSLTSFSSGFVVFSFLGYMAQKHSVPIGDVAKDGPGLIFIIYPEAIATLPLSSAWAVVFFIMLLTLGIDSAMGGMESVITGLIDEFQLLHRHRELFTLFIVLATFLLSLFCVTNGGIYVFTLLDHFAAGTSILFGVLIEAIGVAWFYGVGQFSDDIQQMTGQRPSLYWRLCWKLVSPCFLLFVVVVSIVTFRPPHYGAYIFPDWANALGWVIATSSMAMVPIYAAYKFCSLPGSFREKLAYAIAPEKDRELVDRGEVRQFTLRHWLKV

SEQ ID NO: 82050 - protein, 620 aa, Homo sapiens; identical to SEQ ID NO: 82049
  Payload ID: 16330
  Gene Symbol: SLC6A3
  Gene Name: solute carrier family 6 (neurotransmitter transporter), member 3
  Uniprot ID: Q01959
  ENSP ID: ENSP00000479597

SEQ ID NO: 82051 - protein, 630 aa, Homo sapiens
  Payload ID: 16331
  Gene Symbol: SLC6A4
  Gene Name: solute carrier family 6 (neurotransmitter transporter), member 4
  Uniprot ID: P31645
  ENSP ID: ENSP00000261707
METTPLNSQKQLSACEDGEDCQENGVLQKVVPTPGDKVESGQISNGYSAVPSPGAGDDTRHSIPATTTTLVAELHQGERETWGKKVDFLLSVIGYAVDLGNVWRFPYICYQNGGGAFLLPYTIMAIFGGIPLFYMELALGQYHRNGCISIWRKICPIFKGIGYAICIIAFYIASYYNTIMAWALYYLISSFTDQLPWTSCKNSWNTGNCTNYFSEDNITWTLHSTSPAEEFYTRHVLQIHRSKGLQDLGGISWQLALCIMLIFTVIYFSIWKGVKTSGKVVWVTATFPYIILSVLLVRGATLPGAWRGVLFYLKPNWQKLLETGVWIDAAAQIFFSLGPGFGVLLAFASYNKFNNNCYQDALVTSVVNCMTSFVSGFVIFTVLGYMAEMRNEDVSEVAKDAGPSLLFITYAEAIANMPASTFFAIIFFLMLITLGLDSTFAGLEGVITAVLDEFPHVWAKRRERFVLAVVITCFFGSLVTLTFGGAYVVKLLEEYATGPAVLTVALIEAVAVSWFYGITQFCRDVKEMLGFSPGWFWRICWVAISPLFLLFIICSFLMSPPQLRLFQYNYPYWSIILGYCIGTSSFICIPTYIAYRLIITPGTFKERIIKSITPETPTEIPCGDIRLNAV

SEQ ID NO: 82052 - protein, 618 aa, Homo sapiens
  Payload ID: 16331
  Gene Symbol: SLC6A4
  Gene Name: solute carrier family 6 (neurotransmitter transporter), member 4
  ENSP ID: ENSP00000378298
METTPLNSQKQLSACEDGEDCQENGVLQKVVPTPGDKVESGQISNGYSAVPSPGAGDDTRHSIPATTTTLVAELHQGERETWGKKVDFLLSVIGYAVDLGNVWRFPYICYQNGGGAFLLPYTIMAIFGGIPLFYMELALGQYHRNGCISIWRKICPIFKGIGYAICIIAFYIASYYNTIMAWALYYLISSFTDQLPWTSCKNSWNTGNCTNYFSEDNITWTLHSTSPAEEFYTRHVLQIHRSKGLQDLGGISWQLALCIMLIFTVIYFSIWKGVKTSGKVVWVTATFPYIILSVLLVRGATLPGAWRGVLFYLKPNWQKLLETGVWIDAAAQIFFSLGPGFGVLLAFASYNKFNNNCYQDALVTSVVNCMTSFVSGFVIFTVLGYMAEMRNEDVSEVAKDAGPSLLFITYAEAIANMPASTFFAIIFFLMLITLGLDSTFAGLEGVITAVLDEFPHVWAKRRERFVLAVVITCFFGSLVTLTFGGAYVVKLLEEYATGPAVLTVALIEAVAVSWFYGITQFCRDVKEMLGFSPGWFWRICWVAISPLFLLFIICSFLMSPPQLRLFQYNYPYWSIILGYCIGTSSFICIPTYIAYRLIITPGTFKERIIKSITPETPT

SEQ ID NO: 82053 - protein, 630 aa, Homo sapiens; identical to SEQ ID NO: 82051
  Payload ID: 16331
  Gene Symbol: SLC6A4
  Gene Name: solute carrier family 6 (neurotransmitter transporter), member 4
  Uniprot ID: P31645
  ENSP ID: ENSP00000385822

SEQ ID NO: 82054 - protein, 72 aa, Homo sapiens
  Payload ID: 16331
  Gene Symbol: SLC6A4
  Gene Name: solute carrier family 6 (neurotransmitter transporter), member 4
  ENSP ID: ENSP00000463172
  MOD_RES (1)..(1): Any amino acid
XTFFAIIFFLMLITLGLDSTFAGLEGVITAVLDEFPHVWAKRRERFVLAVVITCFFGSLVTLTFASLSSAGT

SEQ ID NO: 82055 - protein, 187 aa, Homo sapiens
  Payload ID: 16332
  Gene Symbol: SLC6A5
  Gene Name: solute carrier family 6 (neurotransmitter transporter), member 5
  ENSP ID: ENSP00000298923
MDCSAPKEMNKLPANSPEAAAAQGHPDGPCAPRTSPEQELPAAAAPPPPRVPRSASTGAQTFQSADARACEAERPGVGSCKLSSPRAQAASAALRDLREAQGAQASPPPGSSGPGNALHCKIPFLRGPEGDANVSVGKGTLERNNTPVVGWVNMSQSTVVLATDGITSVLPGSVATVATQVLSSSLT

SEQ ID NO: 82056 - protein, 797 aa, Homo sapiens
  Payload ID: 16332
  Gene Symbol: SLC6A5
  Gene Name: solute carrier family 6 (neurotransmitter transporter), member 5
  Uniprot ID: Q9Y345
  ENSP ID: ENSP00000434364
MDCSAPKEMNKLPANSPEAAAAQGHPDGPCAPRTSPEQELPAAAAPPPPRVPRSASTGAQTFQSADARACEAERPGVGSCKLSSPRAQAASAALRDLREAQGAQASPPPGSSGPGNALHCKIPFLRGPEGDANVSVGKGTLERNNTPVVGWVNMSQSTVVLATDGITSVLPGSVATVATQEDEQGDENKARGNWSSKLDFILSMVGYAVGLGNVWRFPYLAFQNGGGAFLIPYLMMLALAGLPIFFLEVSLGQFASQGPVSVWKAIPALQGCGIAMLIISVLIAIYYNVIICYTLFYLFASFVSVLPWGSCNNPWNTPECKDKTKLLLDSCVISDHPKIQIKNSTFCMTAYPNVTMVNFTSQANKTFVSGSEEYFKYFVLKISAGIEYPGEIRWPLALCLFLAWVIVYASLAKGIKTSGKVVYFTATFPYVVLVILLIRGVTLPGAGAGIWYFITPKWEKLTDATVWKDAATQIFFSLSAAWGGLITLSSYNKFHNNCYRDTLIVTCTNSATSIFAGFVIFSVIGFMANERKVNIENVADQGPGIAFVVYPEALTRLPLSPFWAIIFFLMLLTLGLDTMFATIETIVTSISDEFPKYLRTHKPVFTLGCCICFFIMGFPMITQGGIYMFQLVDTYAASYALVIIAIFELVGISYVYGLQRFCEDIEMMIGFQPNIFWKVCWAFVTPTILTFILCFSFYQWEPMTYGSYRYPNWSMVLGWLMLACSVIWIPIMFVIKMHLAPGRFIERLKLVCSPQPDWGPFLAQHRGERYKNMIDPLGTSSLGLKLPVKDLELGTQC

SEQ ID NO: 82057 - protein, 95 aa, Homo sapiens
  Payload ID: 16333
  Gene Symbol: SLC6A6
  Gene Name: solute carrier family 6 (neurotransmitter transporter), member 6
  ENSP ID: ENSP00000399522
  MOD_RES (1)..(1): Any amino acid
XTMMPLPTFWSILFFIMLLLLGLDSQGCFIFSLVKYVPLTYNKTYVYPNWAIGLGWSLALSSMLCVPLVIVIRLCQTEGPFLVRVKYLLTPREPN

SEQ ID NO: 82058 - protein, 109 aa, Homo sapiens
  Payload ID: 16333
  Gene Symbol: SLC6A6
  Gene Name: solute carrier family 6 (neurotransmitter transporter), member 6
  ENSP ID: ENSP00000402059
MATKEKLQCLKDFHKDILKPSPGKSPGTRPEDEAEGKPPQREKWSSKIDFVLSVAGGFVGLGNVWRFPYLCYKNGGGAFLIPYFIFLFGSGLPVFFLEIIIGQYTSEGG

SEQ ID NO: 82059 - protein, 620 aa, Homo sapiens
  Payload ID: 16333
  Gene Symbol: SLC6A6
  Gene Name: solute carrier family 6 (neurotransmitter transporter), member 6
  Uniprot ID: P31641
  ENSP ID: ENSP00000480890
MATKEKLQCLKDFHKDILKPSPGKSPGTRPEDEAEGKPPQREKWSSKIDFVLSVAGGFVGLGNVWRFPYLCYKNGGGAFLIPYFIFLFGSGLPVFFLEIIIGQYTSEGGITCWEKICPLFSGIGYASVVIVSLLNVYYIVILAWATYYLFQSFQKELPWAHCNHSWNTPHCMEDTMRKNKSVWITISSTNFTSPVIEFWERNVLSLSPGIDHPGSLKWDLALCLLLVWLVCFFCIWKGVRSTGKVVYFTATFPFAMLLVLLVRGLTLPGAGAGIKFYLYPDITRLEDPQVWIDAGTQIFFSYAICLGAMTSLGSYNKYKYNSYRDCMLLGCLNSGTSFVSGFAIFSILGFMAQEQGVDIADVAESGPGLAFIAYPKAVTMMPLPTFWSILFFIMLLLLGLDSQFVEVEGQITSLVDLYPSFLRKGYRREIFIAFVCSISYLLGLTMVTEGGMYVFQLFDYYAASGVCLLWVAFFECFVIAWIYGGDNLYDGIEDMIGYRPGPWMKYSWAVITPVLCVGCFIFSLVKYVPLTYNKTYVYPNWAIGLGWSLALSSMLCVPLVIVIRLCQTEGPFLVRVKYLLTPREPNRWAVEREGATPYNSRTVMNGALVKPTHIIVETMM

SEQ ID NO: 82060 - protein, 721 aa, Homo sapiens
  Payload ID: 16333
  Gene Symbol: SLC6A6
  Gene Name: solute carrier family 6 (neurotransmitter transporter), member 6
  ENSP ID: ENSP00000481625
MGDAESCLLRQQTREVRKKPLINYRFLRAAANAEPRGPQAQRTSCAKRECGAFTQRVRERAGRQPPAGGTRHSRAERGRRRSHPRSRTRTTALLRSSQTKEMATKEKLQCLKDFHKDILKPSPGKSPGTRPEDEAEGKPPQREKWSSKIDFVLSVAGGFVGLGNVWRFPYLCYKNGGGAFLIPYFIFLFGSGLPVFFLEIIIGQYTSEGGITCWEKICPLFSGIGYASVVIVSLLNVYYIVILAWATYYLFQSFQKELPWAHCNHSWNTPHCMEDTMRKNKSVWITISSTNFTSPVIEFWERNVLSLSPGIDHPGSLKWDLALCLLLVWLVCFFCIWKGVRSTGKVVYFTATFPFAMLLVLLVRGLTLPGAGAGIKFYLYPDITRLEDPQVWIDAGTQIFFSYAICLGAMTSLGSYNKYKYNSYRDCMLLGCLNSGTSFVSGFAIFSILGFMAQEQGVDIADVAESGPGLAFIAYPKAVTMMPLPTFWSILFFIMLLLLGLDSQFVEVEGQITSLVDLYPSFLRKGYRREIFIAFVCSISYLLGLTMVTEGGMYVFQLFDYYAASGVCLLWVAFFECFVIAWIYGGDNLYDGIEDMIGYRPGPWMKYSWAVITPVLCVGCFIFSLVKYVPLTYNKTYVYPNWAIGLGWSLALSSMLCVPLVIVIRLCQTEGPFLVRVKYLLTPREPNRWAVEREGATPYNSRTVMNGALVKPTHIIVETMM

SEQ ID NO: 82061 - protein, 460 aa, Homo sapiens
  Payload ID: 16333
  Gene Symbol: SLC6A6
  Gene Name: solute carrier family 6 (neurotransmitter transporter), member 6
  ENSP ID: ENSP00000481946
MGDAESCLLRQQTREVRKKPLINYRFLRAAANAEPRGPQAQRTSCAKRECGAFTQRVRERAGRQPPAGGTRHSRAERGRRRSHPRSRTRTTALLRSSQTKEMATKEKLQCLKDFHKDILKPSPGKSPGTRPEDEAEGKPPQREKWSSKIDFVLSVAGGFVGLGNVWRFPYLCYKNGGGAFLIPYFIFLFGSGLPVFFLEIIIGQYTSEGGITCWEKICPLFSGIGYASVVIVSLLNVYYIVILAWATYYLFQSFQKELPWAHCNHSWNTPHCMEDTMRKNKSVWITISSTNFTSPVIEFWERNVLSLSPGIDHPGSLKWDLALCLLLVWLVCFFCIWKGVRSTGKVVYFTATFPFAMLLVLLVRGLTLPGAGAGIKFYLYPDITRLEDPQVWIDAGTQIFFSYAICLGAMTSLGSYNKYKYNSYRSWPGLHCLPKSCDNDAAAHILVHSFFYYASLAWTG

SEQ ID NO: 82062 - protein, 122 aa, Homo sapiens
  Payload ID: 16333
  Gene Symbol: SLC6A6
  Gene Name: solute carrier family 6 (neurotransmitter transporter), member 6
  ENSP ID: ENSP00000482220
  MOD_RES (1)..(1): Any amino acid
XQTREVRKKPLINYRFLRAAANAEPRGPQAQRTSCAKRECGAFTQRVRERAGRQPPAGGTRHSRAERGRRRSHPRSRTRTTALLRSSQTKQGDGHQGEAAVSERFPQGHPEALTREEPRHAA

SEQ ID NO: 82063 - protein, 132 aa, Homo sapiens
  Payload ID: 16333
  Gene Symbol: SLC6A6
  Gene Name: solute carrier family 6 (neurotransmitter transporter), member 6
  ENSP ID: ENSP00000482391
MGDAESCLLRQQTREVRKKPLINYRFLRAAANAEPRGPQAQRTSCAKRECGAFTQRVRERAGRQPPAGGTRHSRAERGRRRSHPRSRTRTTALLRSSQTKQGDGHQGEAAVSERFPQGHPEALTREEPRHAA

SEQ ID NO: 82064 - protein, 200 aa, Homo sapiens
  Payload ID: 16333
  Gene Symbol: SLC6A6
  Gene Name: solute carrier family 6 (neurotransmitter transporter), member 6
  Uniprot ID: P31641
  ENSP ID: ENSP00000482560
MATKEKLQCLKDFHKDILKPSPGKSPGTRPEDEAEGKPPQREKWSSKIDFVLSVAGGFVGLGNVWRFPYLCYKNGGGAFLIPYFIFLFGSGLPVFFLEIIIGQYTSEGGITCWEKICPLFSGIGYASVVIVSLLNVYYIVILAWATYYLFQSFQKELPWAHCNHSWNTPHCMEDTMRKNKSVWITISSTNFTSPVIEFWE

SEQ ID NO: 82065 - protein, 636 aa, Homo sapiens
  Payload ID: 16334
  Gene Symbol: SLC6A7
  Gene Name: solute carrier family 6 (neurotransmitter transporter), member 7
  Uniprot ID: Q99884
  ENSP ID: ENSP00000230671
MKKLQGAHLRKPVTPDLLMTPSDQGDVDLDVDFAAHRGNWTGKLDFLLSCIGYCVGLGNVWRFPYRAYTNGGGAFLVPYFLMLAICGIPLFFLELSLGQFSSLGPLAVWKISPLFKGAGAAMLLIVGLVAIYYNMIIAYVLFYLFASLTSDLPWEHCGNWWNTELCLEHRVSKDGNGALPLNLTCTVSPSEEYWSRYVLHIQGSQGIGSPGEIRWNLCLCLLLAWVIVFLCILKGVKSSGKVVYFTATFPYLILLMLLVRGVTLPGAWKGIQFYLTPQFHHLLSSKVWIEAALQIFYSLGVGFGGLLTFASYNTFHQNIYRDTFIVTLGNAITSILAGFAIFSVLGYMSQELGVPVDQVAKAGPGLAFVVYPQAMTMLPLSPFWSFLFFFMLLTLGLDSQFAFLETIVTAVTDEFPYYLRPKKAVFSGLICVAMYLMGLILTTDGGMYWLVLLDDYSASFGLMVVVITTCLAVTRVYGIQRFCRDIHMMLGFKPGLYFRACWLFLSPATLLALMVYSIVKYQPSEYGSYRFPPWAELLGILMGLLSCLMIPAGMLVAVLREEGSLWERLQQASRPAMDWGPSLEENRTGMYVATLAGSQSPKPLMVHMRKYGGITSFENTAIEVDREIAEEEESMM

SEQ ID NO: 82066 - protein, 666 aa, Homo sapiens
  Payload ID: 16334
  Gene Symbol: SLC6A7
  Gene Name: solute carrier family 6 (neurotransmitter transporter), member 7
  ENSP ID: ENSP00000428200
MKKLQGAHLRKPVTPDLLMTPSDQGDVDLDVDFAAHRGNWTGKLDFLLSCIGYCVGLGNVWRFPYRAYTNGGGAFLVPYFLMLAICGIPLFFLELSLGQFSSLGPLAVWKISPLFKGAGAAMLLIVGLVAIYYNMIIAYVLFYLFASLTSDLPWEHCGNWWNTELCLEHRVSKDGNGALPLNLTCTVSPSEEYWSRYVLHIQGSQGIGSPGEIRWNLCLCLLLAWVIVFLCILKGVKSSGKVVYFTATFPYLILLMLLVRGVTLPGAWKGIQFYLTPQFHHLLSSKVWIEAALQIFYSLGVGFGGLLTFASYNTFHQNIYRDTFIVTLGNAITSILAGFAIFSVLGYMSQELGVPVDQVAKAGPGLAFVVYPQAMTMLPLSPFWSFLFFFMLLTLGLDSQFAFLETIVTAVTDEFPYYLRPKKAVFSGLICVAMYLMGLILTTDGGMYWLVLLDDYSASFGLMVVVITTCLAVTRVYGIQRFCRDIHMMLGFKPGLYFRACWLFLSPATLLALMVYSIVKYQPSEYGSYRFPPWAELLGILMGLLSCLMIPAGMLVAVLREEGSLWERLQQASRPAMDWGPSLEENRTGMYVATLAGSQSPKPLMVHMRKGTSARGLLYARMTVSATYIRSTDKMLSCLQGAHSSAETCLGDFKPEICGEEVTVVG

SEQ ID NO: 82067 - protein, 635 aa, Homo sapiens
  Payload ID: 16335
  Gene Symbol: SLC6A8
  Gene Name: solute carrier family 6 (neurotransmitter transporter), member 8
  Uniprot ID: P48029
  ENSP ID: ENSP00000253122
MAKKSAENGIYSVSGDEKKGPLIAPGPDGAPAKGDGPVGLGTPGGRLAVPPRETWTRQMDFIMSCVGFAVGLGNVWRFPYLCYKNGGGVFLIPYVLIALVGGIPIFFLEISLGQFMKAGSINVWNICPLFKGLGYASMVIVFYCNTYYIMVLAWGFYYLVKSFTTTLPWATCGHTWNTPDCVEIFRHEDCANASLANLTCDQLADRRSPVIEFWENKVLRLSGGLEVPGALNWEVTLCLLACWVLVYFCVWKGVKSTGKIVYFTATFPYVVLVVLLVRGVLLPGALDGIIYYLKPDWSKLGSPQVWIDAGTQIFFSYAIGLGALTALGSYNRFNNNCYKDAIILALINSGTSFFAGFVVFSILGFMAAEQGVHISKVAESGPGLAFIAYPRAVTLMPVAPLWAALFFFMLLLLGLDSQFVGVEGFITGLLDLLPASYYFRFQREISVALCCALCFVIDLSMVTDGGMYVFQLFDYYSASGTTLLWQAFWECVVVAWVYGADRFMDDIACMIGYRPCPWMKWCWSFFTPLVCMGIFIFNVVYYEPLVYNNTYVYPWWGEAMGWAFALSSMLCVPLHLLGCLLRAKGTMAERWQHLTQPIWGLHHLEYRAQDADVRGLTTLTPVSESSKVVVVESVM

SEQ ID NO: 82068 - protein, 88 aa, Homo sapiens
  Payload ID: 16335
  Gene Symbol: SLC6A8
  Gene Name: solute carrier family 6 (neurotransmitter transporter), member 8
  ENSP ID: ENSP00000394742
GRHHPGSHQQWDQLLCWLRGLLHPGLHGCRAGRAHLQGGRVRAGPGLHRLPAGCHADASGPTLGCPVLLHAVAAWSRQPGVEGFITGL

SEQ ID NO: 82069 - protein, 156 aa, Homo sapiens
  Payload ID: 16335
  Gene Symbol: SLC6A8
  Gene Name: solute carrier family 6 (neurotransmitter transporter), member 8
  ENSP ID: ENSP00000400463
LLHSPTWSWSCCWCVECCCLAPWMASFTISSLTGQSWGPLSPGQLQPLQQQLLQWDQLLCWLRGLLHPGLHGCRAGRAHLQGGRVREISVALCCALCFVIDLSMVTDGGMYVFQLFDYYSASGTTLLWQAFWECVVVAWVYGADRFMDDIACMIGY

SEQ ID NO: 82070 - protein, 520 aa, Homo sapiens
  Payload ID: 16335
  Gene Symbol: SLC6A8
  Gene Name: solute carrier family 6 (neurotransmitter transporter), member 8
  Uniprot ID: P48029
  ENSP ID: ENSP00000403041
MKAGSINVWNICPLFKGLGYASMVIVFYCNTYYIMVLAWGFYYLVKSFTTTLPWATCGHTWNTPDCVEIFRHEDCANASLANLTCDQLADRRSPVIEFWENKVLRLSGGLEVPGALNWEVTLCLLACWVLVYFCVWKGVKSTGKIVYFTATFPYVVLVVLLVRGVLLPGALDGIIYYLKPDWSKLGSPQVWIDAGTQIFFSYAIGLGALTALGSYNRFNNNCYKDAIILALINSGTSFFAGFVVFSILGFMAAEQGVHISKVAESGPGLAFIAYPRAVTLMPVAPLWAALFFFMLLLLGLDSQFVGVEGFITGLLDLLPASYYFRFQREISVALCCALCFVIDLSMVTDGGMYVFQLFDYYSASGTTLLWQAFWECVVVAWVYGADRFMDDIACMIGYRPCPWMKWCWSFFTPLVCMGIFIFNVVYYEPLVYNNTYVYPWWGEAMGWAFALSSMLCVPLHLLGCLLRAKGTMAERWQHLTQPIWGLHHLEYRAQDADVRGLTTLTPVSESSKVVVVESVM

SEQ ID NO: 82071 - protein, 174 aa, Homo sapiens
  Payload ID: 16335
  Gene Symbol: SLC6A8
  Gene Name: solute carrier family 6 (neurotransmitter transporter), member 8
  ENSP ID: ENSP00000403682
  MOD_RES (1)..(1): Any amino acid
XIDAGTQIFFSYAIGLGALTALGSYNRFNNNCYNGTSFFAGFVVFSILGFMAAEQGVHISKVAESGPGLAFIAYPRAVTLMPVAPLWAALFFFMLLLLGLDSQFVGVEGFITGLLDLLPASYYFRFQREISVALCCALCFVIDLSMVTDGGMYVFQLFDYYSASGTTLLWQAFW

SEQ ID NO: 82072 - protein, 112 aa, Homo sapiens
  Payload ID: 16335
  Gene Symbol: SLC6A8
  Gene Name: solute carrier family 6 (neurotransmitter transporter), member 8
  ENSP ID: ENSP00000404046
  MOD_RES (1)..(1): Any amino acid
XFRHEDCANASLANLTCDQLADRRSPVIEFWENKVLRLSGGLEVPGALNWEVTLCLLACWVLVYFCVWKGVKSTGKVPLEACSGEGGSALGAGCLCQAHLWQREVTRQSLAL

SEQ ID NO: 82073 - protein, 652 aa, Homo sapiens
  Payload ID: 16336
  Gene Symbol: SLC6A9
  Gene Name: solute carrier family 6 (neurotransmitter transporter, glycine), member 9
  Uniprot ID: P48067
  ENSP ID: ENSP00000350362
MSGGDTRAAIARPRMAAAHGPVAPSSPEQNGAVPSEATKRDQNLKRGNWGNQIEFVLTSVGYAVGLGNVWRFPYLCYRNGGGAFMFPYFIMLIFCGIPLFFMELSFGQFASQGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLGCAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGHRNYFQDIQMMLGFPPPLFFQICWRFVSPAIIFFILVFTVIQYQPITYNHYQYPGWAVAIGFLMALSSVLCIPLYAMFRLCRTDGDTLLQRLKNATKPSRDWGPALLEHRTGRYAPTIAPSPEDGFEVQPLHPDKAQIPIVGSNGSSRLQDSRI

SEQ ID NO: 82074 - protein, 706 aa, Homo sapiens
  Payload ID: 16336
  Gene Symbol: SLC6A9
  Gene Name: solute carrier family 6 (neurotransmitter transporter, glycine), member 9
  Uniprot ID: P48067
  ENSP ID: ENSP00000353791
MSGGDTRAAIARPRMAAAHGPVAPSSPEQVTLLPVQRSFFLPPFSGATPSTSLAESVLKVWHGAYNSGLLPQLMAQHSLAMAQNGAVPSEATKRDQNLKRGNWGNQIEFVLTSVGYAVGLGNVWRFPYLCYRNGGGAFMFPYFIMLIFCGIPLFFMELSFGQFASQGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLGCAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGHRNYFQDIQMMLGFPPPLFFQICWRFVSPAIIFFILVFTVIQYQPITYNHYQYPGWAVAIGFLMALSSVLCIPLYAMFRLCRTDGDTLLQRLKNATKPSRDWGPALLEHRTGRYAPTIAPSPEDGFEVQPLHPDKAQIPIVGSNGSSRLQDSRI

SEQ ID NO: 82075 - protein, 579 aa, Homo sapiens
  Payload ID: 16336
  Gene Symbol: SLC6A9
  Gene Name: solute carrier family 6 (neurotransmitter transporter, glycine), member 9
  ENSP ID: ENSP00000361380
MVGKGAKGMLNGAVPSEATKRDQNLKRGNWGNQIEFVLTSVGYAVGLGNVWRFPYLCYRNGGGAFMFPYFIMLIFCGIPLFFMELSFGQFASQGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLGCAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGEHSSLRPPATRPLARPLCPAGLLTPHLSRAPELLPGHPDDAGIPTTPLLSDLLALRLSRHHLPPGSGPPPPPPESSSLRVAPGAERAPPPAPTARGSAGA

SEQ ID NO: 82076 - protein, 574 aa, Homo sapiens
  Payload ID: 16336
  Gene Symbol: SLC6A9
  Gene Name: solute carrier family 6 (neurotransmitter transporter, glycine), member 9
  ENSP ID: ENSP00000361381
MFPYFIMLIFCGIPLFFMELSFGQFASQGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLGCAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGHRNYFQDIQMMLGFPPPLFFQICWRFVSPAIIFLQAQVHRRLPQNPLHFASLPERNVLLHQLPQRGGVPEHDPPTPPSPARTYGPQVRVREVPRARRQRSPNPAPLWAPPSPKPHPCSAAGPLGWDCPFRNCQSLALSSARLLADSDAGGPETRQWEPGP

SEQ ID NO: 82077 - protein, 633 aa, Homo sapiens
  Payload ID: 16336
  Gene Symbol: SLC6A9
  Gene Name: solute carrier family 6 (neurotransmitter transporter, glycine), member 9
  Uniprot ID: P48067
  ENSP ID: ENSP00000361384
MVGKGAKGMLNGAVPSEATKRDQNLKRGNWGNQIEFVLTSVGYAVGLGNVWRFPYLCYRNGGGAFMFPYFIMLIFCGIPLFFMELSFGQFASQGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLGCAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGHRNYFQDIQMMLGFPPPLFFQICWRFVSPAIIFFILVFTVIQYQPITYNHYQYPGWAVAIGFLMALSSVLCIPLYAMFRLCRTDGDTLLQRLKNATKPSRDWGPALLEHRTGRYAPTIAPSPEDGFEVQPLHPDKAQIPIVGSNGSSRLQDSRI

SEQ ID NO: 82078 - protein, 116 aa, Homo sapiens
  Payload ID: 16336
  Gene Symbol: SLC6A9
  Gene Name: solute carrier family 6 (neurotransmitter transporter, glycine), member 9
  ENSP ID: ENSP00000433241
MVGKGAKGMLVTLLPVQRSFFLPPFSGATPSTSLAESVLKVWHGAYNSGLLPQLMAQHSLAMAQNGAVPSEATKRDQNLKRGNWGNQIEFVLTSVGYAVGLGNVWRFPYLCYRNGG

SEQ ID NO: 82079 - protein, 522 aa, Homo sapiens
  Payload ID: 16336
  Gene Symbol: SLC6A9
  Gene Name: solute carrier family 6 (neurotransmitter transporter, glycine), member 9
  ENSP ID: ENSP00000434460
MMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLGCAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGHRNYFQDIQMMLGFPPPLFFQICWRFVSPAIIFFILVFTVIQYQPITYNHYQYPGWAVAIGFLMALSSVLCIPLYAMFRLCRTDGDTLLQRLKNATKPSRDWGPALLEHRTGRYAPTIAPSPEDGFEVQPLHPDKAQIPIVGSNGSSRLQDSRI

SEQ ID NO: 82080 - protein, 134 aa, Homo sapiens
  Payload ID: 16336
  Gene Symbol: SLC6A9
  Gene Name: solute carrier family 6 (neurotransmitter transporter, glycine), member 9
  ENSP ID: ENSP00000435652
MSGGDTRAAIARPRMAAAHGPVAPSSPEQNGAVPSEATKRDQNLKRGNWGNQIEFVLTSVGYAVGLGNVWRFPYLCYRNGGGAFMFPYFIMLIFCGIPLFFMELSFGQFASQGCLGVWRISPMFKGVGYGMMVV

SEQ ID NO: 82081 - protein, 730 aa, Homo sapiens
  Payload ID: 16337
  Gene Symbol: SLC6A15
  Gene Name: solute carrier family 6 (neutral amino acid transporter), member 15
  Uniprot ID: Q9H2J7
  ENSP ID: ENSP00000266682
MPKNSKVVKRELDDDVTESVKDLLSNEDAADDAFKTSELIVDGQEEKDTDVEEGSEVEDERPAWNSKLQYILAQVGFSVGLGNVWRFPYLCQKNGGGAYLLPYLILLMVIGIPLFFLELSVGQRIRRGSIGVWNYISPKLGGIGFASCVVCYFVALYYNVIIGWSLFYFSQSFQQPLPWDQCPLVKNASHTFVEPECEQSSATTYYWYREALNISSSISESGGLNWKMTICLLAAWVMVCLAMIKGIQSSGKIIYFSSLFPYVVLICFLIRAFLLNGSIDGIRHMFTPKLEIMLEPKVWREAATQVFFALGLGFGGVIAFSSYNKRDNNCHFDAVLVSFINFFTSVLATLVVFAVLGFKANVINEKCITQNSETIMKFLKMGNISQDIIPHHINLSTVTAEDYHLVYDIIQKVKEEEFPALHLNSCKIEEELNKAVQGTGLAFIAFTEAMTHFPASPFWSVMFFLMLVNLGLGSMFGTIEGIVTPIVDTFKVRKEILTVICCLLAFCIGLIFVQRSGNYFVTMFDDYSATLPLLIVVILENIAVCFVYGIDKFMEDLKDMLGFAPSRYYYYMWKYISPLMLLSLLIASVVNMGLSPPGYNAWIEDKASEEFLSYPTWGLVVCVSLVVFAILPVPVVFIVRRFNLIDDSSGNLASVTYKRGRVLKEPVNLEGDDTSLIHGKIPSEMPSPNFGKNIYRKQSGSPTLDTAPNGRYGIGYLMADIMPDMPESDL

SEQ ID NO: 82082 - protein, 316 aa, Homo sapiens
  Payload ID: 16337
  Gene Symbol: SLC6A15
  Gene Name: solute carrier family 6 (neutral amino acid transporter), member 15
  ENSP ID: ENSP00000311645
MLEPKVWREAATQVFFALGLGFGGVIAFSSYNKRDNNCHFDAVLVSFINFFTSVLATLVVFAVLGFKANVINEKCITQNSETIMKFLKMGNISQDIIPHHINLSTVTAEDYHLVYDIIQKVKEEEFPALHLNSCKIEEELNKAVQGTGLAFIAFTEAMTHFPASPFWSVMFFLMLVNLGLGSMFGTIEGIVTPIVDTFKVRKEILTVICCLLAFCIGLIFVQRSGNYFVTMFDDYSATLPLLIVVILENIAVCFVYGIDKFMEDLKDMLGFAPSRYYYYMWKYISPLMLLSLLIASVVNMGLSPPGYNAWIEDKHL

SEQ ID NO: 82083 - protein, 289 aa, Homo sapiens
  Payload ID: 16337
  Gene Symbol: SLC6A15
  Gene Name: solute carrier family 6 (neutral amino acid transporter), member 15
  Uniprot ID: Q9H2J7
  ENSP ID: ENSP00000390706
MPKNSKVVKRELDDDVTESVKDLLSNEDAADDAFKTSELIVDGQEEKDTDVEEGSEVEDERPAWNSKLQYILAQVGFSVGLGNVWRFPYLCQKNGGGAYLLPYLILLMVIGIPLFFLELSVGQRIRRGSIGVWNYISPKLGGIGFASCVVCYFVALYYNVIIGWSLFYFSQSFQQPLPWDQCPLVKNASHTFVEPECEQSSATTYYWYREALNISSSISESGGLNWKMTICLLAAWVMVCLAMIKGIQSSGKVSMLEPFLILLITISGFIPLSNSVTDFCGQITHNTSF

SEQ ID NO: 82084 - protein, 96 aa, Homo sapiens
  Payload ID: 16337
  Gene Symbol: SLC6A15
  Gene Name: solute carrier family 6 (neutral amino acid transporter), member 15
  ENSP ID: ENSP00000448308
MPKNSKVVKRELDDDVTESVKDLLSNEDAADDAFKTSELIVDGQEEKDTDVEEGSEVEDERPAWNSKLQYILAQVGFSVGLGNVWRFPYLCQKNGG

SEQ ID NO: 82085 - protein, 71 aa, Homo sapiens
  Payload ID: 16337
  Gene Symbol: SLC6A15
  Gene Name: solute carrier family 6 (neutral amino acid transporter), member 15
  ENSP ID: ENSP00000449263
MFTPKLEIMLEPKVWREAATQVFFALGLGFGGVIAFSSYNKRDNNCHFDAVLVSFINFFTSVLATLVVFAV

SEQ ID NO: 82086 - protein, 623 aa, Homo sapiens
  Payload ID: 16337
  Gene Symbol: SLC6A15
  Gene Name: solute carrier family 6 (neutral amino acid transporter), member 15
  Uniprot ID: Q9H2J7
  ENSP ID: ENSP00000450145
MVIGIPLFFLELSVGQRIRRGSIGVWNYISPKLGGIGFASCVVCYFVALYYNVIIGWSLFYFSQSFQQPLPWDQCPLVKNASHTFVEPECEQSSATTYYWYREALNISSSISESGGLNWKMTICLLAAWVMVCLAMIKGIQSSGKIIYFSSLFPYVVLICFLIRAFLLNGSIDGIRHMFTPKLEIMLEPKVWREAATQVFFALGLGFGGVIAFSSYNKRDNNCHFDAVLVSFINFFTSVLATLVVFAVLGFKANVINEKCITQNSETIMKFLKMGNISQDIIPHHINLSTVTAEDYHLVYDIIQKVKEEEFPALHLNSCKIEEELNKAVQGTGLAFIAFTEAMTHFPASPFWSVMFFLMLVNLGLGSMFGTIEGIVTPIVDTFKVRKEILTVICCLLAFCIGLIFVQRSGNYFVTMFDDYSATLPLLIVVILENIAVCFVYGIDKFMEDLKDMLGFAPSRYYYYMWKYISPLMLLSLLIASVVNMGLSPPGYNAWIEDKASEEFLSYPTWGLVVCVSLVVFAILPVPVVFIVRRFNLIDDSSGNLASVTYKRGRVLKEPVNLEGDDTSLIHGKIPSEMPSPNFGKNIYRKQSGSPTLDTAPNGRYGIGYLMADIMPDMPESDL

SEQ ID NO: 82087 - protein, 19 aa, Homo sapiens
  Payload ID: 16337
  Gene Symbol: SLC6A15
  Gene Name: solute carrier family 6 (neutral amino acid transporter), member 15
  ENSP ID: ENSP00000475035
MPKNSKVVKRELDDDVTES

SEQ ID NO: 82088 - protein, 727 aa, Homo sapiens
  Payload ID: 16338
  Gene Symbol: SLC6A17
  Gene Name: solute carrier family 6 (neutral amino acid transporter), member 17
  Uniprot ID: Q9H1V8
  ENSP ID: ENSP00000330199
MPKNSKVTQREHSSEHVTESVADLLALEEPVDYKQSVLNVAGEAGGKQKAVEEELDAEDRPAWNSKLQYILAQIGFSVGLGNIWRFPYLCQKNGGGAYLVPYLVLLIIIGIPLFFLELAVGQRIRRGSIGVWHYICPRLGGIGFSSCIVCLFVGLYYNVIIGWSIFYFFKSFQYPLPWSECPVVRNGSVAVVEAECEKSSATTYFWYREALDISDSISESGGLNWKMTLCLLVAWSIVGMAVVKGIQSSGKVMYFSSLFPYVVLACFLVRGLLLRGAVDGILHMFTPKLDKMLDPQVWREAATQVFFALGLGFGGVIAFSSYNKQDNNCHFDAALVSFINFFTSVLATLVVFAVLGFKANIMNEKCVVENAEKILGYLNTNVLSRDLIPPHVNFSHLTTKDYMEMYNVIMTVKEDQFSALGLDPCLLEDELDKSVQGTGLAFIAFTEAMTHFPASPFWSVMFFLMLINLGLGSMIGTMAGITTPIIDTFKVPKEMFTVGCCVFAFLVGLLFVQRSGNYFVTMFDDYSATLPLTLIVILENIAVAWIYGTKKFMQELTEMLGFRPYRFYFYMWKFVSPLCMAVLTTASIIQLGVTPPGYSAWIKEEAAERYLYFPNWAMALLITLIVVATLPIPVVFVLRHFHLLSDGSNTLSVSYKKGRMMKDISNLEENDETRFILSKVPSEAPSPMPTHRSYLGPGSTSPLETSGNPNGRYGSGYLLASTPESEL

SEQ ID NO: 82089 - protein, 628 aa, Homo sapiens
  Payload ID: 16339
  Gene Symbol: SLC6A18
  Gene Name: solute carrier family 6 (neutral amino acid transporter), member 18
  Uniprot ID: Q96N87
  ENSP ID: ENSP00000323549
MAHAPEPDPAACDLGDERPKWDNKAQYLLSCTGFAVGLGNIWRFPYLCQTYGGGAFLIPYVIALVFEGIPIFHVELAIGQRLRKGSVGVWTAISPYLSGVGLGCVTLSFLISLYYNTIVAWVLWYLLNSFQHPLPWSSCPPDLNRTGFVEECQGSSAVSYFWYRQTLNITADINDSGSIQWWLLICLAASWAVVYMCVIRGIETTGKVIYFTALFPYLVLTIFLIRGLTLPGATKGLIYLFTPNMHILQNPRVWLDAATQIFFSLSLAFGGHIAFASYNSPRNDCQKDAVVIALVNRMTSLYASIAVFSVLGFKATNDYEHCLDRNILSLINDFDFPEQSISRDDYPAVLMHLNATWPKRVAQLPLKACLLEDFLDKSASGPGLAFVVFTETDLHMPGAPVWAMLFFGMLFTLGLSTMFGTVEAVITPLLDVGVLPRWVPKEALTGLVCLVCFLSATCFTLQSGNYWLEIFDNFAASPNLLMLAFLEVVGVVYVYGMKRFCDDIAWMTGRRPSPYWRLTWRVVSPLLLTIFVAYIILLFWKPLRYKAWNPKYELFPSRQEKLYPGWARAACVLLSLLPVLWVPVAALAQLLTRRRRTWRDRDARPDTDMRPDTDTRPDTDMRPDTDMR

SEQ ID NO: 82090 - protein, 634 aa, Homo sapiens
  Payload ID: 16340
  Gene Symbol: SLC6A19
  Gene Name: solute carrier family 6 (neutral amino acid transporter), member 19
  Uniprot ID: Q695T7
  ENSP ID: ENSP00000305302
MVRLVLPNPGLDARIPSLAELETIEQEEASSRPKWDNKAQYMLTCLGFCVGLGNVWRFPYLCQSHGGGAFMIPFLILLVLEGIPLLYLEFAIGQRLRRGSLGVWSSIHPALKGLGLASMLTSFMVGLYYNTIISWIMWYLFNSFQEPLPWSDCPLNENQTGYVDECARSSPVDYFWYRETLNISTSISDSGSIQWWMLLCLACAWSVLYMCTIRGIETTGKAVYITSTLPYVVLTIFLIRGLTLKGATNGIVFLFTPNVTELAQPDTWLDAGAQVFFSFSLAFGGLISFSSYNSVHNNCEKDSVIVSIINGFTSVYVAIVVYSVIGFRATQRYDDCFSTNILTLINGFDLPEGNVTQENFVDMQQRCNASDPAAYAQLVFQTCDINAFLSEAVEGTGLAFIVFTEAITKMPLSPLWSVLFFIMLFCLGLSSMFGNMEGVVVPLQDLRVIPPKWPKEVLTGLICLGTFLIGFIFTLNSGQYWLSLLDSYAGSIPLLIIAFCEMFSVVYVYGVDRFNKDIEFMIGHKPNIFWQVTWRVVSPLLMLIIFLFFFVVEVSQELTYSIWDPGYEEFPKSQKISYPNWVYVVVVIVAGVPSLTIPGYAIYKLIRNHCQKPGDHQGLVSTLSTASMNGDLKY

SEQ ID NO: 82091 - protein, 354 aa, Homo sapiens
  Payload ID: 16340
  Gene Symbol: SLC6A19
  Gene Name: solute carrier family 6 (neutral amino acid transporter), member 19
  ENSP ID: ENSP00000425701
MVRLVLPNPGLDARIPSLAELETIEQEEASSRPKWDNKAQYMLTCLGFCVGLGNVWRFPYLCQSHGGGAFMIPFLILLVLEGIPLLYLEFAIGQRLRRGSLGVWSSIHPALKGLGASALERLPAQREPDRVCGRVRQELPCGLLLVPRDAQHLHVHQRLGLHPVVDAAVPGLRMERPVHVHHPRHRDHREGRVHHLHAALCRPDHLPHPRPDAEGRHQWHRLPLHAQRHGAGPAGHLAGRGRTGLLLLLPGLRGPHLLLQLQLCAQQLREGLGDCVHHQRLHIGVCGHRGLLRHWVPRHTALRRLLQHVSGCPTILVPWAAPPGSLPASLAPGGRQPQSDPQEHPDPHQRVRPA

SEQ ID NO: 82092 - protein, 555 aa, Homo sapiens
  Payload ID: 16341
  Gene Symbol: SLC6A20
  Gene Name: solute carrier family 6 (proline IMINO transporter), member 20
  Uniprot ID: Q9NP91
  ENSP ID: ENSP00000296133
MEKARPLWANSLQFVFACISYAVGLGNVWRFPYLCQMYGGGSFLVPYIIMLIVEGMPLLYLELAVGQRMRQGSIGAWRTISPYLSGVGVASVVVSFFLSMYYNVINAWAFWYLFHSFQDPLPWSVCPLNGNHTGYDEECEKASSTQYFWYRKTLNISPSLQENGGVQWEPALCLLLAWLVVYLCILRGTESTGKIEQLANPKAWINAATQIFFSLGLGFGSLIAFASYNEPSNNCQKHAIIVSLINSFTSIFASIVTFSIYGFKATFNYENCLKKVSLLLTNTFDLEDGFLTASNLEQVKGYLASAYPSKYSEMFPQIKNCSLESELDTAVQGTGLAFIVYTEAIKNMEVSQLWSVLYFFMLLMLGIGSMLGNTAAILTPLTDSKIISSHLPKEAISGLVCLVNCAIGMVFTMEAGNYWFDIFNDYAATLSLLLIVLVETIAVCYVYGLRRFESDLKAMTGRAVSWYWKVMWAGVSPLLIVSLFVFYLSDYILTGTLKYQAWDASQGQLVTKDYPAYALAVIGLLVASSTMCIPLAALGTFVQRRLKRGDADPVA

SEQ ID NO: 82093 - protein, 592 aa, Homo sapiens
  Payload ID: 16341
  Gene Symbol: SLC6A20
  Gene Name: solute carrier family 6 (proline IMINO transporter), member 20
  Uniprot ID: Q9NP91
  ENSP ID: ENSP00000346298
MEKARPLWANSLQFVFACISYAVGLGNVWRFPYLCQMYGGGSFLVPYIIMLIVEGMPLLYLELAVGQRMRQGSIGAWRTISPYLSGVGVASVVVSFFLSMYYNVINAWAFWYLFHSFQDPLPWSVCPLNGNHTGYDEECEKASSTQYFWYRKTLNISPSLQENGGVQWEPALCLLLAWLVVYLCILRGTESTGKVVYFTASLPYCVLIIYLIRGLTLHGATNGLMYMFTPKIEQLANPKAWINAATQIFFSLGLGFGSLIAFASYNEPSNNCQKHAIIVSLINSFTSIFASIVTFSIYGFKATFNYENCLKKVSLLLTNTFDLEDGFLTASNLEQVKGYLASAYPSKYSEMFPQIKNCSLESELDTAVQGTGLAFIVYTEAIKNMEVSQLWSVLYFFMLLMLGIGSMLGNTAAILTPLTDSKIISSHLPKEAISGLVCLVNCAIGMVFTMEAGNYWFDIFNDYAATLSLLLIVLVETIAVCYVYGLRRFESDLKAMTGRAVSWYWKVMWAGVSPLLIVSLFVFYLSDYILTGTLKYQAWDASQGQLVTKDYPAYALAVIGLLVASSTMCIPLAALGTFVQRRLKRGDADPVA

SEQ ID NO: 82094 - protein, 264 aa, Homo sapiens
  Payload ID: 16341
  Gene Symbol: SLC6A20
  Gene Name: solute carrier family 6 (proline IMINO transporter), member 20
  ENSP ID: ENSP00000395506
MEKARPLWANSLQFVFACISYAVGLGNVWRFPYLCQMYGGGVASVVVSFFLSMYYNVINAWAFWYLFHSFQDPLPWSVCPLNGNHTGYDEECEKASSTQYFWYRKTLNISPSLQENGGVQWEPALCLLLAWLVVYLCILRGTESTGKVVYFTASLPYCVLIIYLIRGLTLHGATNGLMYMFTPKIEQLANPKAWINAATQIFFSLGLGFGSLIAFASYNEPSNNCQKHAIIVSLINSFTSIFASIVTFSIYGFKATFNYENCLK

SEQ ID NO: 82095 - protein, 547 aa, Homo sapiens
  Payload ID: 16341
  Gene Symbol: SLC6A20
  Gene Name: solute carrier family 6 (proline IMINO transporter), member 20
  ENSP ID: ENSP00000404310
MEKARPLWANSLQFVFACISYAVGLGNVWRFPYLCQMYGGGSFLVPYIIMLIVEGMPLLYLELAVGQRMRQGSIGAWRTISPYLSGVGVASVVVSFFLSMYYNVINAWAFWYLFHSFQDPLPWSVCPLNGNHTGYDEECEKASSTQYFWYRKTLNISPSLQENGGVQWEPALCLLLAWLVVYLCILRGTESTGKVVYFTASLPYCVLIIYLIRGLTLHGATNGLMYMFTPKIEQLANPKAWINAATQIFFSLGLGFGSLIAFASYNEPSNNCQKHAIIVSLINSFTSIFASIVTFSIYGFKATFNYENCLKKVSLLLTNTFDLEDGFLTASNLEQVKGYLASAYPSKYSEMFPQIKNCSLESELDTAVQGTGLAFIVYTEAIKNMEVSQLWSVLYFFMLLMLGIGSMLGNTAAILTPLTDSKIISSHLPKEAISGLVCLVNCAIGMVFTMEAGNYWFDIFNDYAATLSLLLIVLVETIAVCYVYGLRRFESDLKAMTGRAVSWYWKVMWAGVSPLLIVSLFVFYLSDYILTGTLKYQAWDASQDDKL

SEQ ID NO: 82096 - protein, 736 aa, Homo sapiens
  Payload ID: 16342
  Gene Symbol: SLC6A16
  Gene Name: solute carrier family 6, member 16
  Uniprot ID: Q9GZN6
  ENSP ID: ENSP00000338627
MKTEAQPSTSLLANTSWTGTVISDSVPGSQTWEDKGSLTRSATSWTSEAQVSAARVAEAQARTSQPKQISVLEALTASALNQKPTHEKVQMTEKKESEVLLARPFWSSKTEYILAQVGFSMKPSCLWRFAYLWLNSGGCSFAAIYIFMLFLVGVPLLFLEMAAGQSMRQGGMGVWKIIAPWIGGVGYSSFMVCFILGLYFNVVNSWIIFYMSQSFQFPVPWEKCPLTMNSSGFDPECERTTPSIYFWYQQALKASDRIEDGGSPVYSLVLPFFLCWCLVGAFMINGLKSTGKVIYVLVLLPCFIIVGFFIRTLLLEGAKFGLQQLVVAKISDVYNMSVWSLAGGQVLSNTGIGLGSVASLASYMPQSNNCLSDAFLVSVINLLTLLVFTSFNFCVLGFWATVITHRCCERNAEILLKLINLGKLPPDAKPPVNLLYNPTSIYNAWLSGLPQHIKSMVLREVTECNIETQFLKASEGPKFAFLSFVEAMSFLPPSVFWSFIFFLMLLAMGLSSAIGIMQGIITPLQDTFSFFRKHTKLLIVGVFLLMFVCGLFFTRPSGSYFIRLLSDYWIVFPIIVVVVFETMAVSWAYGARRFLADLTILLGHPISPIFGWLWPHLCPVVLLIIFVTMMVHLCMKPITYMSWDSSTSKEVLRPYPPWALLLMITLFAIVILPIPAYFVYCRIHRIPFRPKSGDGPMTASTSLPLSHQLTPSKEVQKEEILQVDETKYPSTCNVTS

SEQ ID NO: 82097 - protein, 659 aa, Homo sapiens
  Payload ID: 16342
  Gene Symbol: SLC6A16
  Gene Name: solute carrier family 6, member 16
  Uniprot ID: Q9GZN6
  ENSP ID: ENSP00000404022
MKTEAQPSTSLLANTSWTGTVISDSVPGSQTWEDKGSLTRSATSWTSEAQVSAARVAEAQARTSQPKQISVLEALTASALNQKPTHEKVQMTEKKESEVLLARPFWSSKTEYILAQVGFSMKPSCLWRFAYLWLNSGGCSFAAIYIFMLFLVGVPLLFLEMAAGQSMRQGGMGVWKIIAPWIGGVGYSSFMVCFILGLYFNVVNSWIIFYMSQSFQFPVPWEKCPLTMNSSGFDPECERTTPSIYFWYQQALKASDRIEDGGSPVYSLVLPFFLCWCLVGAFMINGLKSTGKVIYVLVLLPCFIIVGFFIRTLLLEGAKFGLQQLVVAKISDVYNMSVWSLAGGQVLSNTGIGLGSVASLASYMPQSNNCLSDAFLVSVINLLTLLVFTSFNFCVLGFWATVITHRCCERNAEILLKLINLGKLPPDAKPPVNLLYNPTSIYNAWLSGLPQHIKSMVLREVTECNIETQFLKASEGPKFAFLSFVEAMSFLPPSVFWSFIFFLMLLAMGLSSAIGIMQGIITPLQDTFSFFRKHTKLLIVGVFLLMFVCGLFFTRPSGSYFIRLLSDYWIVFPIIVVVVFETMAVSWAYGARRFLADLTILLGHPISPIFGWLWPHLCPVVLLIIFVTMMVHLCMKPITYMSWDSSTVSLPQDPEPLWE

SEQ ID NO: 82098 - protein, 163 aa, Homo sapiens
  Payload ID: 16342
  Gene Symbol: SLC6A16
  Gene Name: solute carrier family 6, member 16
  ENSP ID: ENSP00000469885
MVLREVTECNIETQFLKASEGPKFAFLSFVEAMSFLPPSVFWSFIFFLMLLAMGLSSAIGIMQGIITPLQDTFSFFRKHTKLLIVGVFLLMFVCGLFFTRPSGSYFIRLLSDYWIVFPIIVVVVFETMAVSWAYGARRFLADLTILLGHPISPIFGWLWPHLC

SEQ ID NO: 82099 - protein, 33 aa, Homo sapiens
  Payload ID: 16342
  Gene Symbol: SLC6A16
  Gene Name: solute carrier family 6, member 16
  ENSP ID: ENSP00000470623
LLVFTSFNFCVLGFWATVITHRCCESRDRVSPC

SEQ ID NO: 82100 - protein, 136 aa, Homo sapiens
  Payload ID: 16342
  Gene Symbol: SLC6A16
  Gene Name: solute carrier family 6, member 16
  ENSP ID: ENSP00000472191
  MOD_RES (1)..(1): Any amino acid
XGVWKIIAPWIGGVGYSSFMVCFILGLYFNVVNSWIIFYMSQSFQFPVPWEKCPLTMNSSGFDPECERTTPSIYFWYQQALKASDRIEDGGSPVYSLVLPFFLCWCLVGAFMINGLKSTGKQRQGFTVLARTVSIF

SEQ ID NO: 82101 - protein, 147 aa, Homo sapiens
  Payload ID: 16342
  Gene Symbol: SLC6A16
  Gene Name: solute carrier family 6, member 16
  ENSP ID: ENSP00000472752
  MOD_RES (1)..(1): Any amino acid
XYFNVVNSWIIFYMSQSFQFPVPWEKCPLTMNSSGFDPECERTTPSIYFWYQQALKASDRIEDGGSPVYSLVLPFFLCWCLVGAFMINGLKSTGKVIYVLVLLPCFIIVGFFIRTLLLEGAKFGLQQLVVAKQRQGFTVLARTVSIF

SEQ ID NO: 82102 - protein, 487 aa, Homo sapiens
  Payload ID: 16343
  Gene Symbol: SLC7A9
  Gene Name: solute carrier family 7 (amino acid transporter light chain, bo,+ system), member 9
  Uniprot ID: P82251
  ENSP ID: ENSP00000023064
MGDTGLRKRREDEKSIQSQEPKTTSLQKELGLISGISIIVGTIIGSGIFVSPKSVLSNTEAVGPCLIIWAACGVLATLGALCFAELGTMITKSGGEYPYLMEAYGPIPAYLFSWASLIVIKPTSFAIICLSFSEYVCAPFYVGCKPPQIVVKCLAAAAILFISTVNSLSVRLGSYVQNIFTAAKLVIVAIIIISGLVLLAQGNTKNFDNSFEGAQLSVGAISLAFYNGLWAYDGWNQLNYITEELRNPYRNLPLAIIIGIPLVTACYILMNVSYFTVMTATELLQSQAVAVTFGDRVLYPASWIVPLFVAFSTIGAANGTCFTAGRLIYVAGREGHMLKVLSYISVRRLTPAPAIIFYGIIATIYIIPGDINSLVNYFSFAAWLFYGLTILGLIVMRFTRKELERPIKVPVVIPVLMTLISVFLVLAPIISKPTWEYLYCVLFILSGLLFYFLFVHYKFGWAQKISKPITMHLQMLMEVVPPEEDPE

SEQ ID NO: 82103 - protein, 487 aa, Homo sapiens; identical to SEQ ID NO: 82102
  Payload ID: 16343
  Gene Symbol: SLC7A9
  Gene Name: solute carrier family 7 (amino acid transporter light chain, bo,+ system), member 9
  Uniprot ID: P82251
  ENSP ID: ENSP00000464822

SEQ ID NO: 82104 - protein, 39 aa, Homo sapiens
  Payload ID: 16343
  Gene Symbol: SLC7A9
  Gene Name: solute carrier family 7 (amino acid transporter light chain, bo,+ system), member 9
  ENSP ID: ENSP00000465563
MGDTGLRKRREDEKSIQSQEPKTTSLQKEVPCALRSLAQ

SEQ ID NO: 82105 - protein, 39 aa, Homo sapiens; identical to SEQ ID NO: 82104
  Payload ID: 16343
  Gene Symbol: SLC7A9
  Gene Name: solute carrier family 7 (amino acid transporter light chain, bo,+ system), member 9
  ENSP ID: ENSP00000468076

SEQ ID NO: 82106 - protein, 487 aa, Homo sapiens; identical to SEQ ID NO: 82102
  Payload ID: 16343
  Gene Symbol: SLC7A9
  Gene Name: solute carrier family 7 (amino acid transporter light chain, bo,+ system), member 9
  Uniprot ID: P82251
  ENSP ID: ENSP00000468439

SEQ ID NO: 82107 - protein, 507 aa, Homo sapiens
  Payload ID: 16344
  Gene Symbol: SLC7A5
  Gene Name: solute carrier family 7 (amino acid transporter light chain, L system), member 5
  Uniprot ID: Q01650
  ENSP ID: ENSP00000261622
MAGAGPKRRALAAPAAEEKEEAREKMLAAKSADGSAPAGEGEGVTLQRNITLLNGVAIIVGTIIGSGIFVTPTGVLKEAGSPGLALVVWAACGVFSIVGALCYAELGTTISKSGGDYAYMLEVYGSLPAFLKLWIELLIIRPSSQYIVALVFATYLLKPLFPTCPVPEEAAKLVACLCVLLLTAVNCYSVKAATRVQDAFAAAKLLALALIILLGFVQIGKGDVSNLDPNFSFEGTKLDVGNIVLALYSGLFAYGGWNYLNFVTEEMINPYRNLPLAIIISLPIVTLVYVLTNLAYFTTLSTEQMLSSEAVAVDFGNYHLGVMSWIIPVFVGLSCFGSVNGSLFTSSRLFFVGSREGHLPSILSMIHPQLLTPVPSLVFTCVMTLLYAFSKDIFSVINFFSFFNWLCVALAIIGMIWLRHRKPELERPIKVNLALPVFFILACLFLIAVSFWKTPVECGIGFTIILSGLPVYFFGVWWKNKPKWLLQGIFSTTVLCQKLMQVVPQET

SEQ ID NO: 82108 - protein, 241 aa, Homo sapiens
  Payload ID: 16344
  Gene Symbol: SLC7A5
  Gene Name: solute carrier family 7 (amino acid transporter light chain, L system), member 5
  ENSP ID: ENSP00000454323
MINPYRNLPLAIIISLPIVTLVYVLTNLAYFTTLSTEQMLSSEAVAVDFGNYHLGVMSWIIPVFVGLSCFGSVNGSLFTSSRLFFVGSREGHLPSILSMIHPQLLTPVPSLVFTCVMTLLYAFSKDIFSVINFFSFFNWLCVALAIIGMIWLRHRKPELERPIKVNLALPVFFILACLFLIAVSFWKTPVECGIGFTIILSGLPVYFFGVWWKNKPKWLLQGIFSTTVLCQKLMQVVPQET

SEQ ID NO: 82109 - protein, 535 aa, Homo sapiens
  Payload ID: 16345
  Gene Symbol: SLC7A8
  Gene Name: solute carrier family 7 (amino acid transporter light chain, L system), member 8
  Uniprot ID: Q9UHI5
  ENSP ID: ENSP00000320378
MEEGARHRNNTEKKHPGGGESDASPEAGSGGGGVALKKEIGLVSACGIIVGNIIGSGIFVSPKGVLENAGSVGLALIVWIVTGFITVVGALCYAELGVTIPKSGGDYSYVKDIFGGLAGFLRLWIAVLVIYPTNQAVIALTFSNYVLQPLFPTCFPPESGLRLLAAICLLLLTWVNCSSVRWATRVQDIFTAGKLLALALIIIMGIVQICKGEYFWLEPKNAFENFQEPDIGLVALAFLQGSFAYGGWNFLNYVTEELVDPYKNLPRAIFISIPLVTFVYVFANVAYVTAMSPQELLASNAVAVTFGEKLLGVMAWIMPISVALSTFGGVNGSLFTSSRLFFAGAREGHLPSVLAMIHVKRCTPIPALLFTCISTLLMLVTSDMYTLINYVGFINYLFYGVTVAGQIVLRWKKPDIPRPIKINLLFPIIYLLFWAFLLVFSLWSEPVVCGIGLAIMLTGVPVYFLGVYWQHKPKCFSDFIELLTLVSQKMCVVVYPEVERGSGTEEANEDMEEQQQPMYQPTPTKDKDVAGQPQP

SEQ ID NO: 82110 - protein, 230 aa, Homo sapiens
  Payload ID: 16345
  Gene Symbol: SLC7A8
  Gene Name: solute carrier family 7 (amino acid transporter light chain, L system), member 8
  ENSP ID: ENSP00000343949
  MOD_RES (1)..(1): Any amino acid
XCLQEHSQPSQLLCTLLLCWCVLGRERPFRKAQSTSSPLEGVPRFLKRLLLTWVNCSSVRWATRVQDIFTAGKLLALALIIIMGIVQICKGEYFWLEPKNAFENFQEPDIGLVALAFLQGSFAYGGWNFLNYVTEELVDPYKLFFAGAREGHLPSVLAMIHVKRCTPIPALLFTCISTLLMLVTSDMYTLINYVGFINYLFYGVTVAGQIVLRWKKPDIPRPIKPLPYQG

SEQ ID NO: 82111 - protein, 332 aa, Homo sapiens
  Payload ID: 16345
  Gene Symbol: SLC7A8
  Gene Name: solute carrier family 7 (amino acid transporter light chain, L system), member 8
  Uniprot ID: Q9UHI5
  ENSP ID: ENSP00000391577
MGIVQICKGEYFWLEPKNAFENFQEPDIGLVALAFLQGSFAYGGWNFLNYVTEELVDPYKNLPRAIFISIPLVTFVYVFANVAYVTAMSPQELLASNAVAVTFGEKLLGVMAWIMPISVALSTFGGVNGSLFTSSRLFFAGAREGHLPSVLAMIHVKRCTPIPALLFTCISTLLMLVTSDMYTLINYVGFINYLFYGVTVAGQIVLRWKKPDIPRPIKINLLFPIIYLLFWAFLLVFSLWSEPVVCGIGLAIMLTGVPVYFLGVYWQHKPKCFSDFIELLTLVSQKMCVVVYPEVERGSGTEEANEDMEEQQQPMYQPTPTKDKDVAGQPQP

SEQ ID NO: 82112 - protein, 311 aa, Homo sapiens
  Payload ID: 16345
  Gene Symbol: SLC7A8
  Gene Name: solute carrier family 7 (amino acid transporter light chain, L system), member 8
  Uniprot ID: Q9UHI5
  ENSP ID: ENSP00000416398
MGQLFQCAVGHPGSRHLHSWEAPGLGPDYHHGDCTDMQRNLPRAIFISIPLVTFVYVFANVAYVTAMSPQELLASNAVAVTFGEKLLGVMAWIMPISVALSTFGGVNGSLFTSSRLFFAGAREGHLPSVLAMIHVKRCTPIPALLFTCISTLLMLVTSDMYTLINYVGFINYLFYGVTVAGQIVLRWKKPDIPRPIKINLLFPIIYLLFWAFLLVFSLWSEPVVCGIGLAIMLTGVPVYFLGVYWQHKPKCFSDFIELLTLVSQKMCVVVYPEVERGSGTEEANEDMEEQQQPMYQPTPTKDKDVAGQPQP

SEQ ID NO: 82113 - protein, 430 aa, Homo sapiens
  Payload ID: 16345
  Gene Symbol: SLC7A8
  Gene Name: solute carrier family 7 (amino acid transporter light chain, L system), member 8
  Uniprot ID: Q9UHI5
  ENSP ID: ENSP00000434345
MGQYGQELSWKCLVKAVCLQEHSQPSQLLCTLLLCWCVLGRERPFRKAQSTSSPLEGVPRFLKRLLLTWVNCSSVRWATRVQDIFTAGKLLALALIIIMGIVQICKGEYFWLEPKNAFENFQEPDIGLVALAFLQGSFAYGGWNFLNYVTEELVDPYKNLPRAIFISIPLVTFVYVFANVAYVTAMSPQELLASNAVAVTFGEKLLGVMAWIMPISVALSTFGGVNGSLFTSSRLFFAGAREGHLPSVLAMIHVKRCTPIPALLFTCISTLLMLVTSDMYTLINYVGFINYLFYGVTVAGQIVLRWKKPDIPRPIKINLLFPIIYLLFWAFLLVFSLWSEPVVCGIGLAIMLTGVPVYFLGVYWQHKPKCFSDFIELLTLVSQKMCVVVYPEVERGSGTEEANEDMEEQQQPMYQPTPTKDKDVAGQPQP

SEQ ID NO: 82114 - protein, 94 aa, Homo sapiens
  Payload ID: 16345
  Gene Symbol: SLC7A8
  Gene Name: solute carrier family 7 (amino acid transporter light chain, L system), member 8
  ENSP ID: ENSP00000434352
MEEGARHRNNTEKKHPGGGESDASPEAGSGGGGVALKKEIGLVSACGIIVGNIIGSGIFVSPKGVLENAGSVGLALIVWIVTGFITVVGALCYA

SEQ ID NO: 82115 - protein, 289 aa, Homo sapiens
  Payload ID: 16345
  Gene Symbol: SLC7A8
  Gene Name: solute carrier family 7 (amino acid transporter light chain, L system), member 8
  ENSP ID: ENSP00000435114
MEEGARHRNNTEKKHPGGGESDASPEAGSGGGGVALKKEIGLVSACGIIVGNIIGSGIFVSPKGVLENAGSVGLALIVWIVTGFITVVGALCYAELGVTIPKSGGDYSYVKDIFGGLAGFLRLWIAVLVIYPTNQAVIALTFSNYVLQPLFPTCFPPESGLRLLAAICLLLLTWVNCSSVRWATRVQDIFTAGKLLALALIIIMGIVQICKGEYFWLEPKNAFENFQEPDIGLVALAFLQGSFAYGGWNFLNYVTEELVDPYKAANPGEPEDVCGRVPRGGAGLRDRGG

SEQ ID NO: 82116 - protein, 49 aa, Homo sapiens
  Payload ID: 16345
  Gene Symbol: SLC7A8
  Gene Name: solute carrier family 7 (amino acid transporter light chain, L system), member 8
  ENSP ID: ENSP00000435865
MGIVQICKGTFPEPSSSPSHWSHLCMSLPMSLMSLQCPPRSCWHPTPSL

SEQ ID NO: 82117 - protein, 78 aa, Homo sapiens
  Payload ID: 16345
  Gene Symbol: SLC7A8
  Gene Name: solute carrier family 7 (amino acid transporter light chain, L system), member 8
  ENSP ID: ENSP00000436665
MEEGARHRNNTEKKHPGGGESDASPEAGSGGGGVALKKEIGLVSACGIIVGNIIGSGIFVSPKGVLENAGSVGLALIV

SEQ ID NO: 82118 - protein, 303 aa, Homo sapiens
  Payload ID: 16345
  Gene Symbol: SLC7A8
  Gene Name: solute carrier family 7 (amino acid transporter light chain, L system), member 8
  ENSP ID: ENSP00000477662
MGIVQICKGEYFWLEPKNAFENFQEPDIGLVALAFLQGSFAYGGWNFLNYVTEELVDPYKNLPRAIFISIPLVTFVYVFANVAYVTAMSPQELLASNAVAVTFGEKLLGVMAWIMPISVALSTFGGVNGSLFTSSRLFFAGAREGHLPSVLAMIHVKRCTPIPALLFTCISTLLMLVTSDMYTLINYVGFINYLFYGVTVAGQIVLRWKKPDIPRPIKINLLFPIIYLLFWAFLLVFSLWSEPVVCGIGLAIMLTGVPVYFLGVYWQHKPKCFSDFIELLTLVSQKMCVVVYPEVEGLRDRGG

SEQ ID NO: 82119 - protein, 210 aa, Homo sapiens
  Payload ID: 16345
  Gene Symbol: SLC7A8
  Gene Name: solute carrier family 7 (amino acid transporter light chain, L system), member 8
  ENSP ID: ENSP00000479318
MGIVQICKGEYFWLEPKNAFENFQEPDIGLVALAFLQGSFAYGGWNFLNYVTEELVDPYKNLPRAIFISIPLVTFVYVFANVAYVTAMSPQELLASNAVAVTFGEKLLGVMAWIMPISVALSTFGGVNGSLHLLSAVLRWSPRGPPSQCVGHDPREALHPNPSPALHMHLHPADAGHQRHVHTHQLCGLHQLPLLWGHGCWTDSPSLEEA

SEQ ID NO: 82120 - protein, 210 aa, Homo sapiens
  Payload ID: 16345
  Gene Symbol: SLC7A8
  Gene Name: solute carrier family 7 (amino acid transporter light chain, L system), member 8
  ENSP ID: ENSP00000480181
MGIVQICKGEYFWLEPKNAFENFQEPDIGLVALAFLQGSFAYGGWNFLNYVTEELVDPYKNLPRAIFISIPLVTFVYVFANVAYVTAMSPQELLASNAVAVTFGEKLLGVMAWIMPISVALSTFGGVNGSLFLLSAVLRWSPRGPPSQCVGHDPREALHPNPSPALHMHLHPADAGHQRHVHTHQLCGLHQLPLLWGHGCWTDSPSLEEA

SEQ ID NO: 82121 - protein, 515 aa, Homo sapiens
  Payload ID: 16346
  Gene Symbol: SLC7A6
  Gene Name: solute carrier family 7 (amino acid transporter light chain, y+L system), member 6
  Uniprot ID: Q92536
  ENSP ID: ENSP00000219343
MEAREPGRPTPTYHLVPNTSQSQVEEDVSSPPQRSSETMQLKKEISLLNGVSLVVGNMIGSGIFVSPKGVLVHTASYGMSLIVWAIGGLFSVVGALCYAELGTTITKSGASYAYILEAFGGFIAFIRLWVSLLVVEPTGQAIIAITFANYIIQPSFPSCDPPYLACRLLAAACICLLTFVNCAYVKWGTRVQDTFTYAKVVALIAIIVMGLVKLCQGHSEHFQDAFEGSSWDMGNLSLALYSALFSYSGWDTLNFVTEEIKNPERNLPLAIGISMPIVTLIYILTNVAYYTVLNISDVLSSDAVAVTFADQTFGMFSWTIPIAVALSCFGGLNASIFASSRLFFVGSREGHLPDLLSMIHIERFTPIPALLFNCTMALIYLIVEDVFQLINYFSFSYWFFVGLSVVGQLYLRWKEPKRPRPLKLSVFFPIVFCICSVFLVIVPLFTDTINSLIGIGIALSGVPFYFMGVYLPESRRPLFIRNVLAAITRGTQQLCFCVLTELDVAEEKKDERKTD

SEQ ID NO: 82122 - protein, 229 aa, Homo sapiens
  Payload ID: 16346
  Gene Symbol: SLC7A6
  Gene Name: solute carrier family 7 (amino acid transporter light chain, y+L system), member 6
  ENSP ID: ENSP00000368448
MEAREPGRPTPTYHLVPNTSQSQVEEDVSSPPQRSSETMQLKKEISLLNGVSLVVGNMIGSGIFVSPKGVLVHTASYGMSLIVWAIGGLFSVVGALCYAELGTTITKSGASYAYILEAFGGFIAFIRLWVSLLVVEPTGQAIIAITFANYIIQPSFPSCDPPYLACRLLAAACICLLTFVNCAYVKWGTRVQDTFTYAKVVALIAIIVMGLVKLCQEICPWPLGFLCQL

SEQ ID NO: 82123 - protein, 214 aa, Homo sapiens
  Payload ID: 16346
  Gene Symbol: SLC7A6
  Gene Name: solute carrier family 7 (amino acid transporter light chain, y+L system), member 6
  ENSP ID: ENSP00000454824
MEAREPGRPTPTYHLVPNTSQSQVEEDVSSPPQRSSETMQLKKEISLLNGVSLVVGNMIGSGIFVSPKGVLVHTASYGMSLIVWAIGGLFSVVGALCYAELGTTITKSGASYAYILEAFGGFIAFIRLWVSLLVVEPTGQAIIAITFANYIIQPSFPSCDPPYLACRLLAAACICNLPSAFKFTSLTDEFLLAMKRSCVSCGLEPWESGWERVC

SEQ ID NO: 82124 - protein, 515 aa, Homo sapiens; identical to SEQ ID NO: 82121
  Payload ID: 16346
  Gene Symbol: SLC7A6
  Gene Name: solute carrier family 7 (amino acid transporter light chain, y+L system), member 6
  Uniprot ID: Q92536
  ENSP ID: ENSP00000455064

SEQ ID NO: 82125 - protein, 28 aa, Homo sapiens
  Payload ID: 16346
  Gene Symbol: SLC7A6
  Gene Name: solute carrier family 7 (amino acid transporter light chain, y+L system), member 6
  ENSP ID: ENSP00000455357
MEAREPGRPTPTYHLVPNTSQSQVEEDV

SEQ ID NO: 82126 - protein, 91 aa, Homo sapiens
  Payload ID: 16346
  Gene Symbol: SLC7A6
  Gene Name: solute carrier family 7 (amino acid transporter light chain, y+L system), member 6
  ENSP ID: ENSP00000455487
MEAREPGRPTPTYHLVPNTSQSQVEEDVSSPPQRSSETMQLKKEISLLNGVSLVVGNMIGSGIFVSPKGVLVHTASYGMSLIVWAIGGLFS

SEQ ID NO: 82127 - protein, 127 aa, Homo sapiens
  Payload ID: 16346
  Gene Symbol: SLC7A6
  Gene Name: solute carrier family 7 (amino acid transporter light chain, y+L system), member 6
  ENSP ID: ENSP00000456474
  MOD_RES (1)..(1): Any amino acid
XNGVSLVVGNMIGSGIFVSPKGVLVHTASYGMSLIVWAIGGLFSVVGALCYAELGTTITKSGASYAYILEAFGGFIAFIRLWVSLLVVEPTGQAIIAITFANYIIQPSFPSCDPPYLACRLLAAACI

SEQ ID NO: 82128 - protein, 74 aa, Homo sapiens
  Payload ID: 16346
  Gene Symbol: SLC7A6
  Gene Name: solute carrier family 7 (amino acid transporter light chain, y+L system), member 6
  ENSP ID: ENSP00000456629
MEAREPGRPTPTYHLVPNTSQSQVEEDVSSPPQRSSETMQLKKEISLLNGVSLVVGNMIGSGIFVSPKGVLVHT

SEQ ID NO: 82129 - protein, 24 aa, Homo sapiens
  Payload ID: 16346
  Gene Symbol: SLC7A6
  Gene Name: solute carrier family 7 (amino acid transporter light chain, y+L system), member 6
  ENSP ID: ENSP00000456896
MEAREPGRPTPTYHLVPNTSQSQV

SEQ ID NO: 82130 - protein, 123 aa, Homo sapiens
  Payload ID: 16346
  Gene Symbol: SLC7A6
  Gene Name: solute carrier family 7 (amino acid transporter light chain, y+L system), member 6
  ENSP ID: ENSP00000457550
MEAREPGRPTPTYHLVPNTSQSQVEEDVSSPPQRSSETMQLKKEISLLNGVSLVVGNMIGSGIFVSPKGVLVHTASYGMSLIVWAIGGLFSVVGALCYAELGTTITKSGASYAYILEAFGGFI

SEQ ID NO: 82131 - protein, 98 aa, Homo sapiens
  Payload ID: 16346
  Gene Symbol: SLC7A6
  Gene Name: solute carrier family 7 (amino acid transporter light chain, y+L system), member 6
  ENSP ID: ENSP00000457758
MEAREPGRPTPTYHLVPNTSQSQVEEDVSSPPQRSSETMQLKKEISLLNGLLSPPVRPSSPSPLPTTSSSRPSPAVIPHTWPAVSWLLLAYVTCHLHS

SEQ ID NO: 82132 - protein, 50 aa, Homo sapiens
  Payload ID: 16346
  Gene Symbol: SLC7A6
  Gene Name: solute carrier family 7 (amino acid transporter light chain, y+L system), member 6
  ENSP ID: ENSP00000463394
VNCAYVKWGTRVQDTFTYAKVVALIAIIVMGLVKLCQEICPWPLGFLCQL

SEQ ID NO: 82133 - protein, 229 aa, Homo sapiens; identical to SEQ ID NO: 82122
  Payload ID: 16346
  Gene Symbol: SLC7A6
  Gene Name: solute carrier family 7 (amino acid transporter light chain, y+L system), member 6
  ENSP ID: ENSP00000484012

SEQ ID NO: 82134 - protein, 511 aa, Homo sapiens
  Payload ID: 16347
  Gene Symbol: SLC7A7
  Gene Name: solute carrier family 7 (amino acid transporter light chain, y+L system), member 7
  Uniprot ID: Q9UM01
  ENSP ID: ENSP00000285850
MVDSTEYEVASQPEVETSPLGDGASPGPEQVKLKKEISLLNGVCLIVGNMIGSGIFVSPKGVLIYSASFGLSLVIWAVGGLFSVFGALCYAELGTTIKKSGASYAYILEAFGGFLAFIRLWTSLLIIEPTSQAIIAITFANYMVQPLFPSCFAPYAASRLLAAACICLLTFINCAYVKWGTLVQDIFTYAKVLALIAVIVAGIVRLGQGASTHFENSFEGSSFAVGDIALALYSALFSYSGWDTLNYVTEEIKNPERNLPLSIGISMPIVTIIYILTNVAYYTVLDMRDILASDAVAVTFADQIFGIFNWIIPLSVALSCFGGLNASIVAASRLFFVGSREGHLPDAICMIHVERFTPVPSLLFNGIMALIYLCVEDIFQLINYYSFSYWFFVGLSIVGQLYLRWKEPDRPRPLKLSVFFPIVFCLCTIFLVAVPLYSDTINSLIGIAIALSGLPFYFLIIRVPEHKRPLYLRRIVGSATRYLQVLCMSVAAEMDLEDGGEMPKQRDPKSN

SEQ ID NO: 82135 - protein, 511 aa, Homo sapiens; identical to SEQ ID NO: 82134
  Payload ID: 16347
  Gene Symbol: SLC7A7
  Gene Name: solute carrier family 7 (amino acid transporter light chain, y+L system), member 7
  Uniprot ID: Q9UM01
  ENSP ID: ENSP00000380662

SEQ ID NO: 82136 - protein, 511 aa, Homo sapiens; identical to SEQ ID NO: 82134
  Payload ID: 16347
  Gene Symbol: SLC7A7
  Gene Name: solute carrier family 7 (amino acid transporter light chain, y+L system), member 7
  Uniprot ID: Q9UM01
  ENSP ID: ENSP00000380663

SEQ ID NO: 82137 - protein, 511 aa, Homo sapiens; identical to SEQ ID NO: 82134
  Payload ID: 16347
  Gene Symbol: SLC7A7
  Gene Name: solute carrier family 7 (amino acid transporter light chain, y+L system), member 7
  Uniprot ID: Q9UM01
  ENSP ID: ENSP00000380666

SEQ ID NO: 82138 - protein, 141 aa, Homo sapiens
  Payload ID: 16347
  Gene Symbol: SLC7A7
  Gene Name: solute carrier family 7 (amino acid transporter light chain, y+L system), member 7
  ENSP ID: ENSP00000421554
MVDSTEYEVASQPEVETSPLGDGASPGPEQVKLKKEISLLNGVCLIVGNMIGSGIFVSPKGVLIYSASFGLSLVIWAVGGLFSVFGALCYAELGTTIKKSGASYAYILEAFGGFLAFIRLWTSLLIIEPTSQAIIAITFAN

SEQ ID NO: 82139 - protein, 116 aa, Homo sapiens
  Payload ID: 16347
  Gene Symbol: SLC7A7
  Gene Name: solute carrier family 7 (amino acid transporter light chain, y+L system), member 7
  ENSP ID: ENSP00000450495
MVDSTEYEVASQPEVETSPLGDGASPGPEQVKLKKEISLLNGVCLIVGNMIGSGIFVSPKGVLIYSASFGLSLVIWAVGGLFSVFGALCYAELGTTIKKSGASYAYILEAFGGFLA

SEQ ID NO: 82140 - protein, 164 aa, Homo sapiens
  Payload ID: 16347
  Gene Symbol: SLC7A7
  Gene Name: solute carrier family 7 (amino acid transporter light chain, y+L system), member 7
  ENSP ID: ENSP00000450671
MVDSTEYEVASQPEVETSPLGDGASPGPEQVKLKKEISLLNGVCLIVGNMIGSGIFVSPKGVLIYSASFGLSLVIWAVGGLFSVFGALCYAELGTTIKKSGASYAYILEAFGGFLAFIRLWTSLLIIEPTSQAIIAITFANYMVQPLFPSCFAPYAASRLLAAA

SEQ ID NO: 82141 - protein, 310 aa, Homo sapiens
  Payload ID: 16347
  Gene Symbol: SLC7A7
  Gene Name: solute carrier family 7 (amino acid transporter light chain, y+L system), member 7
  ENSP ID: ENSP00000450715
MVDSTEYEVASQPEVETSPLGDGASPGPEQVKLKKEISLLNGVCLIVGNMIGSGIFVSPKGVLIYSASFGLSLVIWAVGGLFSVFGALCYAELGTTIKKSGASYAYILEAFGGFLAFIRLWTSLLIIEPTSQAIIAITFANYMVQPLFPSCFAPYAASRLLAAACICLLTFINCAYVKWGTLVQDIFTYAKVLALIAVIVAGIVRLGQGASTHFENSFEGSSFAVGDIALALYSALFSYSGWDTLNYVTEEIKNPERNLPLSIGISMPIVTIIYILTNVAYYTVLDMRDILASDAVAVAFLCGLKRRPSP

SEQ ID NO: 82142 - protein, 106 aa, Homo sapiens
  Payload ID: 16347
  Gene Symbol: SLC7A7
  Gene Name: solute carrier family 7 (amino acid transporter light chain, y+L system), member 7
  ENSP ID: ENSP00000450729
MVDSTEYEVASQPEVETSPLGDGASPGPEQVKLKKEISLLNGVCLIVGNMIGSGIFVSPKGVLIYSASFGLSLVIWAVGGLFSVFGALCYAELGTTIKKSGASYAY

SEQ ID NO: 82143 - protein, 168 aa, Homo sapiens
  Payload ID: 16347
  Gene Symbol: SLC7A7
  Gene Name: solute carrier family 7 (amino acid transporter light chain, y+L system), member 7
  ENSP ID: ENSP00000451026
  MOD_RES (1)..(1): Any amino acid
XMRDILASDAVAVTFADQIFGIFNWIIPLSVALSCFGGLNASIVAASRLFFVGSREGHLPDAICMIHVERFTPVPSLLFNLSVFFPIVFCLCTIFLVAVPLYSDTINSLIGIAIALSGLPFYFLIIRVPEHKRPLYLRRIVGSATRYLQVLCMSVAAEMDLEDGGEMP

SEQ ID NO: 82144 - protein, 44 aa, Homo sapiens
  Payload ID: 16347
  Gene Symbol: SLC7A7
  Gene Name: solute carrier family 7 (amino acid transporter light chain, y+L system), member 7
  ENSP ID: ENSP00000451063
MVDSTEYEVASQPEVETSPLGDGASPGPEQVKLKKEISLLNGVC

SEQ ID NO: 82145 - protein, 511 aa, Homo sapiens; identical to SEQ ID NO: 82134
  Payload ID: 16347
  Gene Symbol: SLC7A7
  Gene Name: solute carrier family 7 (amino acid transporter light chain, y+L system), member 7
  Uniprot ID: Q9UM01
  ENSP ID: ENSP00000451881

SEQ ID NO: 82146 - protein, 122 aa, Homo sapiens
  Payload ID: 16347
  Gene Symbol: SLC7A7
  Gene Name: solute carrier family 7 (amino acid transporter light chain, y+L system), member 7
  ENSP ID: ENSP00000451983
MVDSTEYEVASQPEVETSPLGDGASPGPEQVKLKKEISLLNGVCLIVGNMIGSGIFVSPKGVLIYSASFGLSLVIWAVGGLFSVFGALCYAELGTTIKKSGASYAYILEAFGGFLAFIRLWT

SEQ ID NO: 82147 - protein, 245 aa, Homo sapiens
  Payload ID: 16347
  Gene Symbol: SLC7A7
  Gene Name: solute carrier family 7 (amino acid transporter light chain, y+L system), member 7
  ENSP ID: ENSP00000452083
MPIVTIIYILTNVAYYTVLDMRDILASDAVAVTFADQIFGIFNWIIPLSVALSCFGGLNASIVAASRLFFVGSREGHLPDAICMIHVERFTPVPSLLFNGIMALIYLCVEDIFQLINYYSFSYWFFVGLSIVGQLYLRWKEPDRPRPLKLSVFFPIVFCLCTIFLVAVPLYSDTINSLIGIAIALSGLPFYFLIIRVPEHKRPLYLRRIVGSATRYLQVLCMSVAAEMDLEDGGEMPKQRDPKSN

SEQ ID NO: 82148 - protein, 30 aa, Homo sapiens
  Payload ID: 16347
  Gene Symbol: SLC7A7
  Gene Name: solute carrier family 7 (amino acid transporter light chain, y+L system), member 7
  ENSP ID: ENSP00000452256
MVDSTEYEVASQPEVETSPLGDGASPGPEQ

SEQ ID NO: 82149 - protein, 114 aa, Homo sapiens
  Payload ID: 16347
  Gene Symbol: SLC7A7
  Gene Name: solute carrier family 7 (amino acid transporter light chain, y+L system), member 7
  ENSP ID: ENSP00000452551
MVDSTEYEVASQPEVETSPLGDGASPGPEQVKLKKEISLLNGVCLIVGNMIGSGIFVSPKGVLIYSASFGLSLVIWAVGGLFSVFGALCYAELGTTIKKSGASYAYILEAFGGF

SEQ ID NO: 82150 - protein, 501 aa, Homo sapiens
  Payload ID: 16348
  Gene Symbol: SLC7A11
  Gene Name: solute carrier family 7 (anionic amino acid transporter light chain, xc- system), member 11
  Uniprot ID: Q9UPY5
  ENSP ID: ENSP00000280612
MVRKPVVSTISKGGYLQGNVNGRLPSLGNKEPPGQEKVQLKRKVTLLRGVSIIIGTIIGAGIFISPKGVLQNTGSVGMSLTIWTVCGVLSLFGALSYAELGTTIKKSGGHYTYILEVFGPLPAFVRVWVELLIIRPAATAVISLAFGRYILEPFFIQCEIPELAIKLITAVGITVVMVLNSMSVSWSARIQIFLTFCKLTAILIIIVPGVMQLIKGQTQNFKDAFSGRDSSITRLPLAFYYGMYAYAGWFYLNFVTEEVENPEKTIPLAICISMAIVTIGYVLTNVAYFTTINAEELLLSNAVAVTFSERLLGNFSLAVPIFVALSCFGSMNGGVFAVSRLFYVASREGHLPEILSMIHVRKHTPLPAVIVLHPLTMIMLFSGDLDSLLNFLSFARWLFIGLAVAGLIYLRYKCPDMHRPFKVPLFIPALFSFTCLFMVALSLYSDPFSTGIGFVITLTGVPAYYLFIIWDKKPRWFRIMSEKITRTLQIILEVVPEEDKL

SEQ ID NO: 82151 - protein, 75 aa, Homo sapiens
  Payload ID: 16348
  Gene Symbol: SLC7A11
  Gene Name: solute carrier family 7 (anionic amino acid transporter light chain, xc- system), member 11
  ENSP ID: ENSP00000424046
AILIIIVPGVMQLIKGQTQNFKDAFSGRDSSITRLPLAFYYGMYAYAGWFYLNFVTEEVENPEKPFLSGYWEISH

SEQ ID NO: 82152 - protein, 470 aa, Homo sapiens
  Payload ID: 16349
  Gene Symbol: SLC7A13
  Gene Name: solute carrier family 7 (anionic amino acid transporter), member 13
  Uniprot ID: Q8TCU3
  ENSP ID: ENSP00000297524
MDRGEKIQLKRVFGYWWGTSFLLINIIGAGIFVSPKGVLAYSCMNVGVSLCVWAGCAILAMTSTLCSAEISISFPCSGAQYYFLKRYFGSTVAFLNLWTSLFLGSGVVAGQALLLAEYSIQPFFPSCSVPKLPKKCLALAMLWIVGILTSRGVKEVTWLQIASSVLKVSILSFISLTGVVFLIRGKKENVERFQNAFDAELPDISHLIQAIFQGYFAYSGGACFTLIAGELKKPRTTIPKCIFTALPLVTVVYLLVNISYLTVLTPREILSSDAVAITWADRAFPSLAWIMPFAISTSLFSNLLISIFKSSRPIYLASQEGQLPLLFNTLNSHSSPFTAVLLLVTLGSLAIILTSLIDLINYIFFTGSLWSILLMIGILRRRYQEPNLSIPYKVFLSFPLATIVIDVGLVVIPLVKSPNVHYVYVLLLVLSGLLFYIPLIHFKIRLAWFEKMTCYLQLLFNICLPDVSEE

SEQ ID NO: 82153 - protein, 433 aa, Homo sapiens
  Payload ID: 16349
  Gene Symbol: SLC7A13
  Gene Name: solute carrier family 7 (anionic amino acid transporter), member 13
  Uniprot ID: Q8TCU3
  ENSP ID: ENSP00000410982
MDRGEKIQLKRVFGYWWGTSFLLINIIGAGIFVSPKGVLAYSCMNVGVSLCVWAGCAILAMTSTLCSAEISISFPCSGAQYYFLKRYFGSTVAFLNLWTSLFLGSGVVAGQALLLAEYSIQPFFPSCSVPKLPKKCLALAMLWIVGILTSRGVKEVTWLQIASSVLKVSILSFISLTGVVFLIRGKKENVERFQNAFDAELPDISHLIQAIFQGYFAYSGELKKPRTTIPKCIFTALPLVTVVYLLVNISYLTVLTPREILSSDAVAITWADRAFPSLAWIMPFAISTSLFSNLLISIFKSSRPIYLASQEGQLPLLFNTLNSHSSPFTAVLLLVTLGSLAIILTSLIDLINYIFFTGSLWSILLMIGILRRRYQEPNLSIPYKSLILVVQAGEAGVQWHDLGLLQPLLPGFKRFSCLSLPSSWDYRCFCHFH

SEQ ID NO: 82154 - protein, 629 aa, Homo sapiens
  Payload ID: 16350
  Gene Symbol: SLC7A1
  Gene Name: solute carrier family 7 (cationic amino acid transporter, y+ system), member 1
  Uniprot ID: P30825
  ENSP ID: ENSP00000370128
MGCKVLLNIGQQMLRRKVVDCSREETRLSRCLNTFDLVALGVGSTLGAGVYVLAGAVARENAGPAIVISFLIAALASVLAGLCYGEFGARVPKTGSAYLYSYVTVGELWAFITGWNLILSYIIGTSSVARAWSATFDELIGRPIGEFSRTHMTLNAPGVLAENPDIFAVIIILILTGLLTLGVKESAMVNKIFTCINVLVLGFIMVSGFVKGSVKNWQLTEEDFGNTSGRLCLNNDTKEGKPGVGGFMPFGFSGVLSGAATCFYAFVGFDCIATTGEEVKNPQKAIPVGIVASLLICFIAYFGVSAALTLMMPYFCLDNNSPLPDAFKHVGWEGAKYAVAVGSLCALSASLLGSMFPMPRVIYAMAEDGLLFKFLANVNDRTKTPIIATLASGAVAAVMAFLFDLKDLVDLMSIGTLLAYSLVAACVLVLRYQPEQPNLVYQMASTSDELDPADQNELASTNDSQLGFLPEAEMFSLKTILSPKNMEPSKISGLIVNISTSLIAVLIITFCIVTVLGREALTKGALWAVFLLAGSALLCAVVTGVIWRQPESKTKLSFKVPFLPVLPILSIFVNVYLMMQLDQGTWVRFAVWMLIGFIIYFGYGLWHSEEASLDADQARTPDGNLDQCK

SEQ ID NO: 82155 - protein, 121 aa, Homo sapiens
  Payload ID: 16350
  Gene Symbol: SLC7A1
  Gene Name: solute carrier family 7 (cationic amino acid transporter, y+ system), member 1
  ENSP ID: ENSP00000390092
MGCKVLLNIGQQMLRRKVVDCSREETRLSRCLNTFDLVALGVGSTLGAGVYVLAGAVARENAGPAIVISFLIAALASVLAGLCYGEFGARVPKTGSAYLYSYVTVGELWAFITGWNLILSY

SEQ ID NO: 82156 - protein, 698 aa, Homo sapiens
  Payload ID: 16351
  Gene Symbol: SLC7A2
  Gene Name: solute carrier family 7 (cationic amino acid transporter, y+ system), member 2
  Uniprot ID: P52569
  ENSP ID: ENSP00000004531
MKIETSGYNSDKLICRGFIGTPAPPVCDSKFLLSPSSDVRMIPCRAALTFARCLIRRKIVTLDSLEDTKLCRCLSTMDLIALGVGSTLGAGVYVLAGEVAKADSGPSIVVSFLIAALASVMAGLCYAEFGARVPKTGSAYLYTYVTVGELWAFITGWNLILSYVIGTSSVARAWSGTFDELLSKQIGQFLRTYFRMNYTGLAEYPDFFAVCLILLLAGLLSFGVKESAWVNKVFTAVNILVLLFVMVAGFVKGNVANWKISEEFLKNISASAREPPSENGTSIYGAGGFMPYGFTGTLAGAATCFYAFVGFDCIATTGEEVRNPQKAIPIGIVTSLLVCFMAYFGVSAALTLMMPYYLLDEKSPLPVAFEYVGWGPAKYVVAAGSLCALSTSLLGSIFPMPRVIYAMAEDGLLFKCLAQINSKTKTPIIATLSSGAVAALMAFLFDLKALVDMMSIGTLMAYSLVAACVLILRYQPGLSYDQPKCSPEKDGLGSSPRVTSKSESQVTMLQRQGFSMRTLFCPSLLPTQQSASLVSFLVGFLAFLVLGLSVLTTYGVHAITRLEAWSLALLALFLVLFVAIVLTIWRQPQNQQKVAFMVPFLPFLPAFSILVNIYLMVQLSADTWVRFSIWMAIGFLIYFSYGIRHSLEGHLRDENNEEDAYPDNVHAAAEEKSAIQANDHHPRNLSSPFIFHEKTSEF

SEQ ID NO: 82157 - protein, 697 aa, Homo sapiens
  Payload ID: 16351
  Gene Symbol: SLC7A2
  Gene Name: solute carrier family 7 (cationic amino acid transporter, y+ system), member 2
  Uniprot ID: P52569
  ENSP ID: ENSP00000381164
MKIETSGYNSDKLICRGFIGTPAPPVCDSKFLLSPSSDVRMIPCRAALTFARCLIRRKIVTLDSLEDTKLCRCLSTMDLIALGVGSTLGAGVYVLAGEVAKADSGPSIVVSFLIAALASVMAGLCYAEFGARVPKTGSAYLYTYVTVGELWAFITGWNLILSYVIGTSSVARAWSGTFDELLSKQIGQFLRTYFRMNYTGLAEYPDFFAVCLILLLAGLLSFGVKESAWVNKVFTAVNILVLLFVMVAGFVKGNVANWKISEEFLKNISASAREPPSENGTSIYGAGGFMPYGFTGTLAGAATCFYAFVGFDCIATTGEEVRNPQKAIPIGIVTSLLVCFMAYFGVSAALTLMMPYYLLDEKSPLPVAFEYVGWGPAKYVVAAGSLCALSTSLLGSMFPLPRILFAMARDGLLFRFLARVSKRQSPVAATLTAGVISALMAFLFDLKALVDMMSIGTLMAYSLVAACVLILRYQPGLSYDQPKCSPEKDGLGSSPRVTSKSESQVTMLQRQGFSMRTLFCPSLLPTQQSASLVSFLVGFLAFLVLGLSVLTTYGVHAITRLEAWSLALLALFLVLFVAIVLTIWRQPQNQQKVAFMVPFLPFLPAFSILVNIYLMVQLSADTWVRFSIWMAIGFLIYFSYGIRHSLEGHLRDENNEEDAYPDNVHAAAEEKSAIQANDHHPRNLSSPFIFHEKTSEF

SEQ ID NO: 82158 - protein, 658 aa, Homo sapiens
  Payload ID: 16351
  Gene Symbol: SLC7A2
  Gene Name: solute carrier family 7 (cationic amino acid transporter, y+ system), member 2
  Uniprot ID: P52569
  ENSP ID: ENSP00000419140
MIPCRAALTFARCLIRRKIVTLDSLEDTKLCRCLSTMDLIALGVGSTLGAGVYVLAGEVAKADSGPSIVVSFLIAALASVMAGLCYAEFGARVPKTGSAYLYTYVTVGELWAFITGWNLILSYVIGTSSVARAWSGTFDELLSKQIGQFLRTYFRMNYTGLAEYPDFFAVCLILLLAGLLSFGVKESAWVNKVFTAVNILVLLFVMVAGFVKGNVANWKISEEFLKNISASAREPPSENGTSIYGAGGFMPYGFTGTLAGAATCFYAFVGFDCIATTGEEVRNPQKAIPIGIVTSLLVCFMAYFGVSAALTLMMPYYLLDEKSPLPVAFEYVGWGPAKYVVAAGSLCALSTSLLGSIFPMPRVIYAMAEDGLLFKCLAQINSKTKTPIIATLSSGAVAALMAFLFDLKALVDMMSIGTLMAYSLVAACVLILRYQPGLSYDQPKCSPEKDGLGSSPRVTSKSESQVTMLQRQGFSMRTLFCPSLLPTQQSASLVSFLVGFLAFLVLGLSVLTTYGVHAITRLEAWSLALLALFLVLFVAIVLTIWRQPQNQQKVAFMVPFLPFLPAFSILVNIYLMVQLSADTWVRFSIWMAIGFLIYFSYGIRHSLEGHLRDENNEEDAYPDNVHAAAEEKSAIQANDHHPRNLSSPFIFHEKTSEF

SEQ ID NO: 82159 - protein, 697 aa, Homo sapiens; identical to SEQ ID NO: 82157
  Payload ID: 16351
  Gene Symbol: SLC7A2
  Gene Name: solute carrier family 7 (cationic amino acid transporter, y+ system), member 2
  Uniprot ID: P52569
  ENSP ID: ENSP00000419873

SEQ ID NO: 82160 - protein, 658 aa, Homo sapiens; identical to SEQ ID NO: 82158
  Payload ID: 16351
  Gene Symbol: SLC7A2
  Gene Name: solute carrier family 7 (cationic amino acid transporter, y+ system), member 2
  Uniprot ID: P52569
  ENSP ID: ENSP00000430464

SEQ ID NO: 82161 - protein, 619 aa, Homo sapiens
  Payload ID: 16352
  Gene Symbol: SLC7A3
  Gene Name: solute carrier family 7 (cationic amino acid transporter, y+ system), member 3
  Uniprot ID: Q8WY07
  ENSP ID: ENSP00000298085
MPWQAFRRFGQKLVRRRTLESGMAETRLARCLSTLDLVALGVGSTLGAGVYVLAGEVAKDKAGPSIVICFLVAALSSVLAGLCYAEFGARVPRSGSAYLYSYVTVGELWAFTTGWNLILSYVIGTASVARAWSSAFDNLIGNHISKTLQGSIALHVPHVLAEYPDFFALGLVLLLTGLLALGASESALVTKVFTGVNLLVLGFVMISGFVKGDVHNWKLTEEDYELAMAELNDTYSLGPLGSGGFVPFGFEGILRGAATCFYAFVGFDCIATTGEEAQNPQRSIPMGIVISLSVCFLAYFAVSSALTLMMPYYQLQPESPLPEAFLYIGWAPARYVVAVGSLCALSTSLLGSMFPMPRVIYAMAEDGLLFRVLARIHTGTRTPIIATVVSGIIAAFMAFLFKLTDLVDLMSIGTLLAYSLVSICVLILRYQPDQETKTGEEVELQEEAITTESEKLTLWGLFFPLNSIPTPLSGQIVYVCSSLLAVLLTALCLVLAQWSVPLLSGDLLWTAVVVLLLLLIIGIIVVIWRQPQSSTPLHFKVPALPLLPLMSIFVNIYLMMQMTAGTWARFGVWMLIGFAIYFGYGIQHSLEEIKSNQPSRKSRAKTVDLDPGTLYVHSV

SEQ ID NO: 82162 - protein, 619 aa, Homo sapiens; identical to SEQ ID NO: 82161
  Payload ID: 16352
  Gene Symbol: SLC7A3
  Gene Name: solute carrier family 7 (cationic amino acid transporter, y+ system), member 3
  Uniprot ID: Q8WY07
  ENSP ID: ENSP00000363417

SEQ ID NO: 82163 - protein, 523 aa, Homo sapiens
  Payload ID: 16353
  Gene Symbol: SLC7A10
  Gene Name: solute carrier family 7 (neutral amino acid transporter light chain, asc system), member 10
  Uniprot ID: Q9NS82
  ENSP ID: ENSP00000253188
MAGHTQQPSGRGNPRPAPSPSPVPGTVPGASERVALKKEIGLLSACTIIIGNIIGSGIFISPKGVLEHSGSVGLALFVWVLGGGVTALGSLCYAELGVAIPKSGGDYAYVTEIFGGLAGFLLLWSAVLIMYPTSLAVISMTFSNYVLQPVFPNCIPPTTASRVLSMACLMLLTWVNSSSVRWATRIQDMFTGGKLLALSLIIGVGLLQIFQGHFEELRPSNAFAFWMTPSVGHLALAFLQGSFAFSGWNFLNYVTEEMVDARKNLPRAIFISIPLVTFVYTFTNIAYFTAMSPQELLSSNAVAVTFGEKLLGYFSWVMPVSVALSTFGGINGYLFTYSRLCFSGAREGHLPSLLAMIHVRHCTPIPALLVCCGATAVIMLVGDTYTLINYVSFINYLCYGVTILGLLLLRWRRPALHRPIKVNLLIPVAYLVFWAFLLVFSFISEPMVCGVGVIIILTGVPIFFLGVFWRSKPKCVHRLTESMTHWGQELCFVVYPQDAPEEEENGPCPPSLLPATDKPSKPQ

SEQ ID NO: 82164 - protein, 389 aa, Homo sapiens
  Payload ID: 16353
  Gene Symbol: SLC7A10
  Gene Name: solute carrier family 7 (neutral amino acid transporter light chain, asc system), member 10
  ENSP ID: ENSP00000465421
MAGHTQQPSGRGNPRPAPSPSPVPGTVPGASERVALKKEIGLLSACTIIIGNIIGSGIFISPKGVLEHSGSVGLALFVWVLGGGVTALGSLCYAELGVAIPKSGGDYAYVTEIFGGLAGFLLLWSAVLIMYPTSLAVISMTFSNYVLQPVFPNCIPPTTASRVLSMACLMLLTWVNSSSVRWATRIQDMFTGGKLLALSLIIGVGLLQIFQGHFEELRPSNAFAFWMTPSVGHLALAFLQGSFAFSGWNFLNYVTEEMVDARKNLPRAIFISIPLVTFVYTFTNIAYFTAMSPQELLSSNAVAVTFGEKLLGYFSWVMPVSVALSTFGGINGYLFTYSSAGPQPSSCSWATRTRSSTMCPSSTTSATASPSWACCCCAGGGLHSTGPSR

SEQ ID NO: 82165 - protein, 71 aa, Homo sapiens
  Payload ID: 16353
  Gene Symbol: SLC7A10
  Gene Name: solute carrier family 7 (neutral amino acid transporter light chain, asc system), member 10
  ENSP ID: ENSP00000466410
MAGHTQQPSGRGNPRPAPSPSPVPGTVPGASERVALKKEIGLLSACTIIIAFCCSGAPSSSCTPPALLSSP

SEQ ID NO: 82166 - protein, 71 aa, Homo sapiens; identical to SEQ ID NO: 82165
  Payload ID: 16353
  Gene Symbol: SLC7A10
  Gene Name: solute carrier family 7 (neutral amino acid transporter light chain, asc system), member 10
  ENSP ID: ENSP00000466876

SEQ ID NO: 82167 - protein, 771 aa, Homo sapiens
  Payload ID: 16354
  Gene Symbol: SLC7A14
  Gene Name: solute carrier family 7, member 14
  Uniprot ID: Q8TBB6
  ENSP ID: ENSP00000231706
MSGFFTSLDPRRVQWGAAWYAMHSRILRTKPVESMLEGTGTTTAHGTKLAQVLTTVDLISLGVGSCVGTGMYVVSGLVAKEMAGPGVIVSFIIAAVASILSGVCYAEFGVRVPKTTGSAYTYSYVTVGEFVAFFIGWNLILEYLIGTAAGASALSSMFDSLANHTISRWMADSVGTLNGLGKGEESYPDLLALLIAVIVTIIVALGVKNSIGFNNVLNVLNLAVWVFIMIAGLFFINGKYWAEGQFLPHGWSGVLQGAATCFYAFIGFDIIATTGEEAKNPNTSIPYAITASLVICLTAYVSVSVILTLMVPYYTIDTESPLMEMFVAHGFYAAKFVVAIGSVAGLTVSLLGSLFPMPRVIYAMAGDGLLFRFLAHVSSYTETPVVACIVSGFLAALLALLVSLRDLIEMMSIGTLLAYTLVSVCVLLLRYQPESDIDGFVKFLSEEHTKKKEGILADCEKEACSPVSEGDEFSGPATNTCGAKNLPSLGDNEMLIGKSDKSTYNVNHPNYGTVDMTTGIEADESENIYLIKLKKLIGPHYYTMRIRLGLPGKMDRPTAATGHTVTICVLLLFILMFIFCSFIIFGSDYISEQSWWAILLVVLMVLLISTLVFVILQQPENPKKLPYMAPCLPFVPAFAMLVNIYLMLKLSTITWIRFAVWCFVGLLIYFGYGIWNSTLEISAREEALHQSTYQRYDVDDPFSVEEGFSYATEGESQEDWGGPTEDKGFYYQQMSDAKANGRTSSKAKSKSKHKQNSEALIANDELDYSPE

SEQ ID NO: 82168 - protein, 635 aa, Homo sapiens
  Payload ID: 16355
  Gene Symbol: SLC7A4
  Gene Name: solute carrier family 7, member 4
  Uniprot ID: O43246
  ENSP ID: ENSP00000372390
MARGLPTIASLARLCQKLNRLKPLEDSTMETSLRRCLSTLDLTLLGVGGMVGSGLYVLTGAVAKEVAGPAVLLSFGVAAVASLLAALCYAEFGARVPRTGSAYLFTYVSMGELWAFLIGWNVLLEYIIGGAAVARAWSGYLDSMFSHSIRNFTETHVGSWQVPLLGHYPDFLAAGIILLASAFVSCGARVSSWLNHTFSAISLLVILFIVILGFILAQPHNWSADEGGFAPFGFSGVMAGTASCFYAFVGFDVIAASSEEAQNPRRSVPLAIAISLAIAAGAYILVSTVLTLMVPWHSLDPDSALADAFYQRGYRWAGFIVAAGSICAMNTVLLSLLFSLPRIVYAMAADGLFFQVFAHVHPRTQVPVAGTLAFGLLTAFLALLLDLESLVQFLSLGTLLAYTFVATSIIVLRFQKSSPPSSPGPASPGPLTKQQSSFSDHLQLVGTVHASVPEPGELKPALRPYLGFLDGYSPGAVVTWALGVMLASAITIGCVLVFGNSTLHLPHWGYILLLLLTSVMFLLSLLVLGAHQQQYREDLFQIPMVPLIPALSIVLNICLMLKLSYLTWVRFSIWLLMGLAVYFGYGIRHSKENQRELPGLNSTHYVVFPRGSLEETVQAMQPPSQAPAQDPGHME

SEQ ID NO: 82169 - protein, 635 aa, Homo sapiens; identical to SEQ ID NO: 82168
  Payload ID: 16355
  Gene Symbol: SLC7A4
  Gene Name: solute carrier family 7, member 4
  Uniprot ID: O43246
  ENSP ID: ENSP00000384278

SEQ ID NO: 82170 - protein, 81 aa, Homo sapiens
  Payload ID: 16355
  Gene Symbol: SLC7A4
  Gene Name: solute carrier family 7, member 4
  ENSP ID: ENSP00000408727
MARGLPTIASLARLCQKLNRLKPLEDSTMETSLRRCLSTLDLTLLGVGGMVGSGLYVLTGAVAKEVAGPAVLLSFGVAAVA

SEQ ID NO: 82171 - protein, 309 aa, Homo sapiens
  Payload ID: 16356
  Gene Symbol: SLC7A6OS
  Gene Name: solute carrier family 7, member 6 opposite strand
  Uniprot ID: Q96CW6
  ENSP ID: ENSP00000263997
MEAARTAVLRVKRKRSAEPAEALVLACKRLRSDAVESAAQKTSEGLERAAENNVFHLVATVCSQEEPVQPLLREVLRPSRDSQQRVRRNLRASAREVRQEGRYRVLSSRRSLGTTSSGQESEYTPGNPEAAGNSGFQLLDLVHEEGEPEAASAGSCKTSDPDVILCNSVELIRERLTVSEDGPGVRRQEEQKHDDYVYDIYYLETATPGWIENILSVQPYSQEWELVNDDQEPEDIYDDEDDENSENNWRNEYPEEESSDGDEDSRGSADYNSLSEEERGSSRQRMWSKYPLDVQKEFGYDSPHDLDSD

SEQ ID NO: 82172 - protein, 119 aa, Homo sapiens
  Payload ID: 16356
  Gene Symbol: SLC7A6OS
  Gene Name: solute carrier family 7, member 6 opposite strand
  ENSP ID: ENSP00000461470
SDPDVILCNSVELIRERLTVSEDGPGVRRQEEQKHDDYVYDIYYLETATPGWIENILSVQPYSQEWELVNDDQEPEDIYDDEDDENSENNWRNEYPEEESSDGDEDSRGGWQPQTGRDW

SEQ ID NO: 82173 - protein, 39 aa, Homo sapiens
  Payload ID: 16356
  Gene Symbol: SLC7A6OS
  Gene Name: solute carrier family 7, member 6 opposite strand
  ENSP ID: ENSP00000462436
  MOD_RES (1)..(1): Any amino acid
XKHDDYVYDIYYLETATPGWIENILSVQPYSQEWELMCR

SEQ ID NO: 82174 - protein, 238 aa, Homo sapiens
  Payload ID: 16356
  Gene Symbol: SLC7A6OS
  Gene Name: solute carrier family 7, member 6 opposite strand
  ENSP ID: ENSP00000481459
MEAARTAVLRVKRKRSAEPAEALVLACKRLRSDAVESAAQKTSEGLERAAENNVFHLVATVCSQEEPVQPLLREVLRPSRDSQQRVRRNLRASAREVRQEGRYRVLSSRRSLGTTSSGQESEYTPGNPEAAGNSGFQLLDLVHEEGEPEAASAGSCKTSDPDVILCNSVELIRERLTVSEDGPGVRRQEEQKHDDYVYDIYYLETATPGWIENILSVQPYSQEWELVNDDQEPGHLRR

SEQ ID NO: 82175 - protein, 209 aa, Homo sapiens
  Payload ID: 16356
  Gene Symbol: SLC7A6OS
  Gene Name: solute carrier family 7, member 6 opposite strand
  ENSP ID: ENSP00000483575
  MOD_RES (1)..(1): Any amino acid
XESAAQKTSEGLERAAENNVFHLVATVCSQEEPVQPLLREVLRPSRDSQQRVRRNLRASAREVRQEGRYRVLSSRRSLGTTSSGQESEYTPGNPEAAGNSGFQLLDLVHEEGEPEAASAGSCKTSDPDVILCNSVELIRERLTVSEDGPGVRRQEEQKHDDYVYDIYYLETATPGWIENILSVQPYSQEWELVRGPMSRRGMRHPKLLI

SEQ ID NO: 82176 - protein, 973 aa, Homo sapiens
  Payload ID: 16357
  Gene Symbol: SLC8A1
  Gene Name: solute carrier family 8 (sodium/calcium exchanger), member 1
  Uniprot ID: P32418
  ENSP ID: ENSP00000332931
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKTISVKVIDDEEYEKNKTFFLEIGEPRLVEMSEKKALLLNELGGFTITGKYLFGQPVFRKVHAREHPILSTVITIADEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 82177 - protein, 937 aa, Homo sapiens
  Payload ID: 16357
  Gene Symbol: SLC8A1
  Gene Name: solute carrier family 8 (sodium/calcium exchanger), member 1
  Uniprot ID: P32418
  ENSP ID: ENSP00000383886
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKIITIRIFDREEYEKECSFSLVLEEPKWIRRGMKGGFTITDEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 82178 - protein, 973 aa, Homo sapiens; identical to SEQ ID NO: 82176
  Payload ID: 16357
  Gene Symbol: SLC8A1
  Gene Name: solute carrier family 8 (sodium/calcium exchanger), member 1
  Uniprot ID: P32418
  ENSP ID: ENSP00000384763

SEQ ID NO: 82179 - protein, 965 aa, Homo sapiens
  Payload ID: 16357
  Gene Symbol: SLC8A1
  Gene Name: solute carrier family 8 (sodium/calcium exchanger), member 1
  Uniprot ID: P32418
  ENSP ID: ENSP00000384908
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKIITIRIFDREEYEKECSFSLVLEEPKWIRRGMKGGFTITGKYLFGQPVFRKVHAREHPILSTVITIADEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 82180 - protein, 937 aa, Homo sapiens; identical to SEQ ID NO: 82177
  Payload ID: 16357
  Gene Symbol: SLC8A1
  Gene Name: solute carrier family 8 (sodium/calcium exchanger), member 1
  Uniprot ID: P32418
  ENSP ID: ENSP00000385188

SEQ ID NO: 82181 - protein, 937 aa, Homo sapiens; identical to SEQ ID NO: 82177
  Payload ID: 16357
  Gene Symbol: SLC8A1
  Gene Name: solute carrier family 8 (sodium/calcium exchanger), member 1
  Uniprot ID: P32418
  ENSP ID: ENSP00000385535

SEQ ID NO: 82182 - protein, 968 aa, Homo sapiens
  Payload ID: 16357
  Gene Symbol: SLC8A1
  Gene Name: solute carrier family 8 (sodium/calcium exchanger), member 1
  Uniprot ID: P32418
  ENSP ID: ENSP00000385678
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKTISVKVIDDEEYEKNKTFFLEIGEPRLVEMSEKKALLLNELGGFTITGQPVFRKVHAREHPILSTVITIADEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 82183 - protein, 937 aa, Homo sapiens; identical to SEQ ID NO: 82177
  Payload ID: 16357
  Gene Symbol: SLC8A1
  Gene Name: solute carrier family 8 (sodium/calcium exchanger), member 1
  Uniprot ID: P32418
  ENSP ID: ENSP00000385811

SEQ ID NO: 82184 - protein, 664 aa, Homo sapiens
  Payload ID: 16357
  Gene Symbol: SLC8A1
  Gene Name: solute carrier family 8 (sodium/calcium exchanger), member 1
  ENSP ID: ENSP00000386116
MRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKTISVKVIDDEEYEKNKTFFLEIGEPRLVEMSEKKGRSLPLEYLTVRNMRKSAVSPLCLRNQNG

SEQ ID NO: 82185 - protein, 87 aa, Homo sapiens
  Payload ID: 16357
  Gene Symbol: SLC8A1
  Gene Name: solute carrier family 8 (sodium/calcium exchanger), member 1
  ENSP ID: ENSP00000389330
MYNMRRLSLSPTFSMGFHLLVTVSLLFSHVDHVIAETEMEGEGNETGECTGSYYCKKGVILPIWEPQDPSFGDKIARATVYFVAMVY

SEQ ID NO: 82186 - protein, 87 aa, Homo sapiens; identical to SEQ ID NO: 82185
  Payload ID: 16357
  Gene Symbol: SLC8A1
  Gene Name: solute carrier family 8 (sodium/calcium exchanger), member 1
  ENSP ID: ENSP00000398575

SEQ ID NO: 82187 - protein, 73 aa, Homo sapiens
  Payload ID: 16357
  Gene Symbol: SLC8A1
  Gene Name: solute carrier family 8 (sodium/calcium exchanger), member 1
  ENSP ID: ENSP00000412560
MYNMRRLSLSPTFSMGFHLLVTVSLLFSHVDHVIAETEMEGEGNETGECTGSYYCKKGVILPIWEPQDPSFGD

SEQ ID NO: 82188 - protein, 921 aa, Homo sapiens
  Payload ID: 16358
  Gene Symbol: SLC8A2
  Gene Name: solute carrier family 8 (sodium/calcium exchanger), member 2
  Uniprot ID: Q9UPR5
  ENSP ID: ENSP00000236877
MAPLALVGVTLLLAAPPCSGAATPTPSLPPPPANDSDTSTGGCQGSYRCQPGVLLPVWEPDDPSLGDKAARAVVYFVAMVYMFLGVSIIADRFMAAIEVITSKEKEITITKANGETSVGTVRIWNETVSNLTLMALGSSAPEILLSVIEVCGHNFQAGELGPGTIVGSAAFNMFVVIAVCIYVIPAGESRKIKHLRVFFVTASWSIFAYVWLYLILAVFSPGVVQVWEALLTLVFFPVCVVFAWMADKRLLFYKYVYKRYRTDPRSGIIIGAEGDPPKSIELDGTFVGAEAPGELGGLGPGPAEARELDASRREVIQILKDLKQKHPDKDLEQLVGIANYYALLHQQKSRAFYRIQATRLMTGAGNVLRRHAADASRRAAPAEGAGEDEDDGASRIFFEPSLYHCLENCGSVLLSVTCQGGEGNSTFYVDYRTEDGSAKAGSDYEYSEGTLVFKPGETQKELRIGIIDDDIFEEDEHFFVRLLNLRVGDAQGMFEPDGGGRPKGRLVAPLLATVTILDDDHAGIFSFQDRLLHVSECMGTVDVRVVRSSGARGTVRLPYRTVDGTARGGGVHYEDACGELEFGDDETMKTLQVKIVDDEEYEKKDNFFIELGQPQWLKRGISALLLNQGDGDRKLTAEEEEARRIAEMGKPVLGENCRLEVIIEESYDFKNTVDKLIKKTNLALVIGTHSWREQFLEAITVSAGDEEEEEDGSREERLPSCFDYVMHFLTVFWKVLFACVPPTEYCHGWACFGVSILVIGLLTALIGDLASHFGCTVGLKDSVNAVVFVALGTSIPDTFASKVAALQDQCADASIGNVTGSNAVNVFLGLGVAWSVAAVYWAVQGRPFEVRTGTLAFSVTLFTVFAFVGIAVLLYRRRPHIGGELGGPRGPKLATTALFLGLWLLYILFASLEAYCHIRGF

SEQ ID NO: 82189 - protein, 677 aa, Homo sapiens
  Payload ID: 16358
  Gene Symbol: SLC8A2
  Gene Name: solute carrier family 8 (sodium/calcium exchanger), member 2
  ENSP ID: ENSP00000437536
MADKRLLFYKYVYKRYRTDPRSGIIIGAEGDPPKSIELDGTFVGAEAPGELGGLGPGPAEARELDASRREVIQILKDLKQKHPDKDLEQLVGIANYYALLHQQKSRAFYRIQATRLMTGAGNVLRRHAADASRRAAPAEGAGEDEDDGASRIFFEPSLYHCLENCGSVLLSVTCQGGEGNSTFYVDYRTEDGSAKAGSDYEYSEGTLVFKPGETQKELRIGIIDDDIFEEDEHFFVRLLNLRVGDAQGMFEPDGGGRPKGRLVAPLLATVTILDDDHAGIFSFQDRLLHVSECMGTVDVRVVRSSGARGTVRLPYRTVDGTARGGGVHYEDACGELEFGDDETMKTLQVKIVDDEEYEKKDNFFIELGQPQWLKRGISALLLNQGDGDRKLTAEEEEARRIAEMGKPVLGENCRLEVIIEESYDFKNTVDKLIKKTNLALVIGTHSWREQFLEAITVSAGDEEEEEDGSREERLPSCFDYVMHFLTVFWKVLFACVPPTEYCHGWACFGVSILVIGLLTALIGDLASHFGCTVGLKDSVNAVVFVALGTSIPDTFASKVAALQDQCADASIGNVTGSNAVNVFLGLGVAWSVAAVYWAVQGRPFEVRTGTLAFSVTLFTVFAFVGIAVLLYRRRPHIGGELGGPRGPKLATTALFLGLWLLYILFASLEAYCHIRGF

SEQ ID NO: 82190 - protein, 145 aa, Homo sapiens
  Payload ID: 16358
  Gene Symbol: SLC8A2
  Gene Name: solute carrier family 8 (sodium/calcium exchanger), member 2
  ENSP ID: ENSP00000472208
MVYMFLGVSIIADRFMAAIEVITSKEKEITITKANGETSVGTVRIWNETVSNLTLMALGSSAPEILLSVIEVCGHNFQAGELGPGTIVGSAAFNMFVVIAVCIYVIPAGESRKIKHLRVFFVTASWSIFAYVWLYLILAVFSPGV

SEQ ID NO: 82191 - protein, 159 aa, Homo sapiens
  Payload ID: 16358
  Gene Symbol: SLC8A2
  Gene Name: solute carrier family 8 (sodium/calcium exchanger), member 2
  ENSP ID: ENSP00000472233
MAAIEVITSKEKEITITKANGETSVGTVRIWNETVSNLTLMALGSSAPEILLSVIEVCGHNFQAGELGPGTIVGSAAFNMFVVIAVCIYVIPAGESRKIKHLRVFFVTASWSIFAYVWLYLILAVFSPGVVQVWEALLTLVFFPVCVVFAWMADKRLLF

SEQ ID NO: 82192 - protein, 298 aa, Homo sapiens
  Payload ID: 16359
  Gene Symbol: SLC8A3
  Gene Name: solute carrier family 8 (sodium/calcium exchanger), member 3
  Uniprot ID: P57103
  ENSP ID: ENSP00000216568
MERGISDVTDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 82193 - protein, 921 aa, Homo sapiens
  Payload ID: 16359
  Gene Symbol: SLC8A3
  Gene Name: solute carrier family 8 (sodium/calcium exchanger), member 3
  Uniprot ID: P57103
  ENSP ID: ENSP00000349392
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVKTIRVKIVDEEEYERQENFFIALGEPKWMERGISDVTDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 82194 - protein, 925 aa, Homo sapiens
  Payload ID: 16359
  Gene Symbol: SLC8A3
  Gene Name: solute carrier family 8 (sodium/calcium exchanger), member 3
  Uniprot ID: P57103
  ENSP ID: ENSP00000350560
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVKTIHIKVIDDEAYEKNKNYFIEMMGPRMVDMSFQKALLLSPDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 82195 - protein, 927 aa, Homo sapiens
  Payload ID: 16359
  Gene Symbol: SLC8A3
  Gene Name: solute carrier family 8 (sodium/calcium exchanger), member 3
  Uniprot ID: P57103
  ENSP ID: ENSP00000370669
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVKTIRVKIVDEEEYERQENFFIALGEPKWMERGISALLLSPDVTDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 82196 - protein, 284 aa, Homo sapiens
  Payload ID: 16359
  Gene Symbol: SLC8A3
  Gene Name: solute carrier family 8 (sodium/calcium exchanger), member 3
  Uniprot ID: P57103
  ENSP ID: ENSP00000377863
MEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 82197 - protein, 925 aa, Homo sapiens; identical to SEQ ID NO: 82194
  Payload ID: 16359
  Gene Symbol: SLC8A3
  Gene Name: solute carrier family 8 (sodium/calcium exchanger), member 3
  Uniprot ID: P57103
  ENSP ID: ENSP00000433531

SEQ ID NO: 82198 - protein, 620 aa, Homo sapiens
  Payload ID: 16359
  Gene Symbol: SLC8A3
  Gene Name: solute carrier family 8 (sodium/calcium exchanger), member 3
  Uniprot ID: P57103
  ENSP ID: ENSP00000436332
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVCDRQEADYGRRGGQEDSRDGKASIG

SEQ ID NO: 82199 - protein, 924 aa, Homo sapiens
  Payload ID: 16359
  Gene Symbol: SLC8A3
  Gene Name: solute carrier family 8 (sodium/calcium exchanger), member 3
  Uniprot ID: P57103
  ENSP ID: ENSP00000436688
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVKTIRVKIVDEEEYERQENFFIALGEPKWMERGISALLLSPDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 82200 - protein, 210 aa, Homo sapiens
  Payload ID: 16359
  Gene Symbol: SLC8A3
  Gene Name: solute carrier family 8 (sodium/calcium exchanger), member 3
  ENSP ID: ENSP00000437103
MEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPGESERCLNLQRGFYLVQMTPGLHLIIFHTISDLNLTEPLPLKCTKVNQRDE

SEQ ID NO: 82201 - protein, 584 aa, Homo sapiens
  Payload ID: 16360
  Gene Symbol: SLC8B1
  Gene Name: solute carrier family 8 (sodium/lithium/calcium exchanger), member B1
  Uniprot ID: Q6J4K2
  ENSP ID: ENSP00000202831
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLYVSWLLYLFLILGVTAAKFFCPNLSAISTTLKLSHNVAGVTFLAFGNGAPDIFSALVAFSDPHTAGLALGALFGAGVLVTTVVAGGITILHPFMAASRPFFRDIVFYMVAVFLTFLMLFRGRVTLAWALGYLGLYVFYVVTVILCTWIYQRQRRGSLFCPMPVTPEILSDSEEDRVSSNTNSYDYGDEYRPLFFYQETTAQILVRALNPLDYMKWRRKSAYWKALKVFKLPVEFLLLLTVPVVDPDKDDQNWKRPLNCLHLVISPLVVVLTLQSGTYGVYEIGGLVPVWVVVVIAGTALASVTFFATSDSQPPRLHWLFAFLGFLTSALWINAAATEVVNILRSLGVVFRLSNTVLGLTLLAWGNSIGDAFSDFTLARQGYPRMAFSACFGGIIFNILVGVGLGCLLQISRSHTEVKLEPDGLLVWVLAGALGLSLVFSLVSVPLQCFQLSRVYGFCLLLFYLNFLVVALLTEFGVIHLKSM

SEQ ID NO: 82202 - protein, 584 aa, Homo sapiens; identical to SEQ ID NO: 82201
  Payload ID: 16360
  Gene Symbol: SLC8B1
  Gene Name: solute carrier family 8 (sodium/lithium/calcium exchanger), member B1
  Uniprot ID: Q6J4K2
  ENSP ID: ENSP00000447091

SEQ ID NO: 82203 - protein, 53 aa, Homo sapiens
  Payload ID: 16360
  Gene Symbol: SLC8B1
  Gene Name: solute carrier family 8 (sodium/lithium/calcium exchanger), member B1
  ENSP ID: ENSP00000447502
MAGRRLNLRWALSVLCVLLMAETVSGTRGSSTGAHISPQFPASVPQGVWPECL

SEQ ID NO: 82204 - protein, 99 aa, Homo sapiens
  Payload ID: 16360
  Gene Symbol: SLC8B1
  Gene Name: solute carrier family 8 (sodium/lithium/calcium exchanger), member B1
  ENSP ID: ENSP00000447585
MAFSACFGGIIFNILVGVGLGCLLQISRSHTEVKLEPDGLLVWVLAGALGLSLVFSLVSVPLQCFQLSRVYGFCLLLFYLNFLVVALLTEFGVIHLKSM

SEQ ID NO: 82205 - protein, 103 aa, Homo sapiens
  Payload ID: 16360
  Gene Symbol: SLC8B1
  Gene Name: solute carrier family 8 (sodium/lithium/calcium exchanger), member B1
  ENSP ID: ENSP00000447972
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLY

SEQ ID NO: 82206 - protein, 231 aa, Homo sapiens
  Payload ID: 16360
  Gene Symbol: SLC8B1
  Gene Name: solute carrier family 8 (sodium/lithium/calcium exchanger), member B1
  ENSP ID: ENSP00000448703
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLYVSWLLYLFLILGVTAAKFFCPNLSAISTTLKLSHNVAGVTFLAFGNGAPDIFSALVAFSDPHTAGLALGALFGAGVLVTTVVAGGITILHPFMAASRPFFRDIVFYMVAVFLTFLMLFRGRVTLAWAL

SEQ ID NO: 82207 - protein, 53 aa, Homo sapiens; identical to SEQ ID NO: 82203
  Payload ID: 16360
  Gene Symbol: SLC8B1
  Gene Name: solute carrier family 8 (sodium/lithium/calcium exchanger), member B1
  ENSP ID: ENSP00000448749

SEQ ID NO: 82208 - protein, 404 aa, Homo sapiens
  Payload ID: 16360
  Gene Symbol: SLC8B1
  Gene Name: solute carrier family 8 (sodium/lithium/calcium exchanger), member B1
  ENSP ID: ENSP00000448758
  MOD_RES (1)..(1): Any amino acid
XTLKLSHNVAGVTFLAFGNGAPDIFSALVAFSDPHTAGLALGALFGAGVLVTTVVAGGITILHPFMAASRPFFRDIVFYMVAVFLTFLMLFRGRVTLAWALGYLGLYVFYVVTVILCTWIYQRQRRGSLFCPMPVTPEILSDSEEDRVSSNTNSYDYGDEYRPLFFYQETTAQILVRALNPLDYMKWRRKSAYWKALKVFKLPVEFLLLLTVPVVDPDKDDQNWKRPLNCLHLVISPLVVVLTLQSGTYGVYEIGGLVPVWVVVVIAGTALASVTFFATSDSQPPRLHWLFAFLGFLTSALWINAAATEVVNILRSLGVVFRLSNTVLGLTLLAWGNSIGDAFSDFTLARQGYPRMAFSACFGGIIFNILVGVGLGCLLQISRSHTEVKTRRMQVAGKTKRHGA

SEQ ID NO: 82209 - protein, 131 aa, Homo sapiens
  Payload ID: 16360
  Gene Symbol: SLC8B1
  Gene Name: solute carrier family 8 (sodium/lithium/calcium exchanger), member B1
  ENSP ID: ENSP00000449448
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLYVSWLLYLFLILGVTAAKFFCPNLSAIST

SEQ ID NO: 82210 - protein, 143 aa, Homo sapiens
  Payload ID: 16360
  Gene Symbol: SLC8B1
  Gene Name: solute carrier family 8 (sodium/lithium/calcium exchanger), member B1
  ENSP ID: ENSP00000449519
MTVGENEGVDDQGGWGKRLTTAGPSCSCADAFSDFTLARQGYPRMAFSACFGGIIFNILVGVGLGCLLQISRSHTEVKLEPDGLLVWVLAGALGLSLVFSLVSVPLQCFQLSRVYGFCLLLFYLNFLVVALLTEFGVIHLKSM

SEQ ID NO: 82211 - protein, 528 aa, Homo sapiens
  Payload ID: 16360
  Gene Symbol: SLC8B1
  Gene Name: solute carrier family 8 (sodium/lithium/calcium exchanger), member B1
  Uniprot ID: Q6J4K2
  ENSP ID: ENSP00000450081
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLYVSWLLYLFLILGVTAAKFFCPNLSAISTTLKLSHNVAGVTFLAFGNGAPDIFSALVAFSDPHTAGLALGALFGYLGLYVFYVVTVILCTWIYQRQRRGSLFCPMPVTPEILSDSEEDRVSSNTNSYDYGDEYRPLFFYQETTAQILVRALNPLDYMKWRRKSAYWKALKVFKLPVEFLLLLTVPVVDPDKDDQNWKRPLNCLHLVISPLVVVLTLQSGTYGVYEIGGLVPVWVVVVIAGTALASVTFFATSDSQPPRLHWLFAFLGFLTSALWINAAATEVVNILRSLGVVFRLSNTVLGLTLLAWGNSIGDAFSDFTLARQGYPRMAFSACFGGIIFNILVGVGLGCLLQISRSHTEVKLEPDGLLVWVLAGALGLSLVFSLVSVPLQCFQLSRVYGFCLLLFYLNFLVVALLTEFGVIHLKSM

SEQ ID NO: 82212 - protein, 1124 aa, Homo sapiens
  Payload ID: 16361
  Gene Symbol: SLC9C2
  Gene Name: solute carrier family 9, member C2 (putative)
  Uniprot ID: Q5TAH2
  ENSP ID: ENSP00000356687
MSSYFWAQNESNRPDLLCGQPADYLVEEKHFTTLVCFIVVLGGLLKMCLKNCEVIVLTILSLSGFVIGHMAYNSVEVHQIVYPLLRTSSFSLYSYFSPLIIFMVALDVEFYTLKKMFWQVLLTGLISFSTASIIIGYVVIKFNKDSWDLQSCLLFSITLGIIDPLRSVNSLKTIGISKIYIDLIRGESLIICSIASIFFGNFRGNRIHFSIFRDLHVGIELSYDILGSIIFGYWCAKIIQCILADVFSNMLTNIILCFSMVYMTFYIVEFLGMSGTLALAAVGLNLDSLTFKPKIELVITKFLRIFSSVYEHLIYAFFGIVIGCGELSHYEFHTIPFIFILFTTVNLVRLLTILLVSPILMHSNYEYNWRWGVVITWSGIKGVFNLLWAPDVYNLAERKVEVPQMFILYVQVISLLTMGINSYVMTQSARKLDLCVLSLPRQMILQNATQHIQEIVQNTITLFKTEKILTNVNWTLVEDKTRIEYIPFSHVSHNDMKTESTTDEALMEEARLHVAAIQMSSFEKQRNNGILEIEAARILIGAAKCYYSIQGKFMSIYDVSTYMRTRSWLIKFKNVLTFLEYCIEKIHFIPPESNTFLTFIFHIVFSEEFEYTGQIINLIYIYPMIIHLWPMARGLNVSALISINYYFMFLYVLESTLKIIILKRKYFQQCWNTLEFFILVIGIIDIFCVYFVKLRPDNLALIQLTVIMGYLRIIRFLPLFKIIVPILIRIADVQIKKRLSLMYSITKGYIKSQEDAKLLIKQIAVCESIYQKLCEILETNKQDAVKELVLMEHEGRDVVIALKTKQAIRNVIAKALKNLTFLCSRGIIDKHEVIEINKVLLKKLKALNNFPKAIPPPTPDIYLHNIIWLEGKDVLIDFFKERAKLACFDSGDTICKGGEMPQGIYLIISGMAILHSLSPTFGIESNQRCDRGSRDMFTEFCTTGDIIGELSCLLKREIEYTVICETSLQACFISLEDLYEGFDAFWPSLEYKIWLKLALSTAYQYFESSLIDEDLRFQNCVMFNQAYVETLSSYSDMIIDNMTMKFVIIVYGSVIDTKTEEPYFAPCIIPTTCEQVQGTSDLSKLLIIQASELTQRNSNTNVMASVNTVFEQPGKNINGRQKMS

SEQ ID NO: 82213 - protein, 815 aa, Homo sapiens
  Payload ID: 16362
  Gene Symbol: SLC9A1
  Gene Name: solute carrier family 9, subfamily A (NHE1, cation proton antiporter 1), member 1
  Uniprot ID: P19634
  ENSP ID: ENSP00000263980
MVLRSGICGLSPHRIFPSLLVVVALVGLLPVLRSHGLQLSPTASTIRSSEPPRERSIGDVTTAPPEVTPESRPVNHSVTDHGMKPRKAFPVLGIDYTHVRTPFEISLWILLACLMKIGFHVIPTISSIVPESCLLIVVGLLVGGLIKGVGETPPFLQSDVFFLFLLPPIILDAGYFLPLRQFTENLGTILIFAVVGTLWNAFFLGGLMYAVCLVGGEQINNIGLLDNLLFGSIISAVDPVAVLAVFEEIHINELLHILVFGESLLNDAVTVVLYHLFEEFANYEHVGIVDIFLGFLSFFVVALGGVLVGVVYGVIAAFTSRFTSHIRVIEPLFVFLYSYMAYLSAELFHLSGIMALIASGVVMRPYVEANISHKSHTTIKYFLKMWSSVSETLIFIFLGVSTVAGSHHWNWTFVISTLLFCLIARVLGVLGLTWFINKFRIVKLTPKDQFIIAYGGLRGAIAFSLGYLLDKKHFPMCDLFLTAIITVIFFTVFVQGMTIRPLVDLLAVKKKQETKRSINEEIHTQFLDHLLTGIEDICGHYGHHHWKDKLNRFNKKYVKKCLIAGERSKEPQLIAFYHKMEMKQAIELVESGGMGKIPSAVSTVSMQNIHPKSLPSERILPALSKDKEEEIRKILRNNLQKTRQRLRSYNRHTLVADPYEEAWNQMLLRRQKARQLEQKINNYLTVPAHKLDSPTMSRARIGSDPLAYEPKEDLPVITIDPASPQSPESVDLVNEELKGKVLGLSRDPAKVAEEDEDDDGGIMMRSKETSSPGTDDVFTPAPSDSPSSQRIQRCLSDPGPHPEPGEGEPFFPKGQ

SEQ ID NO: 82214 - protein, 135 aa, Homo sapiens
  Payload ID: 16362
  Gene Symbol: SLC9A1
  Gene Name: solute carrier family 9, subfamily A (NHE1, cation proton antiporter 1), member 1
  ENSP ID: ENSP00000363197
MVLRSGICGLSPHRIFPSLLVVVALVGLLPVLRSHGLQLSPTASTIRSSEPPRERSIGDVTTAPPEVTPESRPVNHSVTDHGMKPRKAFPVLGIDYTHVRTPFEISLWILLACLMKIGFHVIPTISSIVPESCLL

SEQ ID NO: 82215 - protein, 555 aa, Homo sapiens
  Payload ID: 16362
  Gene Symbol: SLC9A1
  Gene Name: solute carrier family 9, subfamily A (NHE1, cation proton antiporter 1), member 1
  Uniprot ID: P19634
  ENSP ID: ENSP00000363199
MVLRSGICGLSPHRIFPSLLVVVALVGLLPVLRSHGLQLSPTASTIRSSEPPRERSIGDVTTAPPEVTPESRPVNHSVTDHGMKPRKAFPVLGIDYTHVRTPFEISLWILLACLMKIGFHVIPTISSIVPESCLLIVVGLLVGGLIKGVGETPPFLQSDVFFLFLLPPIILDAGYFLPLRQFTENLGTILIFAVVGTLWNAFFLGGLMYAVCLVGGEQINNIGLLDNLLFGSIISAVDPVAVLAVFEEIHINELLHILVFGESLLNDAVTVVLYHLFEEFANYEHVGIVDIFLGFLSFFVVALGGVLVGVVYGVIAAFTSRFTSHIRVIEPLFVFLYSYMAYLSAELFHLSGIMALIASGVVMRPYVEANISHKSHTTIKYFLKMWSSVSETLIFIFLGVSTVAGSHHWNWTFVISTLLFCLIARVLGVLGLTWFINKFRIVKLTPKDQFIIAYGGLRGAIAFSLGYLLDKKHFPMCDLFLTAIITVIFFTVFVQVLGQGRAGPCLGDPHRLFPWKERKACDLKCDSSPSSTTNLLCDLGRATPPFWASVSSIVK

SEQ ID NO: 82216 - protein, 812 aa, Homo sapiens
  Payload ID: 16363
  Gene Symbol: SLC9A2
  Gene Name: solute carrier family 9, subfamily A (NHE2, cation proton antiporter 2), member 2
  Uniprot ID: Q9UBY0
  ENSP ID: ENSP00000233969
MEPLGNWRSLRAPLPPMLLLLLLQVAGPVGALAETLLNAPRAMGTSSSPPSPASVVAPGTTLFEESRLPVFTLDYPHVQIPFEITLWILLASLAKIGFHLYHKLPTIVPESCLLIMVGLLLGGIIFGVDEKSPPAMKTDVFFLYLLPPIVLDAGYFMPTRPFFENIGTIFWYAVVGTLWNSIGIGVSLFGICQIEAFGLSDITLLQNLLFGSLISAVDPVAVLAVFENIHVNEQLYILVFGESLLNDAVTVVLYNLFKSFCQMKTIETIDVFAGIANFFVVGIGGVLIGIFLGFIAAFTTRFTHNIRVIEPLFVFLYSYLSYITAEMFHLSGIMAITACAMTMNKYVEENVSQKSYTTIKYFMKMLSSVSETLIFIFMGVSTVGKNHEWNWAFVCFTLAFCLMWRALGVFVLTQVINRFRTIPLTFKDQFIIAYGGLRGAICFALVFLLPAAVFPRKKLFITAAIVVIFFTVFILGITIRPLVEFLDVKRSNKKQQAVSEEIYCRLFDHVKTGIEDVCGHWGHNFWRDKFKKFDDKYLRKLLIRENQPKSSIVSLYKKLEIKHAIEMAETGMISTVPTFASLNDCREEKIRKVTSSETDEIRELLSRNLYQIRQRTLSYNRHSLTADTSERQAKEILIRRRHSLRESIRKDSSLNREHRASTSTSRYLSLPKNTKLPEKLQKRRTISIADGNSSDSDADAGTTVLNLQPRARRFLPEQFSKKSPQSYKMEWKNEVDVDSGRDMPSTPPTPHSREKGTQTSGLLQQPLLSKDQSGSEREDSLTEGIPPKPPPRLVWRASEPGSRKARFGSEKP

SEQ ID NO: 82217 - protein, 834 aa, Homo sapiens
  Payload ID: 16364
  Gene Symbol: SLC9A3
  Gene Name: solute carrier family 9, subfamily A (NHE3, cation proton antiporter 3), member 3
  Uniprot ID: P48764
  ENSP ID: ENSP00000264938
MWGLGARGPDRGLLLALALGGLARAGGVEVEPGGAHGESGGFQVVTFEWAHVQDPYVIALWILVASLAKIGFHLSHKVTSVVPESALLIVLGLVLGGIVWAADHIASFTLTPTVFFFYLLPPIVLDAGYFMPNRLFFGNLGTILLYAVVGTVWNAATTGLSLYGVFLSGLMGDLQIGLLDFLLFGSLMAAVDPVAVLAVFEEVHVNEVLFIIVFGESLLNDAVTVVLYNVFESFVALGGDNVTGVDCVKGIVSFFVVSLGGTLVGVVFAFLLSLVTRFTKHVRIIEPGFVFIISYLSYLTSEMLSLSAILAITFCGICCQKYVKANISEQSATTVRYTMKMLASSAETIIFMFLGISAVNPFIWTWNTAFVLLTLVFISVYRAIGVVLQTWLLNRYRMVQLEPIDQVVLSYGGLRGAVAFALVVLLDGDKVKEKNLFVSTTIIVVFFTVIFQGLTIKPLVQWLKVKRSEHREPRLNEKLHGRAFDHILSAIEDISGQIGHNYLRDKWSHFDRKFLSRVLMRRSAQKSRDRILNVFHELNLKDAISYVAEGERRGSLAFIRSPSTDNVVNVDFTPRSSTVEASVSYLLRENVSAVCLDMQSLEQRRRSIRDAEDMVTHHTLQQYLYKPRQEYKHLYSRHELTPTEDEKQDREIFHRTMRKRLESFKSTKLGLNQNKKAAKLYKRERAQKRRNSSIPNGKLPMESPAQNFTIKEKDLELSDTEEPPNYDEEMSGGIEFLASVTKDTASDSPAGIDNPVFSPDEALDRSLLARLPPWLSPGETVVPSQRARTQIPYSPGTFCRLMPFRLSSKSVDSFLQADGPEERPPAALPESTHM

SEQ ID NO: 82218 - protein, 825 aa, Homo sapiens
  Payload ID: 16364
  Gene Symbol: SLC9A3
  Gene Name: solute carrier family 9, subfamily A (NHE3, cation proton antiporter 3), member 3
  Uniprot ID: P48764
  ENSP ID: ENSP00000422983
MWGLGARGPDRGLLLALALGGLARAGGVEVEPGGAHGESGGFQVVTFEWAHVQDPYVIALWILVASLAKIGFHLSHKVTSVVPESALLIVLGLVLGGIVWAADHIASFTLTPTVFFFYLLPPIVLDAGYFMPNRLFFGNLGTILLYAVVGTVWNAATTGLSLYGVFLSGLMGDLQIGLLDFLLFGSLMAAVDPVAVLAVFEEVHVNEVLFIIVFGESLLNDAVTVVLYNVFESFVALGGDNVTGVDCVKGIVSFFVVSLGGTLVGVVFAFLLSLVTRFTKHVRIIEPGFVFIISYLSYLTSEMLSLSAILAITFCGICCQKYVKANISEQSATTVRYTMKMLASSAETIIFMFLGISAVNPFIWTWNTAFVLLTLVFISVYRAIGVVLQTWLLNRYRMVQLEPIDQVVLSYGGLRGAVAFALVVLLDGDKVKEKNLFVSTTIIVVFFTVIFQWLKVKRSEHREPRLNEKLHGRAFDHILSAIEDISGQIGHNYLRDKWSHFDRKFLSRVLMRRSAQKSRDRILNVFHELNLKDAISYVAEGERRGSLAFIRSPSTDNVVNVDFTPRSSTVEASVSYLLRENVSAVCLDMQSLEQRRRSIRDAEDMVTHHTLQQYLYKPRQEYKHLYSRHELTPTEDEKQDREIFHRTMRKRLESFKSTKLGLNQNKKAAKLYKRERAQKRRNSSIPNGKLPMESPAQNFTIKEKDLELSDTEEPPNYDEEMSGGIEFLASVTKDTASDSPAGIDNPVFSPDEALDRSLLARLPPWLSPGETVVPSQRARTQIPYSPGTFCRLMPFRLSSKSVDSFLQADGPEERPPAALPESTHM

SEQ ID NO: 82219 - protein, 70 aa, Homo sapiens
  Payload ID: 16364
  Gene Symbol: SLC9A3
  Gene Name: solute carrier family 9, subfamily A (NHE3, cation proton antiporter 3), member 3
  ENSP ID: ENSP00000486297
MWGLGARGPDRGLLLALALGGLARAGGVEVEPGGAHGESGGFQVVTFEWAHVQDPYVIALWILVASLAKI

SEQ ID NO: 82220 - protein, 70 aa, Homo sapiens; identical to SEQ ID NO: 82219
  Payload ID: 16364
  Gene Symbol: SLC9A3
  Gene Name: solute carrier family 9, subfamily A (NHE3, cation proton antiporter 3), member 3
  ENSP ID: ENSP00000486364

SEQ ID NO: 82221 - protein, 358 aa, Homo sapiens
  Payload ID: 16365
  Gene Symbol: SLC9A3R1
  Gene Name: solute carrier family 9, subfamily A (NHE3, cation proton antiporter 3), member 3 regulator 1
  Uniprot ID: O14745
  ENSP ID: ENSP00000262613
MSADAAAGAPLPRLCCLEKGPNGYGFHLHGEKGKLGQYIRLVEPGSPAEKAGLLAGDRLVEVNGENVEKETHQQVVSRIRAALNAVRLLVVDPETDEQLQKLGVQVREELLRAQEAPGQAEPPAAAEVQGAGNENEPREADKSHPEQRELRPRLCTMKKGPSGYGFNLHSDKSKPGQFIRSVDPDSPAEASGLRAQDRIVEVNGVCMEGKQHGDVVSAIRAGGDETKLLVVDRETDEFFKKCRVIPSQEHLNGPLPVPFTNGEIQKENSREALAEAALESPRPALVRSASSDTSEELNSQDSPPKQDSTAPSSTSSSDPILDFNISLAMAKERAHQKRSSKRAPQMDWSKKNELFSNL

SEQ ID NO: 82222 - protein, 35 aa, Homo sapiens
  Payload ID: 16365
  Gene Symbol: SLC9A3R1
  Gene Name: solute carrier family 9, subfamily A (NHE3, cation proton antiporter 3), member 3 regulator 1
  ENSP ID: ENSP00000464117
  MOD_RES (1)..(1): Any amino acid
XGDETKLLVVDRETDEFFKKCRVIPSQEHLNGEQS

SEQ ID NO: 82223 - protein, 215 aa, Homo sapiens
  Payload ID: 16365
  Gene Symbol: SLC9A3R1
  Gene Name: solute carrier family 9, subfamily A (NHE3, cation proton antiporter 3), member 3 regulator 1
  ENSP ID: ENSP00000464321
MSADAAAGAPLPRLCCLEKGPNGYGFHLHGEKGKLGQYIRLVEPGSPAEKAGLLAGDRLVEVNGENVEKETHQQVVSRIRAALNAVRLLVVDPETDEQLQKLGVQVREELLRAQEAPGQAEPPAAAEVQGAGNENEPREADKSHPEQENSREALAEAALESPRPALVRSASSDTSEELNSQDSPPKQDSTAPSSTSSSDPILDFNISLAMAKERA

SEQ ID NO: 82224 - protein, 202 aa, Homo sapiens
  Payload ID: 16365
  Gene Symbol: SLC9A3R1
  Gene Name: solute carrier family 9, subfamily A (NHE3, cation proton antiporter 3), member 3 regulator 1
  Uniprot ID: O14745
  ENSP ID: ENSP00000464982
MKKGPSGYGFNLHSDKSKPGQFIRSVDPDSPAEASGLRAQDRIVEVNGVCMEGKQHGDVVSAIRAGGDETKLLVVDRETDEFFKKCRVIPSQEHLNGPLPVPFTNGEIQKENSREALAEAALESPRPALVRSASSDTSEELNSQDSPPKQDSTAPSSTSSSDPILDFNISLAMAKERAHQKRSSKRAPQMDWSKKNELFSNL

SEQ ID NO: 82225 - protein, 326 aa, Homo sapiens
  Payload ID: 16366
  Gene Symbol: SLC9A3R2
  Gene Name: solute carrier family 9, subfamily A (NHE3, cation proton antiporter 3), member 3 regulator 2
  Uniprot ID: Q15599
  ENSP ID: ENSP00000402857
MAAPEPLRPRLCRLVRGEQGYGFHLHGEKGRRGQFIRRVEPGSPAEAAALRAGDRLVEVNGVNVEGETHHQVVQRIKAVEGQTRLLVVDQETDEELRRRQLTCTEEMAQRGLPPAHDPWEPKPDWAHTGSHSSEAGKKDVSGPLRELRPRLCHLRKGPQGYGFNLHSDKSRPGQYIRSVDPGSPAARSGLRAQDRLIEVNGQNVEGLRHAEVVASIKAREDEARLLVVDPETDEHFKRLRVTPTEEHVEGPLPSPVTNGTSPAQLNGGSACSSRSDLPGSDKDTEESGLHLSPTAAEAKEKARAMRVNKRAPQMDWNRKREIFSNF

SEQ ID NO: 82226 - protein, 337 aa, Homo sapiens
  Payload ID: 16366
  Gene Symbol: SLC9A3R2
  Gene Name: solute carrier family 9, subfamily A (NHE3, cation proton antiporter 3), member 3 regulator 2
  Uniprot ID: Q15599
  ENSP ID: ENSP00000408005
MAAPEPLRPRLCRLVRGEQGYGFHLHGEKGRRGQFIRRVEPGSPAEAAALRAGDRLVEVNGVNVEGETHHQVVQRIKAVEGQTRLLVVDQETDEELRRRQLTCTEEMAQRGLPPAHDPWEPKPDWAHTGSHSSEAGKKDVSGPLRELRPRLCHLRKGPQGYGFNLHSDKSRPGQYIRSVDPGSPAARSGLRAQDRLIEVNGQNVEGLRHAEVVASIKAREDEARLLVVDPETDEHFKRLRVTPTEEHVEGPLPSPVTNGTSPAQLNGGSACSSRSDLPGSDKDTEDGSAWKQDPFQESGLHLSPTAAEAKEKARAMRVNKRAPQMDWNRKREIFSNF

SEQ ID NO: 82227 - protein, 151 aa, Homo sapiens
  Payload ID: 16366
  Gene Symbol: SLC9A3R2
  Gene Name: solute carrier family 9, subfamily A (NHE3, cation proton antiporter 3), member 3 regulator 2
  ENSP ID: ENSP00000454361
MGTQGAMAQEAAQRRALCLGGGRGAQPRAPERREGEEDCAKPASTAHMGNCLGWLCLTPGNQVVQRIKAVEGQTRLLVVDQETDEELRRRQLTCTEEMAQRGLPPAHDPWEPKPDWAHTGSHSSEAGKKDVSGPLRELRPRLCHLRKGPQG

SEQ ID NO: 82228 - protein, 223 aa, Homo sapiens
  Payload ID: 16366
  Gene Symbol: SLC9A3R2
  Gene Name: solute carrier family 9, subfamily A (NHE3, cation proton antiporter 3), member 3 regulator 2
  ENSP ID: ENSP00000454690
MARSGSATPPARAPGAPPRSPPQRLDVSGPLRELRPRLCHLRKGPQGYGFNLHSDKSRPGQYIRSVDPGSPAARSGLRAQDRLIEVNGQNVEGLRHAEVVASIKAREDEARLLVVDPETDEHFKRLRVTPTEEHVEGPLPSPVTNGTSPAQLNGGSACSSRSDLPGSDKDTEDGSAWKQDPFQESGLHLSPTAAEAKEKARAMRVNKRAPQMDWNRKREIFSN

SEQ ID NO: 82229 - protein, 231 aa, Homo sapiens
  Payload ID: 16366
  Gene Symbol: SLC9A3R2
  Gene Name: solute carrier family 9, subfamily A (NHE3, cation proton antiporter 3), member 3 regulator 2
  ENSP ID: ENSP00000455909
MAQRGLPPAHDPWEPKPDWAHTGSHSSEAGKKDVSGPLRELRPRLCHLRKGPQGYGFNLHSDKSRPGQYIRSVDPGSPAARSGLRAQDRLIEVNGQNVEGLRHAEVVASIKAREDEARLLVVDPETDEHFKRLRVTPTEEHVEGPLPSPVTNGTSPAQLNGGSACSSRSDLPGSDKDTEDGSAWKQDPFQESGLHLSPTAAEAKEKARAMRVNKRAPQMDWNRKREIFSNF

SEQ ID NO: 82230 - protein, 226 aa, Homo sapiens
  Payload ID: 16366
  Gene Symbol: SLC9A3R2
  Gene Name: solute carrier family 9, subfamily A (NHE3, cation proton antiporter 3), member 3 regulator 2
  Uniprot ID: Q15599
  ENSP ID: ENSP00000456895
MARSGSATPPARAPGAPPRSPPQRLVQDVSGPLRELRPRLCHLRKGPQGYGFNLHSDKSRPGQYIRSVDPGSPAARSGLRAQDRLIEVNGQNVEGLRHAEVVASIKAREDEARLLVVDPETDEHFKRLRVTPTEEHVEGPLPSPVTNGTSPAQLNGGSACSSRSDLPGSDKDTEDGSAWKQDPFQESGLHLSPTAAEAKEKARAMRVNKRAPQMDWNRKREIFSNF

SEQ ID NO: 82231 - protein, 166 aa, Homo sapiens
  Payload ID: 16366
  Gene Symbol: SLC9A3R2
  Gene Name: solute carrier family 9, subfamily A (NHE3, cation proton antiporter 3), member 3 regulator 2
  ENSP ID: ENSP00000457755
  MOD_RES (1)..(1): Any amino acid
XSHSSEAGKKDVSGPLRELRPRLCHLRKGPQGYGFNLHSDKSRPGQYIRSVDPGSPAARSGLRAQDRLIEVNGQNVEGLRHAEVVASIKAREDEARLLVVDPETDEHFKRLRVTPTEEHVEGPLPSPVTNGTSPAQLNGGSACSSRSDLPGSDKDTEEGPPSGVWD

SEQ ID NO: 82232 - protein, 798 aa, Homo sapiens
  Payload ID: 16367
  Gene Symbol: SLC9A4
  Gene Name: solute carrier family 9, subfamily A (NHE4, cation proton antiporter 4), member 4
  Uniprot ID: Q6AI14
  ENSP ID: ENSP00000295269
MALQMFVTYSPWNCLLLLVALECSEASSDLNESANSTAQYASNAWFAAASSEPEEGISVFELDYDYVQIPYEVTLWILLASLAKIGFHLYHRLPGLMPESCLLILVGALVGGIIFGTDHKSPPVMDSSIYFLYLLPPIVLEGGYFMPTRPFFENIGSILWWAVLGALINALGIGLSLYLICQVKAFGLGDVNLLQNLLFGSLISAVDPVAVLAVFEEARVNEQLYMMIFGEALLNDGITVVLYNMLIAFTKMHKFEDIETVDILAGCARFIVVGLGGVLFGIVFGFISAFITRFTQNISAIEPLIVFMFSYLSYLAAETLYLSGILAITACAVTMKKYVEENVSQTSYTTIKYFMKMLSSVSETLIFIFMGVSTVGKNHEWNWAFICFTLAFCQIWRAISVFALFYISNQFRTFPFSIKDQCIIFYSGVRGAGSFSLAFLLPLSLFPRKKMFVTATLVVIYFTVFIQGITVGPLVRYLDVKKTNKKESINEELHIRLMDHLKAGIEDVCGHWSHYQVRDKFKKFDHRYLRKILIRKNLPKSSIVSLYKKLEMKQAIEMVETGILSSTAFSIPHQAQRIQGIKRLSPEDVESIRDILTSNMYQVRQRTLSYNKYNLKPQTSEKQAKEILIRRQNTLRESMRKGHSLPWGKPAGTKNIRYLSYPYGNPQSAGRDTRAAGFSDDDSSDPGSPSITFSACSRIGSLQKQEAQEIIPMKSLHRGRKAFSFGYQRNTSQEEYLGGVRRVALRPKPLFHAVDEEGESGGESEGKASLVEVRSRWTADHGHGRDHHRSHSPLLQKK

SEQ ID NO: 82233 - protein, 896 aa, Homo sapiens
  Payload ID: 16368
  Gene Symbol: SLC9A5
  Gene Name: solute carrier family 9, subfamily A (NHE5, cation proton antiporter 5), member 5
  Uniprot ID: Q14940
  ENSP ID: ENSP00000299798
MLRAALSLLALPLAGAAEEPTQKPESPGEPPPGLELFRWQWHEVEAPYLVALWILVASLAKIVFHLSRKVTSLVPESCLLILLGLVLGGIVLAVAKKAEYQLEPGTFFLFLLPPIVLDSGYFMPSRLFFDNLGAILTYAVVGTLWNAFTTGAALWGLQQAGLVAPRVQAGLLDFLLFGSLISAVDPVAVLAVFEEVHVNETLFIIVFGESLLNDAVTVVLYKVCNSFVEMGSANVQATDYLKGVASLFVVSLGGAAVGLVFAFLLALTTRFTKRVRIIEPLLVFLLAYAAYLTAEMASLSAILAVTMCGLGCKKYVEANISHKSRTTVKYTMKTLASCAETVIFMLLGISAVDSSKWAWDSGLVLGTLIFILFFRALGVVLQTWVLNQFRLVPLDKIDQVVMSYGGLRGAVAFALVILLDRTKVPAKDYFVATTIVVVFFTVIVQGLTIKPLVKWLKVKRSEHHKPTLNQELHEHTFDHILAAVEDVVGHHGYHYWRDRWEQFDKKYLSQLLMRRSAYRIRDQIWDVYYRLNIRDAISFVDQGGHVLSSTGLTLPSMPSRNSVAETSVTNLLRESGSGACLDLQVIDTVRSGRDREDAVMHHLLCGGLYKPRRRYKASCSRHFISEDAQERQDKEVFQQNMKRRLESFKSTKHNICFTKSKPRPRKTGRRKKDGVANAEATNGKHRGLGFQDTAAVILTVESEEEEEESDSSETEKEDDEGIIFVARATSEVLQEGKVSGSLEVCPSPRIIPPSPTCAEKELPWKSGQGDLAVYVSSETTKIVPVDMQTGWNQSISSLESLASPPCNQAPILTCLPPHPRGTEEPQVPLHLPSDPRSSFAFPPSLAKAGRSRSESSADLPQQQELQPLMGHKDHTHLSPGTATSHWCIQFNRGSRL

SEQ ID NO: 82234 - protein, 175 aa, Homo sapiens
  Payload ID: 16368
  Gene Symbol: SLC9A5
  Gene Name: solute carrier family 9, subfamily A (NHE5, cation proton antiporter 5), member 5
  ENSP ID: ENSP00000455058
MLRAALSLLALPLAGAAEEPTQKPESPGEPPPGLELFRWQWHEVEAPYLVALWILVASLAKIVFHLSRKVTSLVPESCLLILLGLVLGGIVLAVAKKAEYQLEPGTFFLFLLPPIVLDSGYFMPSRLFFDNLGAILTYAVVGTLWNAFTTGWLTGLPAVWEPHLGGGPRGRASCL

SEQ ID NO: 82235 - protein, 273 aa, Homo sapiens
  Payload ID: 16368
  Gene Symbol: SLC9A5
  Gene Name: solute carrier family 9, subfamily A (NHE5, cation proton antiporter 5), member 5
  ENSP ID: ENSP00000462404
  MOD_RES (1)..(1): Any amino acid
XALWGLQQAGLVAPRVQAGLLDFLLFGSLISAVDPVAVLAVFEEVHVNETLFIIVFGESLLNDAVTVYKASCSRHFISEDAQERQDKEVFQQNMKRRLESFKSTKHNICFTKSKPRPRKTGRRKKDGVANAEATNGKHRGLGFQDTAAVILTVESEEEEEESDSSETEKEDDEGIIFVARATSEVLQEGKVSGSLEVCPSPRIIPPSPTCAEKELPWKSGQGDLAVYVSSETTKIVPVDMQTGWNQSISSLESLASPPCNQAPILTCLPPHPR

SEQ ID NO: 82236 - protein, 171 aa, Homo sapiens
  Payload ID: 16368
  Gene Symbol: SLC9A5
  Gene Name: solute carrier family 9, subfamily A (NHE5, cation proton antiporter 5), member 5
  ENSP ID: ENSP00000462446
MRRGRCLPVFHLSRKVTSLVPESCLLILLGLVLGGIVLAVAKKAEYQLEPGTFFLFLLPPIVLDSGYFMPSRLFFDNLGAILTYAVVGTLWNAFTTGAALWGLQQAGLVGLTLPSMPSRNSVAETSVTNLLRESGSGACLDLQVIDTVRSGRDREDAVMHHLLCGGLYKPR

SEQ ID NO: 82237 - protein, 178 aa, Homo sapiens
  Payload ID: 16368
  Gene Symbol: SLC9A5
  Gene Name: solute carrier family 9, subfamily A (NHE5, cation proton antiporter 5), member 5
  ENSP ID: ENSP00000464393
FFDNLGAILTYAVVGTLWNAFTTGAALWGLQQAGLVGLTLPSMPSRNSVAETSVTNLLRESGSGACLDLQVIDTVRSGRDREDAVMHHLLCGGLYKPRRRYKASCSRHFISEDAQERQDKEVFQQNMKRRLESFKSTKHNICFTKSKPRPRKTGRRKDGVANAEATNGKHRGLGFQDT

SEQ ID NO: 82238 - protein, 701 aa, Homo sapiens
  Payload ID: 16369
  Gene Symbol: SLC9A6
  Gene Name: solute carrier family 9, subfamily A (NHE6, cation proton antiporter 6), member 6
  Uniprot ID: Q92581
  ENSP ID: ENSP00000359729
MARRGWRRAPLRRGVGSSPRARRLMRPLWLLLAVGVFDWAGASDGGGGEARAMDEEIVSEKQAEESHRQDSANLLIFILLLTLTILTIWLFKHRRARFLHETGLAMIYGLLVGLVLRYGIHVPSDVNNVTLSCEVQSSPTTLLVNVSGKFYEYMLKGEISSHELNNVQDNEMLRKVTFDPEVFFNILLPPIIFYAGYSLKRRHFFRNLGSILAYAFLGTAISCFVIGSIMYGCVTLMKVTGQLAGDFYFTDCLLFGAIVSATDPVTVLAIFHELQVDVELYALLFGESVLNDAVAIVLSSSIVAYQPAGDNSHTFDVTAMFKSIGIFLGIFSGSFAMGAATGVVTALVTKFTKLREFQLLETGLFFLMSWSTFLLAEAWGFTGVVAVLFCGITQAHYTYNNLSTESQHRTKQLFELLNFLAENFIFSYMGLTLFTFQNHVFNPTFVVGAFVAIFLGRAANIYPLSLLLNLGRRSKIGSNFQHMMMFAGLRGAMAFALAIRDTATYARQMMFSTTLLIVFFTVWVFGGGTTAMLSCLHIRVGVDSDQEHLGVPENERRTTKAESAWLFRMWYNFDHNYLKPLLTHSGPPLTTTLPACCGPIARCLTSPQAYENQEQLKDDDSDLILNDGDISLTYGDSTVNTEPATSSAPRRFMGNSSEDALDRELAFGDHELVIRGTRLVLPMDDSEPPLNLLDNTRHGPA

SEQ ID NO: 82239 - protein, 669 aa, Homo sapiens
  Payload ID: 16369
  Gene Symbol: SLC9A6
  Gene Name: solute carrier family 9, subfamily A (NHE6, cation proton antiporter 6), member 6
  Uniprot ID: Q92581
  ENSP ID: ENSP00000359732
MARRGWRRAPLRRGVGSSPRARRLMRPLWLLLAVGVFDWAGASDGGGGEARAMDEEIVSEKQAEESHRQDSANLLIFILLLTLTILTIWLFKHRRARFLHETGLAMIYGLLVGLVLRYGIHVPSDVNNVTLSCEVQSSPTTLLVTFDPEVFFNILLPPIIFYAGYSLKRRHFFRNLGSILAYAFLGTAISCFVIGSIMYGCVTLMKVTGQLAGDFYFTDCLLFGAIVSATDPVTVLAIFHELQVDVELYALLFGESVLNDAVAIVLSSSIVAYQPAGDNSHTFDVTAMFKSIGIFLGIFSGSFAMGAATGVVTALVTKFTKLREFQLLETGLFFLMSWSTFLLAEAWGFTGVVAVLFCGITQAHYTYNNLSTESQHRTKQLFELLNFLAENFIFSYMGLTLFTFQNHVFNPTFVVGAFVAIFLGRAANIYPLSLLLNLGRRSKIGSNFQHMMMFAGLRGAMAFALAIRDTATYARQMMFSTTLLIVFFTVWVFGGGTTAMLSCLHIRVGVDSDQEHLGVPENERRTTKAESAWLFRMWYNFDHNYLKPLLTHSGPPLTTTLPACCGPIARCLTSPQAYENQEQLKDDDSDLILNDGDISLTYGDSTVNTEPATSSAPRRFMGNSSEDALDRELAFGDHELVIRGTRLVLPMDDSEPPLNLLDNTRHGPA

SEQ ID NO: 82240 - protein, 649 aa, Homo sapiens
  Payload ID: 16369
  Gene Symbol: SLC9A6
  Gene Name: solute carrier family 9, subfamily A (NHE6, cation proton antiporter 6), member 6
  Uniprot ID: Q92581
  ENSP ID: ENSP00000359735
MDEEIVSEKQAEESHRQDSANLLIFILLLTLTILTIWLFKHRRARFLHETGLAMIYGLLVGLVLRYGIHVPSDVNNVTLSCEVQSSPTTLLVNVSGKFYEYMLKGEISSHELNNVQDNEMLRKVTFDPEVFFNILLPPIIFYAGYSLKRRHFFRNLGSILAYAFLGTAISCFVIGSIMYGCVTLMKVTGQLAGDFYFTDCLLFGAIVSATDPVTVLAIFHELQVDVELYALLFGESVLNDAVAIVLSSSIVAYQPAGDNSHTFDVTAMFKSIGIFLGIFSGSFAMGAATGVVTALVTKFTKLREFQLLETGLFFLMSWSTFLLAEAWGFTGVVAVLFCGITQAHYTYNNLSTESQHRTKQLFELLNFLAENFIFSYMGLTLFTFQNHVFNPTFVVGAFVAIFLGRAANIYPLSLLLNLGRRSKIGSNFQHMMMFAGLRGAMAFALAIRDTATYARQMMFSTTLLIVFFTVWVFGGGTTAMLSCLHIRVGVDSDQEHLGVPENERRTTKAESAWLFRMWYNFDHNYLKPLLTHSGPPLTTTLPACCGPIARCLTSPQAYENQEQLKDDDSDLILNDGDISLTYGDSTVNTEPATSSAPRRFMGNSSEDALDRELAFGDHELVIRGTRLVLPMDDSEPPLNLLDNTRHGPA

SEQ ID NO: 82241 - protein, 184 aa, Homo sapiens
  Payload ID: 16369
  Gene Symbol: SLC9A6
  Gene Name: solute carrier family 9, subfamily A (NHE6, cation proton antiporter 6), member 6
  ENSP ID: ENSP00000486743
MDEEIVSEKQAEESHRQDSANLLIFILLLTLTILTIWLFKHRRARFLHETGLAMIYGLLVGLVLRYGIHVPSDVNNVTLSCEVQSSPTTLLVNVSGKFYEYMLKGEISSHELNNVQDNEMLRKVTFDPEVFFNILLPPIIFYAGYSLKRRHFFRNLGSILAYAFLGTAISCFVIGSIMYGCVTL

SEQ ID NO: 82242 - protein, 206 aa, Homo sapiens
  Payload ID: 16369
  Gene Symbol: SLC9A6
  Gene Name: solute carrier family 9, subfamily A (NHE6, cation proton antiporter 6), member 6
  ENSP ID: ENSP00000487486
  MOD_RES (1)..(1): Any amino acid
XYARQMMFSTTLLIVFFTVWVFGGGTTAMLSCLHIRYCARLWGYRDELRHGLYPQGTHSLFGETDRVGVDSDQEHLGVPENERRTTKAESAWLFRMWYNFDHNYLKPLLTHSGPPLTTTLPACCGPIARCLTSPQAYENQEQLKDDDSDLILNDGDISLTYGDSTVNTEPATSSAPRRFMGNSSEDALDRELAFGDHELVIRGTRL

SEQ ID NO: 82243 - protein, 725 aa, Homo sapiens
  Payload ID: 16370
  Gene Symbol: SLC9A7
  Gene Name: solute carrier family 9, subfamily A (NHE7, cation proton antiporter 7), member 7
  Uniprot ID: Q96T83
  ENSP ID: ENSP00000330320
MEPGDAARPGSGRATGAPPPRLLLLPLLLGWGLRVAAAASASSSGAAAEDSSAMEELATEKEAEESHRQDSVSLLTFILLLTLTILTIWLFKHRRVRFLHETGLAMIYGLIVGVILRYGTPATSGRDKSLSCTQEDRAFSTLLVNVSGKFFEYTLKGEISPGKINSVEQNDMLRKVTFDPEVFFNILLPPIIFHAGYSLKKRHFFRNLGSILAYAFLGTAVSCFIIGNLMYGVVKLMKIMGQLSDKFYYTDCLFFGAIISATDPVTVLAIFNELHADVDLYALLFGESVLNDAVAIVLSSSIVAYQPAGLNTHAFDAAAFFKSVGIFLGIFSGSFTMGAVTGVNANVTKFTKLHCFPLLETALFFLMSWSTFLLAEACGFTGVVAVLFCGITQAHYTYNNLSVESRSRTKQLFEVLHFLAENFIFSYMGLALFTFQKHVFSPIFIIGAFVAIFLGRAAHIYPLSFFLNLGRRHKIGWNFQHMMMFSGLRGAMAFALAIRDTASYARQMMFTTTLLIVFFTVWIIGGGTTPMLSWLNIRVGVEEPSEEDQNEHHWQYFRVGVDPDQDPPPNNDSFQVLQGDGPDSARGNRTKQESAWIFRLWYSFDHNYLKPILTHSGPPLTTTLPAWCGLLARCLTSPQVYDNQEPLREEDSDFILTEGDLTLTYGDSTVTANGSSSSHTASTSLEGSRRTKSSSEEVLERDLGMGDQKVSSRGTRLVFPLEDNA

SEQ ID NO: 82244 - protein, 726 aa, Homo sapiens
  Payload ID: 16370
  Gene Symbol: SLC9A7
  Gene Name: solute carrier family 9, subfamily A (NHE7, cation proton antiporter 7), member 7
  ENSP ID: ENSP00000480916
MEPGDAARPGSGRATGAPPPRLLLLPLLLGWGLRVAAAASASSSGAAAEDSSAMEELATEKEAEESHRQDSVSLLTFILLLTLTILTIWLFKHRRVRFLHETGLAMIYGLIVGVILRYGTPATSGRDKSLSCTQEDRAFSTLLVNVSGKFFEYTLKGEISPGKINSVEQNDMLRKVTFDPEVFFNILLPPIIFHAGYSLKKRHFFRNLGSILAYAFLGTAVSCFIIGNLMYGVVKLMKIMGQLSDKFYYTDCLFFGAIISATDPVTVLAIFNELHADVDLYALLFGESVLNDAVAIVLSSSIVAYQPAGLNTHAFDAAAFFKSVGIFLGIFSGSFTMGAVTGVVTALVTKFTKLHCFPLLETALFFLMSWSTFLLAEACGFTGVVAVLFCGITQAHYTYNNLSVESRSRTKQLFEVLHFLAENFIFSYMGLALFTFQKHVFSPIFIIGAFVAIFLGRAAHIYPLSFFLNLGRRHKIGWNFQHMMMFSGLRGAMAFALAIRDTASYARQMMFTTTLLIVFFTVWIIGGGTTPMLSWLNIRVGVEEPSEEDQNEHHWQYFRVGVDPDQDPPPNNDSFQVLQGDGPDSARGNRTKQESAWIFRLWYSFDHNYLKPILTHSGPPLTTTLPAWCGLLARCLTSPQVYDNQEPLREEDSDFILTEGDLTLTYGDSTVTANGSSSSHTASTSLEGSRRTKSSSEEVLERDLGMGDQKVSSRGTRLVFPLEDNA

SEQ ID NO: 82245 - protein, 581 aa, Homo sapiens
  Payload ID: 16371
  Gene Symbol: SLC9A8
  Gene Name: solute carrier family 9, subfamily A (NHE8, cation proton antiporter 8), member 8
  Uniprot ID: Q9Y2E8
  ENSP ID: ENSP00000354966
MGEKMAEEERFPNTTHEGFNVTLHTTLVVTTKLVLPTPGKPILPVQTGEQAQQEEQSSGMTIFFSLLVLAICIILVHLLIRYRLHFLPESVAVVSLGILMGAVIKIIEFKKLANWKEEEMFRPNMFFLLLLPPIIFESGYSLHKGNFFQNIGSITLFAVFGTAISAFVVGGGIYFLGQADVISKLNMTDSFAFGSLISAVDPVATIAIFNALHVDPVLNMLVFGESILNDAVSIVLTNTAEGLTRKNMSDVSGWQTFLQALDYFLKMFFGSAALGTLTGLISALVLKHIDLRKTPSLEFGMMIIFAYLPYGLAEGISLSGIMAILFSGIVMSHYTHHNLSPVTQILMQQTLRTVAFLCETCVFAFLGLSIFSFPHKFEISFVIWCIVLVLFGRAVNIFPLSYLLNFFRDHKITPKMMFIMWFSGLRGAIPYALSLHLDLEPMEKRQLIGTTTIVIVLFTILLLGGSTMPLIRLMDIEDAKAHRRNKKDVNLSKTEKMGNTVESEHLSELTEEEYEAHYIRRQDLKGFVWLDAKYLNPFFTRRLTQEDLHHGRIQMKTLTNKWYEEVRQGPSGSEDDEQELL

SEQ ID NO: 82246 - protein, 597 aa, Homo sapiens
  Payload ID: 16371
  Gene Symbol: SLC9A8
  Gene Name: solute carrier family 9, subfamily A (NHE8, cation proton antiporter 8), member 8
  Uniprot ID: Q9Y2E8
  ENSP ID: ENSP00000416418
MGEKMAEEERFPNTTHEGFNVTLHTTLVVTTKLVLPTPGKPILPVQTGEQAQQEEQSSGMTIFFSLLVLAICIILVHLLIRYRLHFLPESVAVVSLGILMGAVIKIIEFKKLANWKEEEMFRPNMFFLLLLPPIIFESGYSLHKGNFFQNIGSITLFAVFGTAISAFVVGGGIYFLGQGFFFVCVCVFVCFILQADVISKLNMTDSFAFGSLISAVDPVATIAIFNALHVDPVLNMLVFGESILNDAVSIVLTNTAEGLTRKNMSDVSGWQTFLQALDYFLKMFFGSAALGTLTGLISALVLKHIDLRKTPSLEFGMMIIFAYLPYGLAEGISLSGIMAILFSGIVMSHYTHHNLSPVTQILMQQTLRTVAFLCETCVFAFLGLSIFSFPHKFEISFVIWCIVLVLFGRAVNIFPLSYLLNFFRDHKITPKMMFIMWFSGLRGAIPYALSLHLDLEPMEKRQLIGTTTIVIVLFTILLLGGSTMPLIRLMDIEDAKAHRRNKKDVNLSKTEKMGNTVESEHLSELTEEEYEAHYIRRQDLKGFVWLDAKYLNPFFTRRLTQEDLHHGRIQMKTLTNKWYEEVRQGPSGSEDDEQELL

SEQ ID NO: 82247 - protein, 645 aa, Homo sapiens
  Payload ID: 16372
  Gene Symbol: SLC9A9
  Gene Name: solute carrier family 9, subfamily A (NHE9, cation proton antiporter 9), member 9
  Uniprot ID: Q8IVB4
  ENSP ID: ENSP00000320246
MERQSRVMSEKDEYQFQHQGAVELLVFNFLLILTILTIWLFKNHRFRFLHETGGAMVYGLIMGLILRYATAPTDIESGTVYDCVKLTFSPSTLLVNITDQVYEYKYKREISQHNINPHQGNAILEKMTFDPEIFFNVLLPPIIFHAGYSLKKRHFFQNLGSILTYAFLGTAISCIVIGLIMYGFVKAMIHAGQLKNGDFHFTDCLFFGSLMSATDPVTVLAIFHELHVDPDLYTLLFGESVLNDAVAIVLTYSISIYSPKENPNAFDAAAFFQSVGNFLGIFAGSFAMGSAYAIITALLTKFTKLCEFPMLETGLFFLLSWSAFLSAEAAGLTGIVAVLFCGVTQAHYTYNNLSSDSKIRTKQLFEFMNFLAENVIFCYMGLALFTFQNHIFNALFILGAFLAIFVARACNIYPLSFLLNLGRKQKIPWNFQHMMMFSGLRGAIAFALAIRNTESQPKQMMFTTTLLLVFFTVWVFGGGTTPMLTWLQIRVGVDLDENLKEDPSSQHQEANNLDKNMTKAESARLFRMWYSFDHKYLKPILTHSGPPLTTTLPEWCGPISRLLTSPQAYGEQLKEDDVECIVNQDELAINYQEQASSPCSPPARLGLDQKASPQTPGKENIYEGDLGLGGYELKLEQTLGQSQLN

SEQ ID NO: 82248 - protein, 147 aa, Homo sapiens
  Payload ID: 16372
  Gene Symbol: SLC9A9
  Gene Name: solute carrier family 9, subfamily A (NHE9, cation proton antiporter 9), member 9
  ENSP ID: ENSP00000418627
MERQSRVMSEKDEYQFQHQGAVELLVFNFLLILTILTIWLFKNHRFRFLHETGGAMVYGLIMGLILRYATAPTDIESGTVYDCVKLTFSPSTLLVNITDQVYEYKYKREISQHNINPHQGNAILEKRHFFQNLGSILTYAFLGTAIS

SEQ ID NO: 82249 - protein, 61 aa, Homo sapiens
  Payload ID: 16372
  Gene Symbol: SLC9A9
  Gene Name: solute carrier family 9, subfamily A (NHE9, cation proton antiporter 9), member 9
  ENSP ID: ENSP00000419090
MERQSRVMSEKDEYQFQHQGAVELLVFNFLLILTILTIWLFKNHRFRFLHETGGAMVYDDI

SEQ ID NO: 82250 - protein, 515 aa, Homo sapiens
  Payload ID: 16373
  Gene Symbol: SLC9B1
  Gene Name: solute carrier family 9, subfamily B (NHA1, cation proton antiporter 1), member 1
  Uniprot ID: Q4ZJI4
  ENSP ID: ENSP00000296422
MHTTESKNEHLEDENFQTSTTPQSLIDPNNTAQEETKTVLSDTEEIKPQTKKETYISCPLRGVLNVIITNGVILFVIWCMTWSILGSEALPGGNLFGLFIIFYSAIIGGKILQLIRIPLVPPLPPLLGMLLAGFTIRNVPFINEHVHVPNTWSSILRSIALTIILIRAGLGLDPQALRHLKVVCFRLAVGPCLMEASAAAVFSHFIMKFPWQWAFLLGFVLGAVSPAVVVPYMMVLQENGYGVEEGIPTLLMAASSMDDILAITGFNTCLSIVFSSGGILNNAIASIRNVCISLLAGIVLGFFVRYFPSEDQKKLTLKRGFLVLTMCVSAVLGSQRIGLHGSGGLCTLVLSFIAGTKWSQEKMKVQKIITTVWDIFQPLLFGLVGAEVSVSSLESNIVGISVATLSLALCVRILTTYLLMCFAGFSFKEKIFIALAWMPKATVQAVLGPLALETARVSAPHLEPYAKDVMTVAFLAILITAPNGALLMGILGPKMLTRHYDPSKIKLQLSTLEHH

SEQ ID NO: 82251 - protein, 475 aa, Homo sapiens
  Payload ID: 16373
  Gene Symbol: SLC9B1
  Gene Name: solute carrier family 9, subfamily B (NHA1, cation proton antiporter 1), member 1
  Uniprot ID: Q4ZJI4
  ENSP ID: ENSP00000378269
MHTTESKNEHLEDENFQTSTTPQSLIDPNNTAQEETKTVLSDTEEIKPQTKKETYISCPLRGVLNVIITNGVILFVIWCMTWSILGSEALPGGNLFGLFIIFYSAIIGGKILQLIRIPLVPPLPPLLGMLLAGFTIRNVPFINEHVHVPNTWSSILRSIALTIILIRAGLGLDPQALRHLKVVCFRLAVGPCLMEASAAAVFSHFIMKFPWQWAFLLGFVLGAVSPAVVVPYMMVLQENGYGVEEGIPTLLMAASSMDDILAITGFNTCLSIVFSSGGILNNAIASIRNVCISLLAGIVLGFFVRYFPSEDQKKLTLKRGFLVLTMCVSAVLGSQRIGLHGSGGLCTLVLSFIAGTKWSQEKMKVQKIITTVWDIFQPLLFGLVGAEVSVSSLESNIVGISVATLSLALCVRILTTYLLMCFAGFSFKEKIFIALAWMPKATVQINQAILLLFLLREEWTNCKVAKKCEYTKERQ

SEQ ID NO: 82252 - protein, 48 aa, Homo sapiens
  Payload ID: 16373
  Gene Symbol: SLC9B1
  Gene Name: solute carrier family 9, subfamily B (NHA1, cation proton antiporter 1), member 1
  ENSP ID: ENSP00000423072
MHTTESKNEHLEDENFQTSTTPQFCSRCCLSCCCCPLHDGAARKWIWC

SEQ ID NO: 82253 - protein, 127 aa, Homo sapiens
  Payload ID: 16373
  Gene Symbol: SLC9B1
  Gene Name: solute carrier family 9, subfamily B (NHA1, cation proton antiporter 1), member 1
  ENSP ID: ENSP00000425544
TGGILNNAIASIRNVCISLLAGIVLGFFVRYFPSEDQKKLTLKRGFLVLTMCVSAVLGSQRIGLHGSGGLCTLVLSFIAGTKWSQEKMKVQKIITTVWDIFQPLLFGLVGAEVSVSSLESNIVGKNN

SEQ ID NO: 82254 - protein, 73 aa, Homo sapiens
  Payload ID: 16373
  Gene Symbol: SLC9B1
  Gene Name: solute carrier family 9, subfamily B (NHA1, cation proton antiporter 1), member 1
  Uniprot ID: Q4ZJI4
  ENSP ID: ENSP00000425913
MHTTESKNEHLEDENFQTSTTPQSLIDPNNTAQEETKTVLSDTEEIKPQTKKETYISCPLRGVLNVIITNVLF

SEQ ID NO: 82255 - protein, 254 aa, Homo sapiens
  Payload ID: 16373
  Gene Symbol: SLC9B1
  Gene Name: solute carrier family 9, subfamily B (NHA1, cation proton antiporter 1), member 1
  ENSP ID: ENSP00000426056
MHTTESKNEHLEDENFQTSTTPQSLIDPNNTAQEETKTVLSDTEEIKPQTKKETYISCPLRGVLNVIITNGMLLAGFTIRNVPFINEHVHVPNTWSSILRSIALTIILIRAGLGLDPQALRHLKVVCFRLAVGPCLMEASAAAVFSHFIMKFPWQWAFLLGFVLGAVSPAVVVPYMMVLQENGYGVEEGIPTLLMAASSMDDILAITGFNTCLSIVFSSGGILNNAIASIRNVCISLLAGIVLGFFVRYFPSED

SEQ ID NO: 82256 - protein, 49 aa, Homo sapiens
  Payload ID: 16373
  Gene Symbol: SLC9B1
  Gene Name: solute carrier family 9, subfamily B (NHA1, cation proton antiporter 1), member 1
  ENSP ID: ENSP00000426325
MHTTESKNEHLEDENFQTSTTPQSLIDPNNTAQEETKTVLSDTEEIKPQ

SEQ ID NO: 82257 - protein, 200 aa, Homo sapiens
  Payload ID: 16373
  Gene Symbol: SLC9B1
  Gene Name: solute carrier family 9, subfamily B (NHA1, cation proton antiporter 1), member 1
  ENSP ID: ENSP00000426584
MHTTESKNEHLEDENFQTSTTPQSLIDPNNTAQEETKTVLSDTEEIKPQTKKETYISCPLRGVLNVIITNGVILFVIWCMTWSILGSEALPGGNLFGLFIIFYSAIIGGKILQLIRIPLVPPLPPLLGMLLAGFTIRNVPFINEHVHVPNTWSSILRSIALTIILIRAGLGLDPQFCSRCCLSCCCCPLHDGAARKWIWC

SEQ ID NO: 82258 - protein, 73 aa, Homo sapiens; identical to SEQ ID NO: 82254
  Payload ID: 16373
  Gene Symbol: SLC9B1
  Gene Name: solute carrier family 9, subfamily B (NHA1, cation proton antiporter 1), member 1
  Uniprot ID: Q4ZJI4
  ENSP ID: ENSP00000426926

SEQ ID NO: 82259 - protein, 537 aa, Homo sapiens
  Payload ID: 16374
  Gene Symbol: SLC9B2
  Gene Name: solute carrier family 9, subfamily B (NHA2, cation proton antiporter 2), member 2
  Uniprot ID: Q86UD5
  ENSP ID: ENSP00000354574
MGDEDKRITYEDSEPSTGMNYTPSMHQEAQEETVMKLKGIDANEPTEGSILLKSSEKKLQETPTEANHVQRLRQMLACPPHGLLDRVITNVTIIVLLWAVVWSITGSECLPGGNLFGIIILFYCAIIGGKLLGLIKLPTLPPLPSLLGMLLAGFLIRNIPVINDNVQIKHKWSSSLRSIALSIILVRAGLGLDSKALKKLKGVCVRLSMGPCIVEACTSALLAHYLLGLPWQWGFILGFVLGAVSPAVVVPSMLLLQGGGYGVEKGVPTLLMAAGSFDDILAITGFNTCLGIAFSTGSTVFNVLRGVLEVVIGVATGSVLGFFIQYFPSRDQDKLVCKRTFLVLGLSVLAVFSSVHFGFPGSGGLCTLVMAFLAGMGWTSEKAEVEKIIAVAWDIFQPLLFGLIGAEVSIASLRPETVGLCVATVGIAVLIRILTTFLMVCFAGFNLKEKIFISFAWLPKATVQAAIGSVALDTARSHGEKQLEDYGMDVLTVAFLSILITAPIGSLLIGLLGPRLLQKVEHQNKDEEVQGETSVQV

SEQ ID NO: 82260 - protein, 537 aa, Homo sapiens; identical to SEQ ID NO: 82259
  Payload ID: 16374
  Gene Symbol: SLC9B2
  Gene Name: solute carrier family 9, subfamily B (NHA2, cation proton antiporter 2), member 2
  Uniprot ID: Q86UD5
  ENSP ID: ENSP00000378265

SEQ ID NO: 82261 - protein, 354 aa, Homo sapiens
  Payload ID: 16374
  Gene Symbol: SLC9B2
  Gene Name: solute carrier family 9, subfamily B (NHA2, cation proton antiporter 2), member 2
  ENSP ID: ENSP00000421943
VWSITGSECLPGGNLFGIIILFYCAIIGGKLLGLIKLPTLPPLPSLLGMLLAGFLIRNIPVINDNVQIKHKWSSSLRSIALSIILVRAGLGLDSKALKKLKGVCVRLSMGPCIVEACTSALLAHYLLGLPWQWGFILGFVLGAVSPAVVVPSMLLLQGGGYGVEKGVPTLLMAAGSFDDILAITGFNTCLGIAFSTGSTVFNVLRGVLEVVIGVATGSVLGFFIQYFPSRDQDKLVCKRTFLVLGLSVLAVFSSVHFGFPGSGGLCTLVMAFLAGMGWTSEKAEVEKIIAVAWDIFQPLLFGLIGAEVSIASLRPETVGSADSITGNFGTERPKLLGPPSTQLRFHFFHIQLST

SEQ ID NO: 82262 - protein, 480 aa, Homo sapiens
  Payload ID: 16374
  Gene Symbol: SLC9B2
  Gene Name: solute carrier family 9, subfamily B (NHA2, cation proton antiporter 2), member 2
  ENSP ID: ENSP00000422477
MGDEDKRITYEDSEPSTGMNYTPSMHQEAQEETVMKLKGIDANEPTEGSILLKSSEKKLQETPTEANHVQRLRQMLACPPHGLLDRVITNGMLLAGFLIRNIPVINDNVQIKHKWSSSLRSIALSIILVRAGLGLDSKALKKLKGVCVRLSMGPCIVEACTSALLAHYLLGLPWQWGFILGFVLGAVSPAVVVPSMLLLQGGGYGVEKGVPTLLMAAGSFDDILAITGFNTCLGIAFSTGSTVFNVLRGVLEVVIGVATGSVLGFFIQYFPSRDQDKLVCKRTFLVLGLSVLAVFSSVHFGFPGSGGLCTLVMAFLAGMGWTSEKAEVEKIIAVAWDIFQPLLFGLIGAEVSIASLRPETVGLCVATVGIAVLIRILTTFLMVCFAGFNLKEKIFISFAWLPKATVQAAIGSVALDTARSHGEKQLEDYGMDVLTVAFLSILITAPIGSLLIGLLGPRLLQKVEHQNKDEEVQGETSVQV

SEQ ID NO: 82263 - protein, 112 aa, Homo sapiens
  Payload ID: 16374
  Gene Symbol: SLC9B2
  Gene Name: solute carrier family 9, subfamily B (NHA2, cation proton antiporter 2), member 2
  ENSP ID: ENSP00000423496
MATDDEKLRLPMLRVVNRCVYSTTKAAVIGLTKSVAADFIQQGIRCNCVCPGTVDTPSLQERIQARGNPEEARNDFLKRQKTGRFATAEEIAMLCVYLASDEISFLFPVSSS

SEQ ID NO: 82264 - protein, 417 aa, Homo sapiens
  Payload ID: 16374
  Gene Symbol: SLC9B2
  Gene Name: solute carrier family 9, subfamily B (NHA2, cation proton antiporter 2), member 2
  ENSP ID: ENSP00000425385
MGDEDKRITYEDSEPSTGMNYTPSMHQEAQEETVMKLKGIDANEPTEGSILLKSSEKKLQETPTEANHVQRLRQMLACPPHGLLDRVITNGMLLAGFLIRNIPVINDNVQIKHKWSSSLRSIALSIILVRAGLGLDSKALKKLKGVCVRLSMGPCIVEACTSALLAHYLLGLPWQWGFILGFVLGAVSPAVVVPSMLLLQGGGYGVEKGVPTLLMAAGSFDDILAITGFNTCLGIAFSTGSTVFNVLRGVLEVVIGVATGSVLGFFIQYFPSRDQDKLVCKRTFLVLGLSVLAVFSSVHFGFPGSGGLCTLVMAFLAGMGWTSEKAEVEKIIAVAWDIFQPLLFGLIGAEVSIASLRPETVGCNRICGFGHSKVTWRETIRRLWNGCVDSGIFVHPHHSPNWKSAYWFTGPQASAES

SEQ ID NO: 82265 - protein, 143 aa, Homo sapiens
  Payload ID: 16374
  Gene Symbol: SLC9B2
  Gene Name: solute carrier family 9, subfamily B (NHA2, cation proton antiporter 2), member 2
  ENSP ID: ENSP00000426305
MGDEDKRITYEDSEPSTGMNYTPSMHQEAQEETVMKLKGIDANEPTEGSILLKSSEKKLQETPTEANHVQRLRQMLACPPHGLLDRVITNVTIIVLLWAVVWSITGSECLPGGNLFGIIILFYCAIIGGKLLGLIKLPTLPPL

SEQ ID NO: 82266 - protein, 1177 aa, Homo sapiens
  Payload ID: 16375
  Gene Symbol: SLC9C1
  Gene Name: solute carrier family 9, subfamily C (Na+-transporting carboxylic acid decarboxylase), member 1
  Uniprot ID: Q4G0N8
  ENSP ID: ENSP00000306627
MAGIFKEFFFSTEDLPEVILTLSLISSIGAFLNRHLEDFPIPVPVILFLLGCSFEVLSFTSSQVQRYANAIQWMSPDLFFRIFTPVVFFTTAFDMDTYMLQKLFWQILLISIPGFLVNYILVLWHLASVNQLLLKPTQWLLFSAILVSSDPMLTAAAIRDLGLSRSLISLINGESLMTSVISLITFTSIMDFDQRLQSKRNHTLAEEIVGGICSYIIASFLFGILSSKLIQFWMSTVFGDDVNHISLIFSILYLIFYICELVGMSGIFTLAIVGLLLNSTSFKAAIEETLLLEFWTFLSRIAFLMVFTFFGLLIPAHTYLYIEFVDIYYSLNIYLTLIVLRFLTLLLISPVLSRVGHEFSWRWIFIMVCSEMKGMPNINMALLLAYSDLYFGSDKEKSQILFHGVLVCLITLVVNRFILPVAVTILGLRDATSTKYKSVCCTFQHFQELTKSAASALKFDKDLANADWNMIEKAITLENPYMLNEEETTEHQKVKCPHCNKEIDEIFNTEAMELANRRLLSAQIASYQRQYRNEILSQSAVQVLVGAAESFGEKKGKCMSLDTIKNYSESQKTVTFARKLLLNWVYNTRKEKEGPSKYFFFRICHTIVFTEEFEHVGYLVILMNIFPFIISWISQLNVIYHSELKHTNYCFLTLYILEALLKIAAMRKDFFSHAWNIFELAITLIGILHVILIEIDTIKYIFNETEVIVFIKVVQFFRILRIFKLIAPKLLQIIDKRMSHQKTFWYGILKGYVQGEADIMTIIDQITSSKQIKQMLLKQVIRNMEHAIKELGYLEYDHPEIAVTVKTKEEINVMLNMATEILKAFGLKGIISKTEGAGINKLIMAKKKEVLDSQSIIRPLTVEEVLYHIPWLDKNKDYINFIQEKAKVVTFDCGNDIFEEGDEPKGIYIIISGMVKLEKSKPGLGIDQMVESKEKDFPIIDTDYMLSGEIIGEINCLTNEPMKYSATCKTVVETCFIPKTHLYDAFEQCSPLIKQKMWLKLGLAITARKIREHLSYEDWNYNMQLKLSNIYVVDIPMSTKTDIYDENLIYVILIHGAVEDCLLRKTYRAPFLIPITCHQIQSIEDFTKVVIIQTPINMKTFRRNIRKFVPKHKSYLTPGLIGSVGTLEEGIQEERNVKEDGAHSAATARSPQPCSLLGTKFNCKESPRINLRKVRKE

SEQ ID NO: 82267 - protein, 85 aa, Homo sapiens
  Payload ID: 16375
  Gene Symbol: SLC9C1
  Gene Name: solute carrier family 9, subfamily C (Na+-transporting carboxylic acid decarboxylase), member 1
  ENSP ID: ENSP00000417274
MSPDLFFRIFTPVVFFTTAFDMDTYMLQKLFWQILLISIPGFLVNYILVLWHLASVNQLLLKPTQWLLFSAILVSSDPMLTAAAI

SEQ ID NO: 82268 - protein, 241 aa, Homo sapiens
  Payload ID: 16375
  Gene Symbol: SLC9C1
  Gene Name: solute carrier family 9, subfamily C (Na+-transporting carboxylic acid decarboxylase), member 1
  ENSP ID: ENSP00000418371
MAGIFKEFFFSTEDLPEVILTLSLISSIGAFLNRHLEDFPIPVPVILFLLGCSFEVLSFTSSQVQRYANAIQWMSPDLFFRIFTPVVFFTTAFDMDTYMLQKLFWQILLISIPGFLVNYILVLWHLASVNQLLLKPTQWLLFSAILVSSDPMLTAAAIRDLGLSRSLISLINGESLMTSVISLITFTSIMDFDQRLQSKRNHTLGELVGMSGIFTLAIVGLLLNSTSFKAAIEETLLLESS

SEQ ID NO: 82269 - protein, 1129 aa, Homo sapiens
  Payload ID: 16375
  Gene Symbol: SLC9C1
  Gene Name: solute carrier family 9, subfamily C (Na+-transporting carboxylic acid decarboxylase), member 1
  Uniprot ID: Q4G0N8
  ENSP ID: ENSP00000420688
MAGIFKEFFFSTEDLPEVILTLSLISSIGAFLNRHLEDFPIPVPVILFLLGCSFEVLSFTSSQVQRYANAIQWMSPDLFFRIFTPVVFFTTAFDMDTYMLQKLFWQILLISIPGFLVNYILVLWHLASVNQLLLKPTQWLLFSAILVSSDPMLTAAAIRDLGLSRSLISLINGESLMTSVISLITFTSIMDFDQRLQSKRNHTLAEEIVGGICSYIIASFLFGILSSKLIQFWMSTVFGDDVNHISLIFSILYLIFYICELVGMSGIFTLAIVGLLLNSTSFKAAIEETLLLEFLTLLLISPVLSRVGHEFSWRWIFIMVCSEMKGMPNINMALLLAYSDLYFGSDKEKSQILFHGVLVCLITLVVNRFILPVAVTILGLRDATSTKYKSVCCTFQHFQELTKSAASALKFDKDLANADWNMIEKAITLENPYMLNEEETTEHQKVKCPHCNKEIDEIFNTEAMELANRRLLSAQIASYQRQYRNEILSQSAVQVLVGAAESFGEKKGKCMSLDTIKNYSESQKTVTFARKLLLNWVYNTRKEKEGPSKYFFFRICHTIVFTEEFEHVGYLVILMNIFPFIISWISQLNVIYHSELKHTNYCFLTLYILEALLKIAAMRKDFFSHAWNIFELAITLIGILHVILIEIDTIKYIFNETEVIVFIKVVQFFRILRIFKLIAPKLLQIIDKRMSHQKTFWYGILKGYVQGEADIMTIIDQITSSKQIKQMLLKQVIRNMEHAIKELGYLEYDHPEIAVTVKTKEEINVMLNMATEILKAFGLKGIISKTEGAGINKLIMAKKKEVLDSQSIIRPLTVEEVLYHIPWLDKNKDYINFIQEKAKVVTFDCGNDIFEEGDEPKGIYIIISGMVKLEKSKPGLGIDQMVESKEKDFPIIDTDYMLSGEIIGEINCLTNEPMKYSATCKTVVETCFIPKTHLYDAFEQCSPLIKQKMWLKLGLAITARKIREHLSYEDWNYNMQLKLSNIYVVDIPMSTKTDIYDENLIYVILIHGAVEDCLLRKTYRAPFLIPITCHQIQSIEDFTKVVIIQTPINMKTFRRNIRKFVPKHKSYLTPGLIGSVGTLEEGIQEERNVKEDGAHSAATARSPQPCSLLGTKFNCKESPRINLRKVRKE

SEQ ID NO: 82270 - protein, 670 aa, Homo sapiens
  Payload ID: 16376
  Gene Symbol: SLCO1A2
  Gene Name: solute carrier organic anion transporter family, member 1A2
  Uniprot ID: P46721
  ENSP ID: ENSP00000305974
MGETEKRIETHRIRCLSKLKMFLLAITCAFVSKTLSGSYMNSMLTQIERQFNIPTSLVGFINGSFEIGNLLLIIFVSYFGTKLHRPIMIGIGCVVMGLGCFLKSLPHFLMNQYEYESTVSVSGNLSSNSFLCMENGTQILRPTQDPSECTKEVKSLMWVYVLVGNIVRGMGETPILPLGISYIEDFAKFENSPLYIGLVETGAIIGPLIGLLLASFCANVYVDTGFVNTDDLIITPTDTRWVGAWWFGFLICAGVNVLTAIPFFFLPNTLPKEGLETNADIIKNENEDKQKEEVKKEKYGITKDFLPFMKSLSCNPIYMLFILVSVIQFNAFVNMISFMPKYLEQQYGISSSDAIFLMGIYNLPPICIGYIIGGLIMKKFKITVKQAAHIGCWLSLLEYLLYFLSFLMTCENSSVVGINTSYEGIPQDLYVENDIFADCNVDCNCPSKIWDPVCGNNGLSYLSACLAGCETSIGTGINMVFQNCSCIQTSGNSSAVLGLCDKGPDCSLMLQYFLILSAMSSFIYSLAAIPGYMVLLRCMKSEEKSLGVGLHTFCTRVFAGIPAPIYFGALMDSTCLHWGTLKCGESGACRIYDSTTFRYIYLGLPAALRGSSFVPALIILILLRKCHLPGENASSGTELIETKVKGKENECKDIYQKSTVLKDDELKTKL

SEQ ID NO: 82271 - protein, 99 aa, Homo sapiens
  Payload ID: 16376
  Gene Symbol: SLCO1A2
  Gene Name: solute carrier organic anion transporter family, member 1A2
  ENSP ID: ENSP00000390572
MGETEKRIETHRIRCLSKLKMFLLAITCAFVSKTLSGSYMNSMLTQIERQFNIPTSLVGFINGSFEIGNLLLIIFVSYFGTKLHRPIMIGIGCVVMGLG

SEQ ID NO: 82272 - protein, 51 aa, Homo sapiens
  Payload ID: 16376
  Gene Symbol: SLCO1A2
  Gene Name: solute carrier organic anion transporter family, member 1A2
  ENSP ID: ENSP00000390672
MGETEKRIETHRIRCLSKLKMFLLAITCAFVSKTLSGSYMNSMLTQIERQF

SEQ ID NO: 82273 - protein, 13 aa, Homo sapiens
  Payload ID: 16376
  Gene Symbol: SLCO1A2
  Gene Name: solute carrier organic anion transporter family, member 1A2
  ENSP ID: ENSP00000392124
MGETEKRIETHRI

SEQ ID NO: 82274 - protein, 538 aa, Homo sapiens
  Payload ID: 16376
  Gene Symbol: SLCO1A2
  Gene Name: solute carrier organic anion transporter family, member 1A2
  ENSP ID: ENSP00000394854
MENGTQILRPTQDPSECTKEVKSLMWVYVLVGNIVRGMGETPILPLGISYIEDFAKFENSPLYIGLVETGAIIGPLIGLLLASFCANVYVDTGFVNTDDLIITPTDTRWVGAWWFGFLICAGVNVLTAIPFFFLPNTLPKEGLETNADIIKNENEDKQKEEVKKEKYGITKDFLPFMKSLSCNPIYMLFILVSVIQFNAFVNMISFMPKYLEQQYGISSSDAIFLMGIYNLPPICIGYIIGGLIMKKFKITVKQAAHIGCWLSLLEYLLYFLSFLMTCENSSVVGINTSYEGIPQDLYVENDIFADCNVDCNCPSKIWDPVCGNNGLSYLSACLAGCETSIGTGINMVFQNCSCIQTSGNSSAVLGLCDKGPDCSLMLQYFLILSAMSSFIYSLAAIPGYMVLLRCMKSEEKSLGVGLHTFCTRVFAGIPAPIYFGALMDSTCLHWGTLKCGESGACRIYDSTTFRYIYLGLPAALRGSSFVPALIILILLRKCHLPGENASSGTELIETKVKGKENECKDIYQKSTVLKDDELKTKL

SEQ ID NO: 82275 - protein, 88 aa, Homo sapiens
  Payload ID: 16376
  Gene Symbol: SLCO1A2
  Gene Name: solute carrier organic anion transporter family, member 1A2
  ENSP ID: ENSP00000401195
MGETEKRIETHRIRCLSKLKMFLLAITCAFVSKTLSGSYMNSMLTQIERQFNIPTSLVGFINGSFEIGNLLLIIFVSYFGTKLHRPIM

SEQ ID NO: 82276 - protein, 32 aa, Homo sapiens
  Payload ID: 16376
  Gene Symbol: SLCO1A2
  Gene Name: solute carrier organic anion transporter family, member 1A2
  ENSP ID: ENSP00000403638
MENGTQILRPTQDPSECTKEVKSLMWVYVLVG

SEQ ID NO: 82277 - protein, 91 aa, Homo sapiens
  Payload ID: 16376
  Gene Symbol: SLCO1A2
  Gene Name: solute carrier organic anion transporter family, member 1A2
  ENSP ID: ENSP00000407462
MGETEKRIETHRIRCLSKLKMFLLAITCAFVSKTLSGSYMNSMLTQIERQFNIPTSLVGFINGSFEIGNLLLIIFVSYFGTKLHRPIMIGI

SEQ ID NO: 82278 - protein, 136 aa, Homo sapiens
  Payload ID: 16376
  Gene Symbol: SLCO1A2
  Gene Name: solute carrier organic anion transporter family, member 1A2
  ENSP ID: ENSP00000409314
MGETEKRIETHRIRCLSKLKMFLLAITCAFVSKTLSGSYMNSMLTQIERQFNIPTSLVGFINGSFEIGNLLLIIFVSYFGTKLHRPIMIGIGCVVMGLGCFLKSLPHFLMNQYEYESTVSVSGNLSSNSFLCMENG

SEQ ID NO: 82279 - protein, 71 aa, Homo sapiens
  Payload ID: 16376
  Gene Symbol: SLCO1A2
  Gene Name: solute carrier organic anion transporter family, member 1A2
  ENSP ID: ENSP00000409691
MFLTKNCKQEQERVESAKMFLLAITCAFVSKTLSGSYMNSMLTQIERQFNIPTSLVGFINGSFEIGNLLLI

SEQ ID NO: 82280 - protein, 1 aa, Homo sapiens
  Payload ID: 16376
  Gene Symbol: SLCO1A2
  Gene Name: solute carrier organic anion transporter family, member 1A2
  ENSP ID: ENSP00000410338
M

SEQ ID NO: 82281 - protein, 147 aa, Homo sapiens
  Payload ID: 16376
  Gene Symbol: SLCO1A2
  Gene Name: solute carrier organic anion transporter family, member 1A2
  ENSP ID: ENSP00000416190
MGETEKRIETHRIRCLSKLKMFLLAITCAFVSKTLSGSYMNSMLTQIERQFNIPTSLVGFINGSFEIGNLLLIIFVSYFGTKLHRPIMIGIGCVVMGLGCFLKSLPHFLMNQYEYESTVSVSGNLSSNSFLCMENGTQILRPTQDPS

SEQ ID NO: 82282 - protein, 95 aa, Homo sapiens
  Payload ID: 16376
  Gene Symbol: SLCO1A2
  Gene Name: solute carrier organic anion transporter family, member 1A2
  ENSP ID: ENSP00000438348
MGETEKRIETHRIRCLSKLKMFLLAITCAFVSKTLSGSYMNSMLTQIERQFNIPTSLVGFINGSFEIDMNMNLQFQFQATCPQTVSCVWKMEPRF

SEQ ID NO: 82283 - protein, 93 aa, Homo sapiens
  Payload ID: 16376
  Gene Symbol: SLCO1A2
  Gene Name: solute carrier organic anion transporter family, member 1A2
  ENSP ID: ENSP00000440154
MFLTKNCKQEQERVESAKMFLLAITCAFVSKTLSGSYMNSMLTQIERQFNIPTSLVGFINGSFEIDMNMNLQFQFQATCPQTVSCVWKMEPRF

SEQ ID NO: 82284 - protein, 691 aa, Homo sapiens
  Payload ID: 16377
  Gene Symbol: SLCO1B1
  Gene Name: solute carrier organic anion transporter family, member 1B1
  Uniprot ID: Q9Y6L6
  ENSP ID: ENSP00000256958
MDQNQHLNKTAEAQPSENKKTRYCNGLKMFLAALSLSFIAKTLGAIIMKSSIIHIERRFEISSSLVGFIDGSFEIGNLLVIVFVSYFGSKLHRPKLIGIGCFIMGIGGVLTALPHFFMGYYRYSKETNINSSENSTSTLSTCLINQILSLNRASPEIVGKGCLKESGSYMWIYVFMGNMLRGIGETPIVPLGLSYIDDFAKEGHSSLYLGILNAIAMIGPIIGFTLGSLFSKMYVDIGYVDLSTIRITPTDSRWVGAWWLNFLVSGLFSIISSIPFFFLPQTPNKPQKERKASLSLHVLETNDEKDQTANLTNQGKNITKNVTGFFQSFKSILTNPLYVMFVLLTLLQVSSYIGAFTYVFKYVEQQYGQPSSKANILLGVITIPIFASGMFLGGYIIKKFKLNTVGIAKFSCFTAVMSLSFYLLYFFILCENKSVAGLTMTYDGNNPVTSHRDVPLSYCNSDCNCDESQWEPVCGNNGITYISPCLAGCKSSSGNKKPIVFYNCSCLEVTGLQNRNYSAHLGECPRDDACTRKFYFFVAIQVLNLFFSALGGTSHVMLIVKIVQPELKSLALGFHSMVIRALGGILAPIYFGALIDTTCIKWSTNNCGTRGSCRTYNSTSFSRVYLGLSSMLRVSSLVLYIILIYAMKKKYQEKDINASENGSVMDEANLESLNKNKHFVPSAGADSETHC

SEQ ID NO: 82285 - protein, 702 aa, Homo sapiens
  Payload ID: 16378
  Gene Symbol: SLCO1B3
  Gene Name: solute carrier organic anion transporter family, member 1B3
  Uniprot ID: Q9NPD5
  ENSP ID: ENSP00000261196
MDQHQHLNKTAESASSEKKKTRRCNGFKMFLAALSFSYIAKALGGIIMKISITQIERRFDISSSLAGLIDGSFEIGNLLVIVFVSYFGSKLHRPKLIGIGCLLMGTGSILTSLPHFFMGYYRYSKETHINPSENSTSSLSTCLINQTLSFNGTSPEIVEKDCVKESGSHMWIYVFMGNMLRGIGETPIVPLGISYIDDFAKEGHSSLYLGSLNAIGMIGPVIGFALGSLFAKMYVDIGYVDLSTIRITPKDSRWVGAWWLGFLVSGLFSIISSIPFFFLPKNPNKPQKERKISLSLHVLKTNDDRNQTANLTNQGKNVTKNVTGFFQSLKSILTNPLYVIFLLLTLLQVSSFIGSFTYVFKYMEQQYGQSASHANFLLGIITIPTVATGMFLGGFIIKKFKLSLVGIAKFSFLTSMISFLFQLLYFPLICESKSVAGLTLTYDGNNSVASHVDVPLSYCNSECNCDESQWEPVCGNNGITYLSPCLAGCKSSSGIKKHTVFYNCSCVEVTGLQNRNYSAHLGECPRDNTCTRKFFIYVAIQVINSLFSATGGTTFILLTVKIVQPELKALAMGFQSMVIRTLGGILAPIYFGALIDKTCMKWSTNSCGAQGACRIYNSVFFGRVYLGLSIALRFPALVLYIVFIFAMKKKFQGKDTKASDNERKVMDEANLEFLNNGEHFVPSAGTDSKTCNLDMQDNAAAN

SEQ ID NO: 82286 - protein, 702 aa, Homo sapiens; identical to SEQ ID NO: 82285
  Payload ID: 16378
  Gene Symbol: SLCO1B3
  Gene Name: solute carrier organic anion transporter family, member 1B3
  Uniprot ID: Q9NPD5
  ENSP ID: ENSP00000370956

SEQ ID NO: 82287 - protein, 291 aa, Homo sapiens
  Payload ID: 16378
  Gene Symbol: SLCO1B3
  Gene Name: solute carrier organic anion transporter family, member 1B3
  ENSP ID: ENSP00000442000
MDQHQHLNKTAESASSEKKKTRRCNGFKMFLAALSFSYIAKALGGIIMKISITQIERRFDISSSLAGLIDGSFEIGNLLVIVFVSYFGSKLHRPKLIGIGCLLMGTGSILTSLPHFFMGYYRYSKETHINPSENSTSSLSTCLINQTLSFNGTSPEIVEKDCVKESGSHMWIYVFMGNMLRGIGETPIVPLGISYIDDFAKEGHSSLYLGSLNAIGMIGPVIGFALGSLFAKMYVDIGYVDLSTIRITPKDSRWVGAWWLGFLVSGLFSIISSIPFFFLPKNPNKPQKERK

SEQ ID NO: 82288 - protein, 479 aa, Homo sapiens
  Payload ID: 16378
  Gene Symbol: SLCO1B3
  Gene Name: solute carrier organic anion transporter family, member 1B3
  ENSP ID: ENSP00000443225
GNMLRGIGETPIVPLGISYIDDFAKEGHSSLYLGSLNAIGMIGPVIGFALGSLFAKMYVDIGYVDLSTIRITPKDSRWVGAWWLGFLVSGLFSIISSIPFFFLPKNPNKPQKERKISLSLHVLKTNDDRNQTANLTNQGKNVTKNVTGFFQSLKSILTNPLYVIFLLLTLLQVSSFIGSFTYVFKYMEQQYGQSASHANFLLGIITIPTVATGMFLGGFIIKKFKLSLVGIAKFSFLTSMISFLFQLLYFPLICESKSVAGLTLTYDGNNSVASHVDVPLSYCNSECNCDESQWEPVCGNNGITYLSPCLAGCKSSSGIKKHTVFYNCSCVEVTGLQNRNYSAHLGECPRDNTCTRKFFIYVAIQVINSLFSATGGTTFILLTVKIVQPELKALAMGFQSMVIRTLGGILAPIYFGALIDKTCMKWSTNSCGAQGACRIYNSVFFGQKYPASDIKTTRLSGRNKKLLQLYLTSYRSINL

SEQ ID NO: 82289 - protein, 640 aa, Homo sapiens
  Payload ID: 16379
  Gene Symbol: SLCO1B7
  Gene Name: solute carrier organic anion transporter family, member 1B7 (non-functional)
  Uniprot ID: G3V0H7
  ENSP ID: ENSP00000394168
MKISTTQIERRFEISSSLVGLIDGSFEIGNLFVIVFVSYFGSKLHRPKLIGIGCFLMGTGSILMALPHFFMGYYRYSKETNIDPSENSTSNLPNCLINQMLSLNRTPSEIIERGCVKESGSHMWIYVFMGNMLRGIGETPIVPLGISYIDDFAKEGHSSLYLGTVNVMGMTGLVFAFMLGSLFAKMYVDIGYVDLSTIRITPKDSRWVGAWWLGFLVSGIVSIISSIPFFFLPLNPNKPQKERKVSLFLHVLKTNDKRNQIANLTNRRKYITKNVTGFFQSLKSILTNPLYVIFVIFTLLHMSSYIASLTYIIKMVEQQYGWSASKTNFLLGVLALPAVAIGMFSGGYIIKKFKLSLVGLAKLAFCSATVHLLSQVLYFFLICESKSVAGLTLTYDGNSPVRSHVDVPLSYCNSECNCDESQWEPVCGNNGITYLSPCLAGCKSSSGNKEPIVFYNCSCVEVIGLQNKNYSAHLGECPRDDACTRKSYVYFVIQVLDAFLCAVGLTSYSVLVIRIVQPELKALAIGFHSMIMRSLGGILVPIYFGALIDTTCMKWSTNSCGARGACRIYNSTYLGRAFFGLKVALIFPVLVLLTVFIFVVRKKSHGKDTKVLENERQVMDEANLEFLNDSEHFVPSAEEQ

SEQ ID NO: 82290 - protein, 99 aa, Homo sapiens
  Payload ID: 16379
  Gene Symbol: SLCO1B7
  Gene Name: solute carrier organic anion transporter family, member 1B7 (non-functional)
  ENSP ID: ENSP00000439857
VIQVLDAFLCAVGLTSYSVLVIRIVQPELKALAIGFHSMIMRSLGGILVPIYFGALIDTTCMKWSTNSCGARGACRIYNSTYLGRAFFGLKVDSMPWII

SEQ ID NO: 82291 - protein, 712 aa, Homo sapiens
  Payload ID: 16380
  Gene Symbol: SLCO1C1
  Gene Name: solute carrier organic anion transporter family, member 1C1
  Uniprot ID: Q9NYB5
  ENSP ID: ENSP00000266509
MDTSSKENIQLFCKTSVQPVGRPSFKTEYPSSEEKQPCCGELKVFLCALSFVYFAKALAEGYLKSTITQIERRFDIPSSLVGVIDGSFEIGNLLVITFVSYFGAKLHRPKIIGAGCVIMGVGTLLIAMPQFFMEQYKYERYSPSSNSTLSISPCLLESSSQLPVSVMEKSKSKISNECEVDTSSSMWIYVFLGNLLRGIGETPIQPLGIAYLDDFASEDNAAFYIGCVQTVAIIGPIFGFLLGSLCAKLYVDIGFVNLDHITITPKDPQWVGAWWLGYLIAGIISLLAAVPFWYLPKSLPRSQSREDSNSSSEKSKFIIDDHTDYQTPQGENAKIMEMARDFLPSLKNLFGNPVYFLYLCTSTVQFNSLFGMVTYKPKYIEQQYGQSSSRANFVIGLINIPAVALGIFSGGIVMKKFRISVCGAAKLYLGSSVFGYLLFLSLFALGCENSDVAGLTVSYQGTKPVSYHERALFSDCNSRCKCSETKWEPMCGENGITYVSACLAGCQTSNRSGKNIIFYNCTCVGIAASKSGNSSGIVGRCQKDNGCPQMFLYFLVISVITSYTLSLGGIPGYILLLRCIKPQLKSFALGIYTLAIRVLAGIPAPVYFGVLIDTSCLKWGFKRCGSRGSCRLYDSNVFRHIYLGLTVILGTVSILLSIAVLFILKKNYVSKHRSFITKRERTMVSTRFQKENYTTSDHLLQPNYWPGKETQL

SEQ ID NO: 82292 - protein, 46 aa, Homo sapiens
  Payload ID: 16380
  Gene Symbol: SLCO1C1
  Gene Name: solute carrier organic anion transporter family, member 1C1
  ENSP ID: ENSP00000437399
MDTSSKENIQLFCKTSVQPVGRPSFKTEYPSSEEKQPCCGELKVQI

SEQ ID NO: 82293 - protein, 663 aa, Homo sapiens
  Payload ID: 16380
  Gene Symbol: SLCO1C1
  Gene Name: solute carrier organic anion transporter family, member 1C1
  Uniprot ID: Q9NYB5
  ENSP ID: ENSP00000438665
MDTSSKENIQLFCKTSVQPVGRPSFKTEYPSSEEKQPCCGELKVFLCALSFVYFAKALAEGYLKSTITQIERRFDIPSSLVGVIDGSFEIGNLLVITFVSYFGAKLHRPKIIGAGCVIMGVGTLLIAMPQFFMEQYKYERYSPSSNSTLSISPCLLESSSQLPVSVMEKSKSKISNGCVQTVAIIGPIFGFLLGSLCAKLYVDIGFVNLDHITITPKDPQWVGAWWLGYLIAGIISLLAAVPFWYLPKSLPRSQSREDSNSSSEKSKFIIDDHTDYQTPQGENAKIMEMARDFLPSLKNLFGNPVYFLYLCTSTVQFNSLFGMVTYKPKYIEQQYGQSSSRANFVIGLINIPAVALGIFSGGIVMKKFRISVCGAAKLYLGSSVFGYLLFLSLFALGCENSDVAGLTVSYQGTKPVSYHERALFSDCNSRCKCSETKWEPMCGENGITYVSACLAGCQTSNRSGKNIIFYNCTCVGIAASKSGNSSGIVGRCQKDNGCPQMFLYFLVISVITSYTLSLGGIPGYILLLRCIKPQLKSFALGIYTLAIRVLAGIPAPVYFGVLIDTSCLKWGFKRCGSRGSCRLYDSNVFRHIYLGLTVILGTVSILLSIAVLFILKKNYVSKHRSFITKRERTMVSTRFQKENYTTSDHLLQPNYWPGKETQL

SEQ ID NO: 82294 - protein, 730 aa, Homo sapiens
  Payload ID: 16380
  Gene Symbol: SLCO1C1
  Gene Name: solute carrier organic anion transporter family, member 1C1
  Uniprot ID: Q9NYB5
  ENSP ID: ENSP00000444149
MDTSSKENIQLFCKTSVQPVGRPSFKTEYPSSEEKQPCCGELKVFLCALSFVYFAKALAEGYLKSTITQIERRFDIPSSLVGVIDGSFEIGNLLVITFVSYFGAKLHRPKIIGAGCVIMGVGTLLIAMPQFFMEQYKYERYSPSSNSTLSISPCLLESSSQLPVSVMEKSKSKISNECEVDTSSSMWIYVFLGNLLRGIGETPIQPLGIAYLDDFASEDNAAFYIGCVQTVAIIGPIFGFLLGSLCAKLYVDIGFVNLDHITITPKDPQWVGAWWLGYLIAGIISLLAAVPFWYLPKSLPRSQSREDSNSSSEKSKFIIDDHTDYQTPQGENAKIMEMARDFLPSLKNLFGNPVYFLYLCTSTVQFNSLFGMVTYKPKYIEQQYGQSSSRANFVIGLINIPAVALGIFSGGIVMKKFRISVCGAAKLYLGSSVFGYLLFLSLFALGCENSDVAGLTVSYQGTKPVSYHERALFSDCNSRCKCSETKWEPMCGENGITYVSACLAGCQTSNRSGKNIIFYNCTCVGIAASKSGNSSGIVGRCQKDNGCPQMFLYFLVISVITSYTLSLGGIPGYILLLRCIKPQLKSFALGIYTLAIRVLAGIPAPVYFGVLIDTSCLKWGFKRCGSRGSCRLYDSNVFRYQIKSIPASHCYSIPDLHNATDTNKFSCHFTACKTYISGTNCDTGHSVNSPKHCSTFHFKEKLCFKTQKFYNQERKNNGVYKIPKGKLHYK

SEQ ID NO: 82295 - protein, 612 aa, Homo sapiens
  Payload ID: 16380
  Gene Symbol: SLCO1C1
  Gene Name: solute carrier organic anion transporter family, member 1C1
  Uniprot ID: Q9NYB5
  ENSP ID: ENSP00000444527
MGVGTLLIAMPQFFMEQYKYERYSPSSNSTLSISPCLLESSSQLPVSVMEKSKSKISNECEVDTSSSMWIYVFLGNLLRGIGETPIQPLGIAYLDDFASEDNAAFYIGCVQTVAIIGPIFGFLLGSLCAKLYVDIGFVNLDHITITPKDPQWVGAWWLGYLIAGIISLLAAVPFWYLPKSLPRSQSREDSNSSSEKSKFIIDDHTDYQTPQGENAKIMEMARDFLPSLKNLFGNPVYFLYLCTSTVQFNSLFGMVTYKPKYIEQQYGQSSSRANFVIGLINIPAVALGIFSGGIVMKKFRISVCGAAKLYLGSSVFGYLLFLSLFALGCENSDVAGLTVSYQGTKPVSYHERALFSDCNSRCKCSETKWEPMCGENGITYVSACLAGCQTSNRSGKNIIFYNCTCVGIAASKSGNSSGIVGRCQKDNGCPQMFLYFLVISVITSYTLSLGGIPGYILLLRCIKPQLKSFALGIYTLAIRVLAGIPAPVYFGVLIDTSCLKWGFKRCGSRGSCRLYDSNVFRYQIKSIPASHCYSIPDLHNATDTNKFSCHFTACKTYISGTNCDTGHSVNSPKHCSTFHFKEKLCFKTQKFYNQERKNNGVYKIPKGKLHYK

SEQ ID NO: 82296 - protein, 643 aa, Homo sapiens [sequence omitted]

SEQ ID NO: 82297 - protein, 567 aa, Homo sapiens
  Payload ID: 16381
  Gene Symbol: SLCO2A1
  Gene Name: solute carrier organic anion transporter family, member 2A1
  ENSP ID: ENSP00000418893
MGLLPKLGASQGSDTSTSRAGRCARSVFGNIKVFVLCQGLLQLCQLLYSAYFKSSLTTIEKRFGLSSSSSGLISSLNEISNAILIIFVSYFGSRVHRPRLIGIGGLFLAAGAFILTLPHFLSEPYQYTLASTAILFAISVFGPAFGYLLGSVMLQIFVDYGRVNTAAVNLVPGDPRWIGAWWLGLLISSALLVLTSFPFFFFPRAMPIGAKRAPATADEARKLEEAKSRGSLVDFIKRFPCIFLRLLMNSLFVLVVLAQCTFSSVIAGLSTFLNKFLEKQYGTSAAYANFLIGAVNLPAAALGMLFGGILMKRFVFSLQAIPRIATTIITISMILCVPLFFMGCSTPTVAEVYPPSTSSSIHPQSPACRRDCSCPDSIFHPVCGDNGIEYLSPCHAGCSNINMSSATSKQLIYLNCSCVTGGSASAKTGSCPVPCAHFLLPAIFLISFVSLIACISHNPLYMMVLRVVNQEEKSFAIGVQFLLMRLLAWLPSPALYGLTIDHSCIRWNSLCLGRRGACAYYDNDALRDRYLGLQMGYKALGMLLLCFISWRVKKNKEYNVQKAAGLI

SEQ ID NO: 82298 - protein, 415 aa, Homo sapiens
  Payload ID: 16381
  Gene Symbol: SLCO2A1
  Gene Name: solute carrier organic anion transporter family, member 2A1
  ENSP ID: ENSP00000420028
MGLLPKLGASQGSDTSTSRAGRCARSVFGNIKVFVLCQGLLQLCQLLYSAYFKSSLTTIEKRFGLSSSSSGLISSLNEISNAILIIFVSYFGSRVHRPRLIGIGGLFLAAGAFILTLPHFLSEPYQYTLASTGNNSRLQAELCQKHWQDLPPSKCHSTTQNPQKETSSMWGLMVVAQLLAGIGTVPIQPFGISYVDDFSEPSNSPLYISILFAISVFGPAFGYLLGSVMLQIFVDYGRVNTAAVNLVPGDPRWIGAWWLGLLISSALLVLTSFPFFFFPRAMPIGAKRAPATADEARKLEEAKSRGSLVDFIKRFPCIFLRLLMNSLFVLVVLAQCTFSSVIAGLSTFLNKFLEKQYGTSAAYANFLIAHQVLYIRSLLPAAGTARAQILSSTRSVETMESSTSPLAMPAAATST

SEQ ID NO: 82299 - protein, 709 aa, Homo sapiens
  Payload ID: 16382
  Gene Symbol: SLCO2B1
  Gene Name: solute carrier organic anion transporter family, member 2B1
  ENSP ID: ENSP00000289575
MGPRIGPAGEVPQVPDKETKATMGTENTPGGKASPDPQDVRPSVFHNIKLFVLCHSLLQLAQLMISGYLKSSISTVEKRFGLSSQTSGLLASFNEVGNTALIVFVSYFGSRVHRPRMIGYGAILVALAGLLMTLPHFISEPYRYDNTSPEDMPQDFKASLCLPTTSAPASAPSNGNCSSYTETQHLSVVGIMFVAQTLLGVGGVPIQPFGISYIDDFAHNSNSPLYLGILFAVTMMGPGLAFGLGSLMLRLYVDINQMPEGGISLTIKDPRWVGAWWLGFLIAAGAVALAAIPYFFFPKEMPKEKRELQFRRKVLAVTDSPARKGKDSPSKQSPGESTKKQDGLVQIAPNLTVIQFIKVFPRVLLQTLRHPIFLLVVLSQVCLSSMAAGMATFLPKFLERQFSITASYANLLIGCLSFPSVIVGIVVGGVLVKRLHLGPVGCGALCLLGMLLCLFFSLPLFFIGCSSHQIAGITHQTSAHPGLELSPSCMEACSCPLDGFNPVCDPSTRVEYITPCHAGCSSWVVQDALDNSQVFYTNCSCVVEGNPVLAGSCDSTCSHLVVPFLLLVSLGSALACLTHTPSFMLILRGVKKEDKTLAVGIQFMFLRILAWMPSPVIHGSAIDTTCVHWALSCGRRAVCRYYNNDLLRNRFIGLQFFFKTGSVICFALVLAVLRQQDKEARTKESRSSPAVEQQLLVSGPGKKPEDSRV

SEQ ID NO: 82300 - protein, 687 aa, Homo sapiens
  Payload ID: 16382
  Gene Symbol: SLCO2B1
  Gene Name: solute carrier organic anion transporter family, member 2B1
  Uniprot ID: O94956
  ENSP ID: ENSP00000388912
MGTENTPGGKASPDPQDVRPSVFHNIKLFVLCHSLLQLAQLMISGYLKSSISTVEKRFGLSSQTSGLLASFNEVGNTALIVFVSYFGSRVHRPRMIGYGAILVALAGLLMTLPHFISEPYRYDNTSPEDMPQDFKASLCLPTTSAPASAPSNGNCSSYTETQHLSVVGIMFVAQTLLGVGGVPIQPFGISYIDDFAHNSNSPLYLGILFAVTMMGPGLAFGLGSLMLRLYVDINQMPEGGISLTIKDPRWVGAWWLGFLIAAGAVALAAIPYFFFPKEMPKEKRELQFRRKVLAVTDSPARKGKDSPSKQSPGESTKKQDGLVQIAPNLTVIQFIKVFPRVLLQTLRHPIFLLVVLSQVCLSSMAAGMATFLPKFLERQFSITASYANLLIGCLSFPSVIVGIVVGGVLVKRLHLGPVGCGALCLLGMLLCLFFSLPLFFIGCSSHQIAGITHQTSAHPGLELSPSCMEACSCPLDGFNPVCDPSTRVEYITPCHAGCSSWVVQDALDNSQVFYTNCSCVVEGNPVLAGSCDSTCSHLVVPFLLLVSLGSALACLTHTPSFMLILRGVKKEDKTLAVGIQFMFLRILAWMPSPVIHGSAIDTTCVHWALSCGRRAVCRYYNNDLLRNRFIGLQFFFKTGSVICFALVLAVLRQQDKEARTKESRSSPAVEQQLLVSGPGKKPEDSRV

SEQ ID NO: 82301 - protein, 482 aa, Homo sapiens
  Payload ID: 16382
  Gene Symbol: SLCO2B1
  Gene Name: solute carrier organic anion transporter family, member 2B1
  Uniprot ID: O94956
  ENSP ID: ENSP00000389653
MIGYGAILVALAGLLMTLPHFISEPYRYDNTSPGGISLTIKDPRWVGAWWLGFLIAAGAVALAAIPYFFFPKEMPKEKRELQFRRKVLAVTDSPARKGKDSPSKQSPGESTKKQDGLVQIAPNLTVIQFIKVFPRVLLQTLRHPIFLLVVLSQVCLSSMAAGMATFLPKFLERQFSITASYANLLIGCLSFPSVIVGIVVGGVLVKRLHLGPVGCGALCLLGMLLCLFFSLPLFFIGCSSHQIAGITHQTSAHPGLELSPSCMEACSCPLDGFNPVCDPSTRVEYITPCHAGCSSWVVQDALDNSQVFYTNCSCVVEGNPVLAGSCDSTCSHLVVPFLLLVSLGSALACLTHTPSFMLILRGVKKEDKTLAVGIQFMFLRILAWMPSPVIHGSAIDTTCVHWALSCGRRAVCRYYNNDLLRNRFIGLQFFFKTGSVICFALVLAVLRQQDKEARTKESRSSPAVEQQLLVSGPGKKPEDSRV

SEQ ID NO: 82302 - protein, 43 aa, Homo sapiens
  Payload ID: 16382
  Gene Symbol: SLCO2B1
  Gene Name: solute carrier organic anion transporter family, member 2B1
  ENSP ID: ENSP00000431192
MGTENTPGGKASPDPQDVRPSVFHNIKLFVLCHSLLQLAQLMI

SEQ ID NO: 82303 - protein, 43 aa, Homo sapiens; identical to SEQ ID NO: 82302
  Payload ID: 16382
  Gene Symbol: SLCO2B1
  Gene Name: solute carrier organic anion transporter family, member 2B1
  ENSP ID: ENSP00000431324

SEQ ID NO: 82304 - protein, 87 aa, Homo sapiens
  Payload ID: 16382
  Gene Symbol: SLCO2B1
  Gene Name: solute carrier organic anion transporter family, member 2B1
  ENSP ID: ENSP00000432889
MGTENTPGGKASPDPQDVRPSVFHNIKLFVLCHSLLQLAQLMISGYLKSSISTVEKRFGLSSQTSGLLASFNEVGNTALIVFVSYFG

SEQ ID NO: 82305 - protein, 127 aa, Homo sapiens
  Payload ID: 16382
  Gene Symbol: SLCO2B1
  Gene Name: solute carrier organic anion transporter family, member 2B1
  ENSP ID: ENSP00000433872
MGTENTPGGKASPDPQDVRPSVFHNIKLFVLCHSLLQLAQLMISGYLKSSISTVEKRFGLSSQTSGLLASFNEVGNTALIVFVSYFGSRVHRPRMIGYGAILVALAGLLMTLPHFISEPYRYDNTSP

SEQ ID NO: 82306 - protein, 593 aa, Homo sapiens
  Payload ID: 16382
  Gene Symbol: SLCO2B1
  Gene Name: solute carrier organic anion transporter family, member 2B1
  ENSP ID: ENSP00000434112
MIGYGAILVALAGLLMTLPHFISEPYRYDNTSPEDMPQDFKASLCLPTTSAPASAPSNGNCSSYTETQHLSVVGIMFVAQTLLGVGGVPIQPFGISYIDDFAHNSNSPLYLGILFAVTMMGPGLAFGLGSLMLRLYVDINQMPEGGISLTIKDPRWVGAWWLGFLIAAGAVALAAIPYFFFPKEMPKEKRELQFRRKVLAVTDSPARKGKDSPSKQSPGESTKKQDGLVQIAPNLTVIQFIKVFPRVLLQTLRHPIFLLVVLSQVCLSSMAAGMATFLPKFLERQFSITASYANLLIGCLSFPSVIVGIVVGGVLVKRLHLGPVGCGALCLLGMLLCLFFSLPLFFIGCSSHQIAGITHQTSAHPGLELSPSCMEACSCPLDGFNPVCDPSTRVEYITPCHAGCSSWVVQDALDNSQVFYTNCSCVVEGNPVLAGSCDSTCSHLVVPFLLLVSLGSALACLTHTPSFMLILRGVKKEDKTLAVGIQFMFLRILAWMPSPVIHGSAIDTTCVHWALSCGRRAVCRYYNNDLLRNRFIGLQFFFKTGSVICFALVLAVLRQQDKEARTKESRSSPAVEQQLLVSGPGKKPEDSRV

SEQ ID NO: 82307 - protein, 147 aa, Homo sapiens
  Payload ID: 16382
  Gene Symbol: SLCO2B1
  Gene Name: solute carrier organic anion transporter family, member 2B1
  ENSP ID: ENSP00000434742
VALAGLLMTLPHFISEPYRYDNTSPEDMPQDFKASLCLPTTSAPASAPSNGNCSSYTETQHLSVVGIMFVAQTLLGVGGVPIQPFGISYIDDFAHNSNSPLYLGILFAVTMMGPGLAFGLGSLMLRLYVDINQMPEGEPQEHMFARP

SEQ ID NO: 82308 - protein, 43 aa, Homo sapiens; identical to SEQ ID NO: 82302
  Payload ID: 16382
  Gene Symbol: SLCO2B1
  Gene Name: solute carrier organic anion transporter family, member 2B1
  ENSP ID: ENSP00000435384

SEQ ID NO: 82309 - protein, 565 aa, Homo sapiens
  Payload ID: 16382
  Gene Symbol: SLCO2B1
  Gene Name: solute carrier organic anion transporter family, member 2B1
  ENSP ID: ENSP00000436324
MGPRIEDMPQDFKASLCLPTTSAPASAPSNGNCSSYTETQHLSVVGIMFVAQTLLGVGGVPIQPFGISYIDDFAHNSNSPLYLGILFAVTMMGPGLAFGLGSLMLRLYVDINQMPEGGISLTIKDPRWVGAWWLGFLIAAGAVALAAIPYFFFPKEMPKEKRELQFRRKVLAVTDSPARKGKDSPSKQSPGESTKKQDGLVQIAPNLTVIQFIKVFPRVLLQTLRHPIFLLVVLSQVCLSSMAAGMATFLPKFLERQFSITASYANLLIGCLSFPSVIVGIVVGGVLVKRLHLGPVGCGALCLLGMLLCLFFSLPLFFIGCSSHQIAGITHQTSAHPGLELSPSCMEACSCPLDGFNPVCDPSTRVEYITPCHAGCSSWVVQDALDNSQVFYTNCSCVVEGNPVLAGSCDSTCSHLVVPFLLLVSLGSALACLTHTPSFMLILRGVKKEDKTLAVGIQFMFLRILAWMPSPVIHGSAIDTTCVHWALSCGRRAVCRYYNNDLLRNRFIGLQFFFKTGSVICFALVLAVLRQQDKEARTKESRSSPAVEQQLLVSGPGKKPEDSRV

SEQ ID NO: 82310 - protein, 150 aa, Homo sapiens
  Payload ID: 16382
  Gene Symbol: SLCO2B1
  Gene Name: solute carrier organic anion transporter family, member 2B1
  ENSP ID: ENSP00000436513
MGTENTPGGKASPDPQDVRPSVFHNIKLFVLCHSLLQLAQLMISGYLKSSISTVEKRFGLSSQTSGLLASFNEVGNTALIVFVSYFGSRVHRPRMIGYGAILVALAGLLMTLPHFISEPYRYDNTSPEDMPQDFKASLCLPTTSAPASAP

SEQ ID NO: 82311 - protein, 710 aa, Homo sapiens
  Payload ID: 16383
  Gene Symbol: SLCO3A1
  Gene Name: solute carrier organic anion transporter family, member 3A1
  Uniprot ID: Q9UIG8
  ENSP ID: ENSP00000320634
MQGKKPGGSSGGGRSGELQGDEAQRNKKKKKKVSCFSNIKIFLVSECALMLAQGTVGAYLVSVLTTLERRFNLQSADVGVIASSFEIGNLALILFVSYFGARGHRPRLIGCGGIVMALGALLSALPEFLTHQYKYEAGEIRWGAEGRDVCAANGSGGDEGPDPDLICRNRTATNMMYLLLIGAQVLLGIGATPVQPLGVSYIDDHVRRKDSSLYIGILFTMLVFGPACGFILGSFCTKIYVDAVFIDTSNLDITPDDPRWIGAWWGGFLLCGALLFFSSLLMFGFPQSLPPHSEPAMESEQAMLSEREYERPKPSNGVLRHPLEPDSSASCFQQLRVIPKVTKHLLSNPVFTCIILAACMEIAVVAGFAAFLGKYLEQQFNLTTSSANQLLGMTAIPCACLGIFLGGLLVKKLSLSALGAIRMAMLVNLVSTACYVSFLFLGCDTGPVAGVTVPYGNSTAPGSALDPYSPCNNNCECQTDSFTPVCGADGITYLSACFAGCNSTNLTGCACLTTVPAENATVVPGKCPSPGCQEAFLTFLCVMCICSLIGAMAQTPSVIILIRTVSPELKSYALGVLFLLLRLLGFIPPPLIFGAGIDSTCLFWSTFCGEQGACVLYDNVVYRYLYVSIAIALKSFAFILYTTTWQCLRKNYKRYIKNHEGGLSTSEFFASTLTLDNLGRDPVPANQTHRTKFIYNLEDHEWCENMESVL

SEQ ID NO: 82312 - protein, 692 aa, Homo sapiens
  Payload ID: 16383
  Gene Symbol: SLCO3A1
  Gene Name: solute carrier organic anion transporter family, member 3A1
  Uniprot ID: Q9UIG8
  ENSP ID: ENSP00000387846
MQGKKPGGSSGGGRSGELQGDEAQRNKKKKKKVSCFSNIKIFLVSECALMLAQGTVGAYLVSVLTTLERRFNLQSADVGVIASSFEIGNLALILFVSYFGARGHRPRLIGCGGIVMALGALLSALPEFLTHQYKYEAGEIRWGAEGRDVCAANGSGGDEGPDPDLICRNRTATNMMYLLLIGAQVLLGIGATPVQPLGVSYIDDHVRRKDSSLYIGILFTMLVFGPACGFILGSFCTKIYVDAVFIDTSNLDITPDDPRWIGAWWGGFLLCGALLFFSSLLMFGFPQSLPPHSEPAMESEQAMLSEREYERPKPSNGVLRHPLEPDSSASCFQQLRVIPKVTKHLLSNPVFTCIILAACMEIAVVAGFAAFLGKYLEQQFNLTTSSANQLLGMTAIPCACLGIFLGGLLVKKLSLSALGAIRMAMLVNLVSTACYVSFLFLGCDTGPVAGVTVPYGNSTAPGSALDPYSPCNNNCECQTDSFTPVCGADGITYLSACFAGCNSTNLTGCACLTTVPAENATVVPGKCPSPGCQEAFLTFLCVMCICSLIGAMAQTPSVIILIRTVSPELKSYALGVLFLLLRLLGFIPPPLIFGAGIDSTCLFWSTFCGEQGACVLYDNVVYRYLYVSIAIALKSFAFILYTTTWQCLRKNYKRYIKNHEGGLSTSTEYQDIETEKTCPESHSPSEDSFVRS

SEQ ID NO: 82313 - protein, 130 aa, Homo sapiens
  Payload ID: 16383
  Gene Symbol: SLCO3A1
  Gene Name: solute carrier organic anion transporter family, member 3A1
  ENSP ID: ENSP00000450559
MPVSVLTTLERRFNLQSADVGVIASSFEIGNLALILFVSYFGARGHRPRLIGCGGIVMALGALLSALPEFLTHQYKYEAGEIRWGAEGRDVCAANGSGGDEGPDPDLICRNRTATNMMYLLLIGAQVLLG

SEQ ID NO: 82314 - protein, 87 aa, Homo sapiens
  Payload ID: 16383
  Gene Symbol: SLCO3A1
  Gene Name: solute carrier organic anion transporter family, member 3A1
  ENSP ID: ENSP00000451287
METAQHLAQPWTPTRPAIITVNAKPIPSLQCVGQMASPTCLPALLAATARISRAVRASPPSLLRTQPWFLENAPVLGAKRPSSLSSV

SEQ ID NO: 82315 - protein, 109 aa, Homo sapiens
  Payload ID: 16383
  Gene Symbol: SLCO3A1
  Gene Name: solute carrier organic anion transporter family, member 3A1
  ENSP ID: ENSP00000451780
  MOD_RES (1)..(1): Any amino acid
XATSPSSSWAATLALWLGLLFPMETAQHLAQPWTPTRPAIITVNAKPIPSLQCVGQMASPTCLPALLAATARISRAVRASPPSLLRTQPWFLENAPVLGAKRPSSLSSV

SEQ ID NO: 82316 - protein, 722 aa, Homo sapiens
  Payload ID: 16384
  Gene Symbol: SLCO4A1
  Gene Name: solute carrier organic anion transporter family, member 4A1
  Uniprot ID: Q96BD0
  ENSP ID: ENSP00000217159
MPLHQLGDKPLTFPSPNSAMENGLDHTPPSRRASPGTPLSPGSLRSAAHSPLDTSKQPLCQLWAEKHGARGTHEVRYVSAGQSVACGWWAFAPPCLQVLNTPKGILFFLCAAAFLQGMTVNGFINTVITSLERRYDLHSYQSGLIASSYDIAACLCLTFVSYFGGSGHKPRWLGWGVLLMGTGSLVFALPHFTAGRYEVELDAGVRTCPANPGAVCADSTSGLSRYQLVFMLGQFLHGVGATPLYTLGVTYLDENVKSSCSPVYIAIFYTAAILGPAAGYLIGGALLNIYTEMGRRTELTTESPLWVGAWWVGFLGSGAAAFFTAVPILGYPRQLPGSQRYAVMRAAEMHQLKDSSRGEASNPDFGKTIRDLPLSIWLLLKNPTFILLCLAGATEATLITGMSTFSPKFLESQFSLSASEAATLFGYLVVPAGGGGTFLGGFFVNKLRLRGSAVIKFCLFCTVVSLLGILVFSLHCPSVPMAGVTASYGGSLLPEGHLNLTAPCNAACSCQPEHYSPVCGSDGLMYFSLCHAGCPAATETNVDGQKVYRDCSCIPQNLSSGFGHATAGKCTSTCQRKPLLLVFIFVVIFFTFLSSIPALTATLRCVRDPQRSFALGIQWIVVRILGGIPGPIAFGWVIDKACLLWQDQCGQQGSCLVYQNSAMSRYILIMGLLYKVLGVLFFAIACFLYKPLSESSDGLETCLPSQSSAPDSATDSQLQSSV

SEQ ID NO: 82317 - protein, 722 aa, Homo sapiens; identical to SEQ ID NO: 82316
  Payload ID: 16384
  Gene Symbol: SLCO4A1
  Gene Name: solute carrier organic anion transporter family, member 4A1
  Uniprot ID: Q96BD0
  ENSP ID: ENSP00000359538

SEQ ID NO: 82318 - protein, 151 aa, Homo sapiens
  Payload ID: 16384
  Gene Symbol: SLCO4A1
  Gene Name: solute carrier organic anion transporter family, member 4A1
  ENSP ID: ENSP00000414855
TTALCAARTASCTSHCATQGALQPRRRMWTARRCVRDPQRSFALGIQWIVVRILGGIPGPIAFGWVIDKACLLWQDQCGQQGSCLVYQNSAMSRYILIMGLLYKVLGVLFFAIACFLYKPLSESSDGLETCLPSQSSAPDSATDSQLQSSV

SEQ ID NO: 82319 - protein, 620 aa, Homo sapiens
  Payload ID: 16384
  Gene Symbol: SLCO4A1
  Gene Name: solute carrier organic anion transporter family, member 4A1
  ENSP ID: ENSP00000434245
MPLHQLGDKPLTFPSPNSAMENGLDHTPPSRRASPGTPLSPGSLRSAAHSPLDTSKQPLCQLWAEKHGARGTHEVRYVSAGQSVACGWWAFAPPCLQVLNTPKGILFFLCAAAFLQGMTVNGFINTVITSLERRYDLHSYQSGLIASSYDIAACLCLTFVSYFGGSGHKPRWLGWGVLLMGTGSLVFALPHFTAGRYEVELDAGVRTCPANPGAVCADSTSGLSRYQLVFMLGQFLHGVGATPLYTLGVTYLDENVKSSCSPVYIAIFYTAAILGPAAGYLIGGALLNIYTEMGRRTELTTESPLWVGAWWVGFLGSGAAAFFTAVPILGYPRQLPGSQRYAVMRAAEMHQLKDSSRGEASNPDFGKTIRDLPLSIWLLLKNPTFILLCLAGATEATLITGMSTFSPKFLESQFSLSASEAATLFGYLVVPAGGGGTFLGGFFVNKLRLRGSAVIKFCLFCTVVSLLGILVFSLHCPSVPMAGVTASYGGSLLPEGHLNLTAPCNAACSCQPEHYSPVCGSDGLMYFSLCHAGCPAATETNVDGQKVSGAAAYRPCPPLDPGKGPPCLPLVIGAIVGLPRCTETVAVSLRIFPLVLAMPLQGNALQLVRESPSFWFSYSL

SEQ ID NO: 82320 - protein, 724 aa, Homo sapiens
  Payload ID: 16385
  Gene Symbol: SLCO4C1
  Gene Name: solute carrier organic anion transporter family, member 4C1
  Uniprot ID: Q6ZQN7
  ENSP ID: ENSP00000309741
MKSAKGIENLAFVPSSPDILRRLSASPSQIEVSALSSDPQRENSQPQELQKPQEPQKSPEPSLPSAPPNVSEEKLRSLSLSEFEEGSYGWRNFHPQCLQRCNTPGGFLLHYCLLAVTQGIVVNGLVNISISTVEKRYEMKSSLTGLISSSYDISFCLLSLFVSFFGERGHKPRWLAFAAFMIGLGALVFSLPQFFSGEYKLGSLFEDTCVTTRNSTSCTSSTSSLSNYLYVFILGQLLLGAGGTPLYTLGTAFLDDSVPTHKSSLYIGTGYAMSILGPAIGYVLGGQLLTIYIDVAMGESTDVTEDDPRWLGAWWIGFLLSWIFAWSLIIPFSCFPKHLPGTAEIQAGKTSQAHQSNSNADVKFGKSIKDFPAALKNLMKNAVFMCLVLSTSSEALITTGFATFLPKFIENQFGLTSSFAATLGGAVLIPGAALGQILGGFLVSKFRMTCKNTMKFALFTSGVALTLSFVFMYAKCENEPFAGVSESYNGTGELGNLIAPCNANCNCSRSYYYPVCGDGVQYFSPCFAGCSNPVAHRKPKVYYNCSCIERKTEITSTAETFGFEAKAGKCETHCAKLPIFLCIFFIVIIFTFMAGTPITVSILRCVNHRQRSLALGIQFMVLRLLGTIPGPIIFGFTIDSTCILWDINDCGIKGACWIYDNIKMAHMLVAISVTCKVITMFFNGFAIFLYKPPPSATDVSFHKENAVVTNVLAEQDLNKIVKEG

SEQ ID NO: 82321 - protein, 848 aa, Homo sapiens
  Payload ID: 16386
  Gene Symbol: SLCO5A1
  Gene Name: solute carrier organic anion transporter family, member 5A1
  Uniprot ID: Q9H2Y9
  ENSP ID: ENSP00000260126
MDEGTGLQPGAGEQLEAPATAEAVQERCEPETLRSKSLPVLSSASCRPSLSPTSGDANPAFGCVDSSGHQELKQGPNPLAPSPSAPSTSAGLGDCNHRVDLSKTFSVSSALAMLQERRCLYVVLTDSRCFLVCMCFLTFIQALMVSGYLSSVITTIERRYSLKSSESGLLVSCFDIGNLVVVVFVSYFGGRGRRPLWLAVGGLLIAFGAALFALPHFISPPYQIQELNASAPNDGLCQGGNSTATLEPPACPKDSGGNNHWVYVALFICAQILIGMGSTPIYTLGPTYLDDNVKKENSSLYLAIMYVMGALGPAVGYLLGGLLIGFYVDPRNPVHLDQNDPRFIGNWWSGFLLCAIAMFLVIFPMFTFPKKLPPRHKKKKKKKFSVDAVSDDDVLKEKSNNSEQADKKVSSMGFGKDVRDLPRAAVRILSNMTFLFVSLSYTAESAIVTAFITFIPKFIESQFGIPASNASIYTGVIIVPSAGVGIVLGGYIIKKLKLGARESAKLAMICSGVSLLCFSTLFIVGCESINLGGINIPYTTGPSLTMPHRNLTGSCNVNCGCKIHEYEPVCGSDGITYFNPCLAGCVNSGNLSTGIRNYTECTCVQSRQVITPPTVGQRSQLRVVIVKTYLNENGYAVSGKCKRTCNTLIPFLVFLFIVTFITACAQPSAIIVTLRSVEDEERPFALGMQFVLLRTLAYIPTPIYFGAVIDTTCMLWQQECGVQGSCWEYNVTSFRFVYFGLAAGLKFVGFIFIFLAWYSIKYKEDGLQRRRQREFPLSTVSERVGHPDNARTRSCPAFSTQGEFHEETGLQKGIQCAAQTYPGPFPEAISSSADPGLEESPAALEPPS

SEQ ID NO: 82322 - protein, 793 aa, Homo sapiens
  Payload ID: 16386
  Gene Symbol: SLCO5A1
  Gene Name: solute carrier organic anion transporter family, member 5A1
  Uniprot ID: Q9H2Y9
  ENSP ID: ENSP00000431611
MDEGTGLQPGAGEQLEAPATAEAVQERCEPETLRSKSLPVLSSASCRPSLSPTSGDANPAFGCVDSSGHQELKQGPNPLAPSPSAPSTSAGLGDCNHRVDLSKTFSVSSALAMLQERRCLYVVLTDSRCFLVCMCFLTFIQALMVSGYLSSVITTIERRYSLKSSESGLLVSCFDIGNLVVVVFVSYFGGRGRRPLWLAVGGLLIAFGAALFALPHFISPPYQIQELNASAPNDGLCQGGNSTATLEPPACPKDSGGNNHWVYVALFICAQILIGMGSTPIYTLGPTYLDDNVKKENSSLYLAIMYVMGALGPAVGYLLGGLLIGFYVDPRNPVHLDQNDPRFIGNWWSGFLLCAIAMFLVIFPMFTFPKKLPPRHKKKKKKKFSVDAVSDDDVLKEKSNNSEQADKKVSSMGFGKDVRGVIIVPSAGVGIVLGGYIIKKLKLGARESAKLAMICSGVSLLCFSTLFIVGCESINLGGINIPYTTGPSLTMPHRNLTGSCNVNCGCKIHEYEPVCGSDGITYFNPCLAGCVNSGNLSTGIRNYTECTCVQSRQVITPPTVGQRSQLRVVIVKTYLNENGYAVSGKCKRTCNTLIPFLVFLFIVTFITACAQPSAIIVTLRSVEDEERPFALGMQFVLLRTLAYIPTPIYFGAVIDTTCMLWQQECGVQGSCWEYNVTSFRFVYFGLAAGLKFVGFIFIFLAWYSIKYKEDGLQRRRQREFPLSTVSERVGHPDNARTRSCPAFSTQGEFHEETGLQKGIQCAAQTYPGPFPEAISSSADPGLEESPAALEPPS

SEQ ID NO: 82323 - protein, 312 aa, Homo sapiens
  Payload ID: 16386
  Gene Symbol: SLCO5A1
  Gene Name: solute carrier organic anion transporter family, member 5A1
  ENSP ID: ENSP00000432676
MDEGTGLQPGAGEQLEAPATAEAVQERCEPETLRSKSLPVLSSASCRPSLSPTSGDANPAFGCVDSSGHQELKQGPNPLAPSPSAPSTSAGLGDCNHRVDLSKTFSVSSALAMLQERRCLYVVLTDSRCFLVCMCFLTFIQALMVSGYLSSVITTIERRYSLKSSESGLLVSCFDIGNLVVVVFVSYFGGRGRRPLWLAVGGLLIAFGAALFALPHFISPPYQIQELNASAPNDGLCQGGNSTATLEPPACPKDSGGNNHWVYVALFICAQILIGMGSTPIYTLGPTYLDDNVKKENSSLYLDLLSPCPIGI

SEQ ID NO: 82324 - protein, 687 aa, Homo sapiens
  Payload ID: 16386
  Gene Symbol: SLCO5A1
  Gene Name: solute carrier organic anion transporter family, member 5A1
  Uniprot ID: Q9H2Y9
  ENSP ID: ENSP00000434422
MDEGTGLQPGAGEQLEAPATAEAVQERCEPETLRSKSLPVLSSASCRPSLSPTSGDANPAFGCVDSSGHQELKQGPNPLAPSPSAPSTSAGLGDCNHRVDLSKTFSVSSALAMLQERRCLYVVLTDSRCFLVCMCFLTFIQALMVSGYLSSVITTIERRYSLKSSESGLLVSCFDIGNLVVVVFVSYFGGRGRRPLWLAVGGLLIAFGAALFALPHFISPPYQIQELNASAPNDGLCQGGNSTATLEPPACPKDSGGNNHWVYVALFICAQILIGMGSTPIYTLGPTYLDDNVKKENSSLYLAIMYVMGALGPAVGYLLGGLLIGFYVDPRNPVHLDQNDPRFIGNWWSGFLLCAIAMFLVIFPMFTFPKKLPPRHKKKKKKKFSVDAVSDDDVLKEKSNNSEQADKKVSSMGFGKDVRDLPRAAVRILSNMTFLFVSLSYTAESAIVTAFITFIPKFIESQFGIPASNASIYTGVIIVPSAGVGIVLGGYIIKKLKLGARESAKLAMICSGVSLLCFSTLFIVGCESINLGGINIPYTTGPSLTMPHRNLTGSCNVNCGCKIHEYEPVCGSDGITYFNPCLAGCVNSGNLSTGIRNYTECTCVQSRQVITPPTVGQRSQLRVVIVKTYLNENGYAVSGKCKRTCNTLIPFLVFLFIVTFITACAQPSAIIVTLSIHSYSNLLWSSH

SEQ ID NO: 82325 - protein, 719 aa, Homo sapiens
  Payload ID: 16387
  Gene Symbol: SLCO6A1
  Gene Name: solute carrier organic anion transporter family, member 6A1
  Uniprot ID: Q86UG4
  ENSP ID: ENSP00000369135
MFVGVARHSGSQDEVSRGVEPLEAARAQPAKDRRAKGTPKSSKPGKKHRYLRLLPEALIRFGGFRKRKKAKSSVSKKPGEVDDSLEQPCGLGCLVSTCCECCNNIRCFMIFYCILLICQGVVFGLIDVSIGDFQKEYQLKTIEKLALEKSYDISSGLVAIFIAFYGDRKKVIWFVASSFLIGLGSLLCAFPSINEENKQSKVGIEDICEEIKVVSGCQSSGISFQSKYLSFFILGQTVQGIAGMPLYILGITFIDENVATHSAGIYLGIAECTSMIGYALGYVLGAPLVKVPENTTSATNTTVNNGSPEWLWTWWINFLFAAVVAWCTLIPLSCFPNNMPGSTRIKARKRKQLHFFDSRLKDLKLGTNIKDLCAALWILMKNPVLICLALSKATEYLVIIGASEFLPIYLENQFILTPTVATTLAGLVLIPGGALGQLLGGVIVSTLEMSCKALMRFIMVTSVISLILLVFIIFVRCNPVQFAGINEDYDGTGKLGNLTAPCNEKCRCSSSIYSSICGRDDIEYFSPCFAGCTYSKAQNQKKMYYNCSCIKEGLITADAEGDFIDARPGKCDAKCYKLPLFIAFIFSTLIFSGFSGVPIVLAMTRVVPDKLRSLALGVSYVILRIFGTIPGPSIFKMSGETSCILRDVNKCGHTGRCWIYNKTKMAFLLVGICFLCKLCTIIFTTIAFFIYKRRLNENTDFPDVTVKNPKVKKKEETDL

SEQ ID NO: 82326 - protein, 657 aa, Homo sapiens
  Payload ID: 16387
  Gene Symbol: SLCO6A1
  Gene Name: solute carrier organic anion transporter family, member 6A1
  Uniprot ID: Q86UG4
  ENSP ID: ENSP00000373671
MFVGVARHSGSQDEVSRGVEPLEAARAQPAKDRRAKGTPKSSKPGKKHRYLRLLPEALIRFGGFRKRKKAKSSVSKKPGEVDDSLEQPCGLGCLVSTCCECCNNIRCFMIFYCILLICQGVVFGLIDVSIGDFQKEYQLKTIEKLALEKSYDISSGLVAIFIAFYGDRKKVIWFVASSFLIGLGSLLCAFPSINEENKQSKVGIEGIAECTSMIGYALGYVLGAPLVKVPENTTSATNTTVNNGSPEWLWTWWINFLFAAVVAWCTLIPLSCFPNNMPGSTRIKARKRKQLHFFDSRLKDLKLGTNIKDLCAALWILMKNPVLICLALSKATEYLVIIGASEFLPIYLENQFILTPTVATTLAGLVLIPGGALGQLLGGVIVSTLEMSCKALMRFIMVTSVISLILLVFIIFVRCNPVQFAGINEDYDGTGKLGNLTAPCNEKCRCSSSIYSSICGRDDIEYFSPCFAGCTYSKAQNQKKMYYNCSCIKEGLITADAEGDFIDARPGKCDAKCYKLPLFIAFIFSTLIFSGFSGVPIVLAMTRVVPDKLRSLALGVSYVILRIFGTIPGPSIFKMSGETSCILRDVNKCGHTGRCWIYNKTKMAFLLVGICFLCKLCTIIFTTIAFFIYKRRLNENTDFPDVTVKNPKVKKKEETDL

SEQ ID NO: 82327 - protein, 719 aa, Homo sapiens; identical to SEQ ID NO: 82325
  Payload ID: 16387
  Gene Symbol: SLCO6A1
  Gene Name: solute carrier organic anion transporter family, member 6A1
  Uniprot ID: Q86UG4
  ENSP ID: ENSP00000421339

SEQ ID NO: 82328 - protein, 25 aa, Homo sapiens
  Payload ID: 16387
  Gene Symbol: SLCO6A1
  Gene Name: solute carrier organic anion transporter family, member 6A1
  ENSP ID: ENSP00000421846
LNENTDFPDVTVKNPKVKKKEETDL

SEQ ID NO: 82329 - protein, 466 aa, Homo sapiens
  Payload ID: 16387
  Gene Symbol: SLCO6A1
  Gene Name: solute carrier organic anion transporter family, member 6A1
  ENSP ID: ENSP00000421990
MFVGVARHSGSQDEVSRGVEPLEAARAQPAKDRRAKGTPKSSKPGKKHRYLRLLPEALIRFGGFRKRKKAKSSVSKKPGEVDDSLEQPCGLGCLVSTCCECCNNIRCFMIFYCILLICQGVVFGLIDVSIGDFQKEYQLKTIEKLALEKSYDISSGLVAIFIAFYGDRKKVIWFVASSFLIGLGSLLCAFPSINEENKQSKVGIEGIAECTSMIGYALGYVLGAPLVKVPENTTSATKTGKLGNLTAPCNEKCRCSSSIYSSICGRDDIEYFSPCFAGCTYSKAQNQKKMYYNCSCIKEGLITADAEGDFIDARPGKCDAKCYKLPLFIAFIFSTLIFSGFSGVPIVLAMTRVVPDKLRSLALGVSYVILRIFGTIPGPSIFKMSGETSCILRDVNKCGHTGRCWIYNKTKMAFLLVGICFLCKLCTIIFTTIAFFIYKRRLNENTDFPDVTVKNPKVKKKEETDL

SEQ ID NO: 82330 - protein, 264 aa, Homo sapiens
  Payload ID: 16388
  Gene Symbol: SBSPON
  Gene Name: somatomedin B and thrombospondin, type 1 domain containing
  Uniprot ID: Q8IVN8
  ENSP ID: ENSP00000297354
MRTLWMALCALSRLWPGAQAGCAEAGRCCPGRDPACFARGWRLDRVYGTCFCDQACRFTGDCCFDYDRACPARPCFVGEWSPWSGCADQCKPTTRVRRRSVQQEPQNGGAPCPPLEERAGCLEYSTPQGQDCGHTYVPAFITTSAFNKERTRQATSPHWSTHTEDAGYCMEFKTESLTPHCALENWPLTRWMQYLREGYTVCVDCQPPAMNSVSLRCSGDGLDSDGNQTLHWQAIGNPRCQGTWKKVRRVDQCSCPAVHSFIFI

SEQ ID NO: 82331 - protein, 116 aa, Homo sapiens
  Payload ID: 16389
  Gene Symbol: SST
  Gene Name: somatostatin
  Uniprot ID: P61278
  ENSP ID: ENSP00000287641
MLSCRLQCALAALSIVLALGCVTGAPSDPRLRQFLQKSLAAAAGKQELAKYFLAELLSEPNQTENDALEPEDLSQAAEQDEMRLELQRSANSNPAMAPRERKAGCKNFFWKTFTSC

SEQ ID NO: 82332 - protein, 391 aa, Homo sapiens
  Payload ID: 16390
  Gene Symbol: SSTR1
  Gene Name: somatostatin receptor 1
  Uniprot ID: P30872
  ENSP ID: ENSP00000267377
MFPNGTASSPSSSPSPSPGSCGEGGGSRGPGAGAADGMEEPGRNASQNGTLSEGQGSAILISFIYSVVCLVGLCGNSMVIYVILRYAKMKTATNIYILNLAIADELLMLSVPFLVTSTLLRHWPFGALLCRLVLSVDAVNMFTSIYCLTVLSVDRYVAVVHPIKAARYRRPTVAKVVNLGVWVLSLLVILPIVVFSRTAANSDGTVACNMLMPEPAQRWLVGFVLYTFLMGFLLPVGAICLCYVLIIAKMRMVALKAGWQQRKRSERKITLMVMMVVMVFVICWMPFYVVQLVNVFAEQDDATVSQLSVILGYANSCANPILYGFLSDNFKRSFQRILCLSWMDNAAEEPVDYYATALKSRAYSVEDFQPENLESGGVFRNGTCTSRITTL

SEQ ID NO: 82333 - protein, 369 aa, Homo sapiens
  Payload ID: 16391
  Gene Symbol: SSTR2
  Gene Name: somatostatin receptor 2
  Uniprot ID: P30874
  ENSP ID: ENSP00000350198
MDMADEPLNGSHTWLSIPFDLNGSVVSTNTSNQTEPYYDLTSNAVLTFIYFVVCIIGLCGNTLVIYVILRYAKMKTITNIYILNLAIADELFMLGLPFLAMQVALVHWPFGKAICRVVMTVDGINQFTSIFCLTVMSIDRYLAVVHPIKSAKWRRPRTAKMITMAVWGVSLLVILPIMIYAGLRSNQWGRSSCTINWPGESGAWYTGFIIYTFILGFLVPLTIICLCYLFIIIKVKSSGIRVGSSKRKKSEKKVTRMVSIVVAVFIFCWLPFYIFNVSSVSMAISPTPALKGMFDFVVVLTYANSCANPILYAFLSDNFKKSFQNVLCLVKVSGTDDGERSDSKQDKSRLNETTETQRTLLNGDLQTSI

SEQ ID NO: 82334 - protein, 418 aa, Homo sapiens
  Payload ID: 16392
  Gene Symbol: SSTR3
  Gene Name: somatostatin receptor 3
  Uniprot ID: P32745
  ENSP ID: ENSP00000480971
MDMLHPSSVSTTSEPENASSAWPPDATLGNVSAGPSPAGLAVSGVLIPLVYLVVCVVGLLGNSLVIYVVLRHTASPSVTNVYILNLALADELFMLGLPFLAAQNALSYWPFGSLMCRLVMAVDGINQFTSIFCLTVMSVDRYLAVVHPTRSARWRTAPVARTVSAAVWVASAVVVLPVVVFSGVPRGMSTCHMQWPEPAAAWRAGFIIYTAALGFFGPLLVICLCYLLIVVKVRSAGRRVWAPSCQRRRRSERRVTRMVVAVVALFVLCWMPFYVLNIVNVVCPLPEEPAFFGLYFLVVALPYANSCANPILYGFLSYRFKQGFRRVLLRPSRRVRSQEPTVGPPEKTEEEDEEEEDGEESREGGKGKEMNGRVSQITQPGTSGQERPPSRVASKEQQLLPQEASTGEKSSTMRISYL

SEQ ID NO: 82335 - protein, 418 aa, Homo sapiens; identical to SEQ ID NO: 82334
  Payload ID: 16392
  Gene Symbol: SSTR3
  Gene Name: somatostatin receptor 3
  Uniprot ID: P32745
  ENSP ID: ENSP00000481325

SEQ ID NO: 82336 - protein, 388 aa, Homo sapiens
  Payload ID: 16393
  Gene Symbol: SSTR4
  Gene Name: somatostatin receptor 4
  Uniprot ID: P31391
  ENSP ID: ENSP00000255008
MSAPSTLPPGGEEGLGTAWPSAANASSAPAEAEEAVAGPGDARAAGMVAIQCIYALVCLVGLVGNALVIFVILRYAKMKTATNIYLLNLAVADELFMLSVPFVASSAALRHWPFGSVLCRAVLSVDGLNMFTSVFCLTVLSVDRYVAVVHPLRAATYRRPSVAKLINLGVWLASLLVTLPIAIFADTRPARGGQAVACNLQWPHPAWSAVFVVYTFLLGFLLPVLAIGLCYLLIVGKMRAVALRAGWQQRRRSEKKITRLVLMVVVVFVLCWMPFYVVQLLNLFVTSLDATVNHVSLILSYANSCANPILYGFLSDNFRRFFQRVLCLRCCLLEGAGGAEEEPLDYYATALKSKGGAGCMCPPLPCQQEALQPEPGRKRIPLTRTTTF

SEQ ID NO: 82337 - protein, 364 aa, Homo sapiens
  Payload ID: 16394
  Gene Symbol: SSTR5
  Gene Name: somatostatin receptor 5
  Uniprot ID: P35346
  ENSP ID: ENSP00000293897
MEPLFPASTPSWNASSPGAASGGGDNRTLVGPAPSAGARAVLVPVLYLLVCAAGLGGNTLVIYVVLRFAKMKTVTNIYILNLAVADVLYMLGLPFLATQNAASFWPFGPVLCRLVMTLDGVNQFTSVFCLTVMSVDRYLAVVHPLSSARWRRPRVAKLASAAAWVLSLCMSLPLLVFADVQEGGTCNASWPEPVGLWGAVFIIYTAVLGFFAPLLVICLCYLLIVVKVRAAGVRVGCVRRRSERKVTRMVLVVVLVFAGCWLPFFTVNIVNLAVALPQEPASAGLYFFVVILSYANSCANPVLYGFLSDNFRQSFQKVLCLRKGSGAKDADATEPRPDRIRQQQEATPPAHRAAANGLMQTSKL

SEQ ID NO: 82338 - protein, 2303 aa, Homo sapiens
  Payload ID: 16395
  Gene Symbol: SON
  Gene Name: SON DNA binding protein
  Uniprot ID: P18583
  ENSP ID: ENSP00000300278
MATNIEQIFRSFVVSKFREIQQELSSGRNEGQLNGETNTPIEGNQAGDAAASARSLPNEEIVQKIEEVLSGVLDTELRYKPDLKEGSRKSRCVSVQTDPTDEIPTKKSKKHKKHKNKKKKKKKEKEKKYKRQPEESESKTKSHDDGNIDLESDSFLKFDSEPSAVALELPTRAFGPSETNESPAVVLEPPVVSMEVSEPHILETLKPATKTAELSVVSTSVISEQSEQSVAVMPEPSMTKILDSFAAAPVPTTTLVLKSSEPVVTMSVEYQMKSVLKSVESTSPEPSKIMLVEPPVAKVLEPSETLVVSSETPTEVYPEPSTSTTMDFPESSAIEALRLPEQPVDVPSEIADSSMTRPQELPELPKTTALELQESSVASAMELPGPPATSMPELQGPPVTPVLELPGPSATPVPELPGPLSTPVPELPGPPATAVPELPGPSVTPVPQLSQELPGLPAPSMGLEPPQEVPEPPVMAQELPGLPLVTAAVELPEQPAVTVAMELTEQPVTTTELEQPVGMTTVEHPGHPEVTTATGLLGQPEATMVLELPGQPVATTALELPGQPSVTGVPELPGLPSATRALELSGQPVATGALELPGPLMAAGALEFSGQSGAAGALELLGQPLATGVLELPGQPGAPELPGQPVATVALEISVQSVVTTSELSTMTVSQSLEVPSTTALESYNTVAQELPTTLVGETSVTVGVDPLMAPESHILASNTMETHILASNTMDSQMLASNTMDSQMLASNTMDSQMLASSTMDSQMLATSSMDSQMLATSSMDSQMLATSTMDSQMLATSSMDSQMLATSSMDSQMLATSSMDSQMLATSSMDSQMLATSTMDSQMLATSTMDSQMLATSSMDSQMLASGTMDSQMLASGTMDAQMLASGTMDAQMLASSTQDSAMLGSKSPDPYRLAQDPYRLAQDPYRLGHDPYRLGHDAYRLGQDPYRLGHDPYRLTPDPYRMSPRPYRIAPRSYRIAPRPYRLAPRPLMLASRRSMMMSYAAERSMMSSYERSMMSYERSMMSPMAERSMMSAYERSMMSAYERSMMSPMAERSMMSAYERSMMSAYERSMMSPMADRSMMSMGADRSMMSSYSAADRSMMSSYSAADRSMMSSYTADRSMMSMAADSYTDSYTDTYTEAYMVPPLPPEEPPTMPPLPPEEPPMTPPLPPEEPPEGPALPTEQSALTAENTWPTEVPSSPSEESVSQPEPPVSQSEISEPSAVPTDYSVSASDPSVLVSEAAVTVPEPPPEPESSITLTPVESAVVAEEHEVVPERPVTCMVSETPAMSAEPTVLASEPPVMSETAETFDSMRASGHVASEVSTSLLVPAVTTPVLAESILEPPAMAAPESSAMAVLESSAVTVLESSTVTVLESSTVTVLEPSVVTVPEPPVVAEPDYVTIPVPVVSALEPSVPVLEPAVSVLQPSMIVSEPSVSVQESTVTVSEPAVTVSEQTQVIPTEVAIESTPMILESSIMSSHVMKGINLSSGDQNLAPEIGMQEIALHSGEEPHAEEHLKGDFYESEHGINIDLNINNHLIAKEMEHNTVCAAGTSPVGEIGEEKILPTSETKQRTVLDTYPGVSEADAGETLSSTGPFALEPDATGTSKGIEFTTASTLSLVNKYDVDLSLTTQDTEHDMVISTSPSGGSEADIEGPLPAKDIHLDLPSNNNLVSKDTEEPLPVKESDQTLAALLSPKESSGGEKEVPPPPKETLPDSGFSANIEDINEADLVRPLLPKDMERLTSLRAGIEGPLLASDVGRDRSAASPVVSSMPERASESSSEEKDDYEIFVKVKDTHEKSKKNKNRDKGEKEKKRDSSLRSRSKRSKSSEHKSRKRTSESRSRARKRSSKSKSHRSQTRSRSRSRRRRRSSRSRSKSRGRRSVSKEKRKRSPKHRSKSRERKRKRSSSRDNRKTVRARSRTPSRRSRSHTPSRRRRSRSVGRRRSFSISPSRRSRTPSRRSRTPSRRSRTPSRRSRTPSRRSRTPSRRSRTPSRRRRSRSVVRRRSFSISPVRLRRSRTPLRRRFSRSPIRRKRSRSSERGRSPKRLTDLDKAQLLEIAKANAAAMCAKAGVPLPPNLKPAPPPTIEEKVAKKSGGATIEELTEKCKQIAQSKEDDDVIVNKPHVSDEEEEEPPFYHHPFKLSEPKPIFFNLNIAAAKPTPPKSQVTLTKEFPVSSGSQHRKKEADSVYGEWVPVEKNGEENKDDDNVFSSNLPSEGRVKRQGRVRRQMKQPAASHLTVTRCNSLCGTKPQSEKHRIAENSVITSLPNIGPSLHLWEGSPRYNYLASRFASRLYSSRFWW

SEQ ID NO: 82339 - protein, 2426 aa, Homo sapiens
  Payload ID: 16395
  Gene Symbol: SON
  Gene Name: SON DNA binding protein
  Uniprot ID: P18583
  ENSP ID: ENSP00000348984
MATNIEQIFRSFVVSKFREIQQELSSGRNEGQLNGETNTPIEGNQAGDAAASARSLPNEEIVQKIEEVLSGVLDTELRYKPDLKEGSRKSRCVSVQTDPTDEIPTKKSKKHKKHKNKKKKKKKEKEKKYKRQPEESESKTKSHDDGNIDLESDSFLKFDSEPSAVALELPTRAFGPSETNESPAVVLEPPVVSMEVSEPHILETLKPATKTAELSVVSTSVISEQSEQSVAVMPEPSMTKILDSFAAAPVPTTTLVLKSSEPVVTMSVEYQMKSVLKSVESTSPEPSKIMLVEPPVAKVLEPSETLVVSSETPTEVYPEPSTSTTMDFPESSAIEALRLPEQPVDVPSEIADSSMTRPQELPELPKTTALELQESSVASAMELPGPPATSMPELQGPPVTPVLELPGPSATPVPELPGPLSTPVPELPGPPATAVPELPGPSVTPVPQLSQELPGLPAPSMGLEPPQEVPEPPVMAQELPGLPLVTAAVELPEQPAVTVAMELTEQPVTTTELEQPVGMTTVEHPGHPEVTTATGLLGQPEATMVLELPGQPVATTALELPGQPSVTGVPELPGLPSATRALELSGQPVATGALELPGPLMAAGALEFSGQSGAAGALELLGQPLATGVLELPGQPGAPELPGQPVATVALEISVQSVVTTSELSTMTVSQSLEVPSTTALESYNTVAQELPTTLVGETSVTVGVDPLMAPESHILASNTMETHILASNTMDSQMLASNTMDSQMLASNTMDSQMLASSTMDSQMLATSSMDSQMLATSSMDSQMLATSTMDSQMLATSSMDSQMLATSSMDSQMLATSSMDSQMLATSSMDSQMLATSTMDSQMLATSTMDSQMLATSSMDSQMLASGTMDSQMLASGTMDAQMLASGTMDAQMLASSTQDSAMLGSKSPDPYRLAQDPYRLAQDPYRLGHDPYRLGHDAYRLGQDPYRLGHDPYRLTPDPYRMSPRPYRIAPRSYRIAPRPYRLAPRPLMLASRRSMMMSYAAERSMMSSYERSMMSYERSMMSPMAERSMMSAYERSMMSAYERSMMSPMAERSMMSAYERSMMSAYERSMMSPMADRSMMSMGADRSMMSSYSAADRSMMSSYSAADRSMMSSYTADRSMMSMAADSYTDSYTDTYTEAYMVPPLPPEEPPTMPPLPPEEPPMTPPLPPEEPPEGPALPTEQSALTAENTWPTEVPSSPSEESVSQPEPPVSQSEISEPSAVPTDYSVSASDPSVLVSEAAVTVPEPPPEPESSITLTPVESAVVAEEHEVVPERPVTCMVSETPAMSAEPTVLASEPPVMSETAETFDSMRASGHVASEVSTSLLVPAVTTPVLAESILEPPAMAAPESSAMAVLESSAVTVLESSTVTVLESSTVTVLEPSVVTVPEPPVVAEPDYVTIPVPVVSALEPSVPVLEPAVSVLQPSMIVSEPSVSVQESTVTVSEPAVTVSEQTQVIPTEVAIESTPMILESSIMSSHVMKGINLSSGDQNLAPEIGMQEIALHSGEEPHAEEHLKGDFYESEHGINIDLNINNHLIAKEMEHNTVCAAGTSPVGEIGEEKILPTSETKQRTVLDTYPGVSEADAGETLSSTGPFALEPDATGTSKGIEFTTASTLSLVNKYDVDLSLTTQDTEHDMVISTSPSGGSEADIEGPLPAKDIHLDLPSNNNLVSKDTEEPLPVKESDQTLAALLSPKESSGGEKEVPPPPKETLPDSGFSANIEDINEADLVRPLLPKDMERLTSLRAGIEGPLLASDVGRDRSAASPVVSSMPERASESSSEEKDDYEIFVKVKDTHEKSKKNKNRDKGEKEKKRDSSLRSRSKRSKSSEHKSRKRTSESRSRARKRSSKSKSHRSQTRSRSRSRRRRRSSRSRSKSRGRRSVSKEKRKRSPKHRSKSRERKRKRSSSRDNRKTVRARSRTPSRRSRSHTPSRRRRSRSVGRRRSFSISPSRRSRTPSRRSRTPSRRSRTPSRRSRTPSRRSRTPSRRSRTPSRRRRSRSVVRRRSFSISPVRLRRSRTPLRRRFSRSPIRRKRSRSSERGRSPKRLTDLDKAQLLEIAKANAAAMCAKAGVPLPPNLKPAPPPTIEEKVAKKSGGATIEELTEKCKQIAQSKEDDDVIVNKPHVSDEEEEEPPFYHHPFKLSEPKPIFFNLNIAAAKPTPPKSQVTLTKEFPVSSGSQHRKKEADSVYGEWVPVEKNGEENKDDDNVFSSNLPSEPVDISTAMSERALAQKRLSENAFDLEAMSMLNRAQERIDAWAQLNSIPGQFTGSTGVQVLTQEQLANTGAQAWIKKDQFLRAAPVTGGMGAVLMRKMGWREGEGLGKNKEGNKEPILVDFKTDRKGLVAVGERAQKRSGNFSAAMKDLSGKHPVSALMEICNKRRWQPPEFLLVHDSGPDHRKHFLFRVLRNGALTRPNCMFFLNRY

SEQ ID NO: 82340 - protein, 2108 aa, Homo sapiens
  Payload ID: 16395
  Gene Symbol: SON
  Gene Name: SON DNA binding protein
  Uniprot ID: P18583
  ENSP ID: ENSP00000371095
MATNIEQIFRSFVVSKFREIQQELSSGRNEGQLNGETNTPIEGNQAGDAAASARSLPNEEIVQKIEEVLSGVLDTELRYKPDLKEGSRKSRCVSVQTDPTDEIPTKKSKKHKKHKNKKKKKKKEKEKKYKRQPEESESKTKSHDDGNIDLESDSFLKFDSEPSAVALELPTRAFGPSETNESPAVVLEPPVVSMEVSEPHILETLKPATKTAELSVVSTSVISEQSEQSVAVMPEPSMTKILDSFAAAPVPTTTLVLKSSEPVVTMSVEYQMKSVLKSVESTSPEPSKIMLVEPPVAKVLEPSETLVVSSETPTEVYPEPSTSTTMDFPESSAIEALRLPEQPVDVPSEIADSSMTRPQELPELPKTTALELQESSVASAMELPGPPATSMPELQGPPVTPVLELPGPSATPVPELPGPLSTPVPELPGPPATAVPELPGPSVTPVPQLSQELPGLPAPSMGLEPPQEVPEPPVMAQELPGLPLVTAAVELPEQPAVTVAMELTEQPVTTTELEQPVGMTTVEHPGHPEVTTATGLLGQPEATMVLELPGQPVATTALELPGQPSVTGVPELPGLPSATRALELSGQPVATGALELPGPLMAAGALEFSGQSGAAGALELLGQPLATGVLELPGQPGAPELPGQPVATVALEISVQSVVTTSELSTMTVSQSLEVPSTTALESYNTVAQELPTTLVGETSVTVGVDPLMAPESHILASNTMETHILASNTMDSQMLASNTMDSQMLASNTMDSQMLASSTMDSQMLATSSMDSQMLATSSMDSQMLATSTMDSQMLATSSMDSQMLATSSMDSQMLATSSMDSQMLATSSMDSQMLATSTMDSQMLATSTMDSQMLATSSMDSQMLASGTMDSQMLASGTMDAQMLASGTMDAQMLASSTQDSAMLGSKSPDPYRLAQDPYRLAQDPYRLGHDPYRLGHDAYRLGQDPYRLGHDPYRLTPDPYRMSPRPYRIAPRSYRIAPRPYRLAPRPLMLASRRSMMMSYAAERSMMSSYERSMMSYERSMMSPMAERSMMSAYERSMMSAYERSMMSPMAERSMMSAYERSMMSAYERSMMSPMADRSMMSMGADRSMMSSYSAADRSMMSSYSAADRSMMSSYTADRSMMSMAADSYTDSYTDTYTEAYMVPPLPPEEPPTMPPLPPEEPPMTPPLPPEEPPEGPALPTEQSALTAENTWPTEVPSSPSEESVSQPEPPVSQSEISEPSAVPTDYSVSASDPSVLVSEAAVTVPEPPPEPESSITLTPVESAVVAEEHEVVPERPVTCMVSETPAMSAEPTVLASEPPVMSETAETFDSMRASGHVASEVSTSLLVPAVTTPVLAESILEPPAMAAPESSAMAVLESSAVTVLESSTVTVLESSTVTVLEPSVVTVPEPPVVAEPDYVTIPVPVVSALEPSVPVLEPAVSVLQPSMIVSEPSVSVQESTVTVSEPAVTVSEQTQVIPTEVAIESTPMILESSIMSSHVMKGINLSSGDQNLAPEIGMQEIALHSGEEPHAEEHLKGDFYESEHGINIDLNINNHLIAKEMEHNTVCAAGTSPVGEIGEEKILPTSETKQRTVLDTYPGVSEADAGETLSSTGPFALEPDATGTSKGIEFTTASTLSLVNKYDVDLSLTTQDTEHDMVISTSPSGGSEADIEGPLPAKDIHLDLPSNNNLVSKDTEEPLPVKESDQTLAALLSPKESSGGEKEVPPPPKETLPDSGFSANIEDINEADLVRPLLPKDMERLTSLRAGIEGPLLASDVGRDRSAASPVVSSMPERASESSSEEKDDYEIFVKVKDTHEKSKKNKNRDKGEKEKKRDSSLRSRSKRSKSSEHKSRKRTSESRSRARKRSSKSKSHRSQTRSRSRSRRRRRSSRSRSKSRGRRSVSKEKRKRSPKHRSKSRERKRKRSSSRDNRKTVRARSRTPSRRSRSHTPSRRRRSRSVGRRRSFSISPSRRSRTPSRRSRTPSRRSRTPSRRSRTPSRRSRTPSRRSRTPSRRRRSRSVVRRRSFSISPVRLRRSRTPLRRRFSRSPIRRKRSRSSERGRSPKRLTDLDKAQLLEIAKANAAAMCAKAGVPLPPNLKPAPPPTIEEKVAKKSGGATIEELTEF

SEQ ID NO: 82341 - protein, 454 aa, Homo sapiens
  Payload ID: 16395
  Gene Symbol: SON
  Gene Name: SON DNA binding protein
  ENSP ID: ENSP00000371111
MATNIEQIFRSFVVSKFREIQQELSSGRNEGQLNGETNTPIEGNQAGDAAASARSLPNEEIVQKIEEVLSGVLDTELRYKPDKAQLLEIAKANAAAMCAKAGVPLPPNLKPAPPPTIEEKVAKKSGGATIEELTEKCKQIAQSKEDDDVIVNKPHVSDEEEEEPPFYHHPFKLSEPKPIFFNLNIAAAKPTPPKSQVTLTKEFPVSSGSQHRKKEADSVYGEWVPVEKNGEENKDDDNVFSSNLPSEPVDISTAMSERALAQKRLSENAFDLEAMSMLNRAQERIDAWAQLNSIPGQFTGSTGVQVLTQEQLANTGAQAWIKKDQFLRAAPVTGGMGAVLMRKMGWREGEGLGKNKEGNKEPILVDFKTDRKGLVAVGERAQKRSGNFSAAMKDLSGKHPVSALMEICNKRRWQPPEFLLVHDSGPDHRKHFLFRVLRNGALTRPNCMFFLNRY

SEQ ID NO: 82342 - protein, 2325 aa, Homo sapiens
  Payload ID: 16395
  Gene Symbol: SON
  Gene Name: SON DNA binding protein
  Uniprot ID: P18583
  ENSP ID: ENSP00000399783
MATNIEQIFRSFVVSKFREIQQELSSGRNEGQLNGETNTPIEGNQAGDAAASARSLPNEEIVQKIEEVLSGVLDTELRYKPDLKEGSRKSRCVSVQTDPTDEIPTKKSKKHKKHKNKKKKKKKEKEKKYKRQPEESESKTKSHDDGNIDLESDSFLKFDSEPSAVALELPTRAFGPSETNESPAVVLEPPVVSMEVSEPHILETLKPATKTAELSVVSTSVISEQSEQSVAVMPEPSMTKILDSFAAAPVPTTTLVLKSSEPVVTMSVEYQMKSVLKSVESTSPEPSKIMLVEPPVAKVLEPSETLVVSSETPTEVYPEPSTSTTMDFPESSAIEALRLPEQPVDVPSEIADSSMTRPQELPELPKTTALELQESSVASAMELPGPPATSMPELQGPPVTPVLELPGPSATPVPELPGPLSTPVPELPGPPATAVPELPGPSVTPVPQLSQELPGLPAPSMGLEPPQEVPEPPVMAQELPGLPLVTAAVELPEQPAVTVAMELTEQPVTTTELEQPVGMTTVEHPGHPEVTTATGLLGQPEATMVLELPGQPVATTALELPGQPSVTGVPELPGLPSATRALELSGQPVATGALELPGPLMAAGALEFSGQSGAAGALELLGQPLATGVLELPGQPGAPELPGQPVATVALEISVQSVVTTSELSTMTVSQSLEVPSTTALESYNTVAQELPTTLVGETSVTVGVDPLMAPESHILASNTMETHILASNTMDSQMLASNTMDSQMLASNTMDSQMLASSTMDSQMLATSSMDSQMLATSSMDSQMLATSTMDSQMLATSSMDSQMLATSSMDSQMLATSSMDSQMLATSSMDSQMLATSTMDSQMLATSTMDSQMLATSSMDSQMLASGTMDSQMLASGTMDAQMLASGTMDAQMLASSTQDSAMLGSKSPDPYRLAQDPYRLAQDPYRLGHDPYRLGHDAYRLGQDPYRLGHDPYRLTPDPYRMSPRPYRIAPRSYRIAPRPYRLAPRPLMLASRRSMMMSYAAERSMMSSYERSMMSYERSMMSPMAERSMMSAYERSMMSAYERSMMSPMAERSMMSAYERSMMSAYERSMMSPMADRSMMSMGADRSMMSSYSAADRSMMSSYSAADRSMMSSYTADRSMMSMAADSYTDSYTDTYTEAYMVPPLPPEEPPTMPPLPPEEPPMTPPLPPEEPPEGPALPTEQSALTAENTWPTEVPSSPSEESVSQPEPPVSQSEISEPSAVPTDYSVSASDPSVLVSEAAVTVPEPPPEPESSITLTPVESAVVAEEHEVVPERPVTCMVSETPAMSAEPTVLASEPPVMSETAETFDSMRASGHVASEVSTSLLVPAVTTPVLAESILEPPAMAAPESSAMAVLESSAVTVLESSTVTVLESSTVTVLEPSVVTVPEPPVVAEPDYVTIPVPVVSALEPSVPVLEPAVSVLQPSMIVSEPSVSVQESTVTVSEPAVTVSEQTQVIPTEVAIESTPMILESSIMSSHVMKGINLSSGDQNLAPEIGMQEIALHSGEEPHAEEHLKGDFYESEHGINIDLNINNHLIAKEMEHNTVCAAGTSPVGEIGEEKILPTSETKQRTVLDTYPGVSEADAGETLSSTGPFALEPDATGTSKGIEFTTASTLSLVNKYDVDLSLTTQDTEHDMVISTSPSGGSEADIEGPLPAKDIHLDLPSNNNLVSKDTEEPLPVKESDQTLAALLSPKESSGGEKEVPPPPKETLPDSGFSANIEDINEADLVRPLLPKDMERLTSLRAGIEGPLLASDVGRDRSAASPVVSSMPERASESSSEEKDDYEIFVKVKDTHEKSKKNKNRDKGEKEKKRDSSLRSRSKRSKSSEHKSRKRTSESRSRARKRSSKSKSHRSQTRSRSRSRRRRRSSRSRSKSRGRRSVSKEKRKRSPKHRSKSRERKRKRSSSRDNRKTVRARSRTPSRRSRSHTPSRRRRSRSVGRRRSFSISPSRRSRTPSRRSRTPSRRSRTPSRRSRTPSRRSRTPSRRSRTPSRRRRSRSVVRRRSFSISPVRLRRSRTPLRRRFSRSPIRRKRSRSSERGRSPKRLTDLDKAQLLEIAKANAAAMCAKAGVPLPPNLKPAPPPTIEEKVAKKSGGATIEELTEKCKQIAQSKEDDDVIVNKPHVSDEEEEEPPFYHHPFKLSEPKPIFFNLNIAAAKPTPPKSQVTLTKEFPVSSGSQHRKKEADSVYGEWVPVEKNGEENKDDDNVFSSNLPSEPVDISTAMSERALAQKRLSENAFDLEAMSMLNRAQERIDAWAQLNSIPGQFTGSTGVQVLTQEQLANTGAQAWIKKGQILVAVFLPRSVPAVLFTTLLLPRPRISS

SEQ ID NO: 82343 - protein, 1454 aa, Homo sapiens
  Payload ID: 16395
  Gene Symbol: SON
  Gene Name: SON DNA binding protein
  ENSP ID: ENSP00000400985
  MOD_RES (1)..(1): Any amino acid
XRSMMSSYERSMMSYERSMMSPMAERSMMSAYERSMMSAYERSMMSPMAERSMMSAYERSMMSAYERSMMSPMADRSMMSMGADRSMMSSYSAADRSMMSSYSAADRSMMSSYTADRSMMSMAADSYTDSYTDTYTEAYMVPPLPPEEPPTMPPLPPEEPPMTPPLPPEEPPEGPALPTEQSALTAENTWPTEVPSSPSEESVSQPEPPVSQSEISEPSAVPTDYSVSASDPSVLVSEAAVTVPEPPPEPESSITLTPVESAVVAEEHEVVPERPVTCMVSETPAMSAEPTVLASEPPVMSETAETFDSMRASGHVASEVSTSLLVPAVTTPVLAESILEPPAMAAPESSAMAVLESSAVTVLESSTVTVLESSTVTVLEPSVVTVPEPPVVAEPDYVTIPVPVVSALEPSVPVLEPAVSVLQPSMIVSEPSVSVQESTVTVSEPAVTVSEQTQVIPTEVAIESTPMILESSIMSSHVMKGINLSSGDQNLAPEIGMQEIALHSGEEPHAEEHLKGDFYESEHGINIDLNINNHLIAKEMEHNTVCAAGTSPVGEIGEEKILPTSETKQRTVLDTYPGVSEADAGETLSSTGPFALEPDATGTSKGIEFTTASTLSLVNKYDVDLSLTTQDTEHDMVISTSPSGGSEADIEGPLPAKDIHLDLPSNNNLVSKDTEEPLPVKESDQTLAALLSPKESSGGEKEVPPPPKETLPDSGFSANIEDINEADLVRPLLPKDMERLTSLRAGIEGPLLASDVGRDRSAASPVVSSMPERASESSSEEKDDYEIFVKVKDTHEKSKKNKNRDKGEKEKKRDSSLRSRSKRSKSSEHKSRKRTSESRSRARKRSSKSKSHRSQTRSRSRSRRRRRSSRSRSKSRGRRSVSKEKRKRSPKHRSKSRERKRKRSSSRDNRKTVRARSRTPSRRSRSHTPSRRRRSRSVGRRRSFSISPSRRSRTPSRRSRTPSRRSRTPSRRSRTPSRRSRTPSRRSRTPSRRRRSRSVVRRRSFSISPVRLRRSRTPLRRRFSRSPIRRKRSRSSERGRSPKRLTDLDKAQLLEIAKANAAAMCAKAGVPLPPNLKPAPPPTIEEKVAKKSGGATIEELTEKCKQIAQSKEDDDVIVNKPHVSDEEEEEPPFYHHPFKLSEPKPIFFNLNIAAAKPTPPKSQVTLTKEFPVSSGSQHRKKEADSVYGEWVPVEKNGEENKDDDNVFSSNLPSEPVDISTAMSERALAQKRLSENAFDLEAMSMLNRAQERIDAWAQLNSIPGQFTGSTGVQVLTQEQLANTGAQAWIKKDQFLRAAPVTGGMGAVLMRKMGWREGEGLGKNKEGNKEPILVDFKTDRKGLVAVGERAQKRSGNFSAAMKDLSGKHPVSALMEICNKRRWQPPEFLLVHDSGPDHRKHFLFRVLINGSAYQPSFASPNKKHAKATAATVVLQAMGLVPKDLMANATCFRSASRR

SEQ ID NO: 82344 - protein, 92 aa, Homo sapiens
  Payload ID: 16395
  Gene Symbol: SON
  Gene Name: SON DNA binding protein
  ENSP ID: ENSP00000401942
VDISTAMSERALAQKRLSENAFDLEAMSMLNRAQERIDAWAQLNSIPGQFTGSTGVQVLTQEQLANTGAQAWIKKCLCLLVRSLGPRSSLLL

SEQ ID NO: 82345 - protein, 97 aa, Homo sapiens
  Payload ID: 16395
  Gene Symbol: SON
  Gene Name: SON DNA binding protein
  ENSP ID: ENSP00000404135
  MOD_RES (1)..(1): Any amino acid
XRALAQKRLSENAFDLEAMSMLNRAQERIDAWAQLNSIPGQFTGSTGVQVLTQEQLANTGAQAWIKKGQILVAVFLPRSVPAVLFTTLLLPRPRISS

SEQ ID NO: 82346 - protein, 343 aa, Homo sapiens
  Payload ID: 16395
  Gene Symbol: SON
  Gene Name: SON DNA binding protein
  ENSP ID: ENSP00000405807
SRSVGRRRSFSISPSRRSRTPSRRSRTPSRRSRTPSRRSRTPSRRSRTPSRRSRTPSRRRRSRSVVRRRSFSISPVRLRRSRTPLRRRFSRSPIRRKRSRSSERGRSPKRLTDLDKAQLLEIAKANAAAMCAKAGVPLPPNLKPAPPPTIEEKVAKKSGGATIEELTEKCKQIAQSKEDDDVIVNKPHVSDEEEEEPPFYHHPFKLSEPKPIFFNLNIAAAKPTPPKSQVTLTKEFPVSSGSQHRKKEADSVYGEWVPVEKNGEENKDDDNVFSSNLPSEPVDISTAMSERALAQKRLSENAFDLEAMSMLNRAQERVCSSFLKKIIIYHQPTHTNVPVLMSK

SEQ ID NO: 82347 - protein, 1318 aa, Homo sapiens
  Payload ID: 16396
  Gene Symbol: SOS1
  Gene Name: son of sevenless homolog 1 (Drosophila)
  ENSP ID: ENSP00000378479
MQAQQLPYEFFSEENAPKWRGLLVPALKKVQGQVHPTLESNDDALQYVEELILQLLNMLCQAQPRSASDVEERVQKSFPHPIDKWAIADAQSAIEKRKRRNPLSLPVEKIHPLLKEVLGYKIDHQVSVYIVAVLEYISADILKLVGNYVRNIRHYEITKQDIKVAMCADKVLMDMFHQDVEDINILSLTDEEPSTSGEQTYYDLVKAFMAEIRQYIRELNLIIKVFREPFVSNSKLFSANDVENIFSRIVDIHELSVKLLGHIEDTVEMTDEGSPHPLVGSCFEDLAEELAFDPYESYARDILRPGFHDRFLSQLSKPGAALYLQSIGEGFKEAVQYVLPRLLLAPVYHCLHYFELLKQLEEKSEDQEDKECLKQAITALLNVQSGMEKICSKSLAKRRLSESACRFYSQQMKGKQLAIKKMNEIQKNIDGWEGKDIGQCCNEFIMEGTLTRVGAKHERHIFLFDGLMICCKSNHGQPRLPGASNAEYRLKEKFFMRKVQINDKDDTNEYKHAFEIILKDENSVIFSAKSAEEKNNWMAALISLQYRSTLERMLDVTMLQEEKEEQMRLPSADVYRFAEPDSEENIIFEENMQPKAGIPIIKAGTVIKLIERLTYHMYADPNFVRTFLTTYRSFCKPQELLSLIIERFEIPEPEPTEADRIAIENGDQPLSAELKRFRKEYIQPVQLRVLNVCRHWVEHHFYDFERDAYLLQRMEEFIGTVRGKAMKKWVESITKIIQRKKIARDNGPGHNITFQSSPPTVEWHISRPGHIETFDLLTLHPIEIARQLTLLESDLYRAVQPSELVGSVWTKEDKEINSPNLLKMIRHTTNLTLWFEKCIVETENLEERVAVVSRIIEILQVFQELNNFNGVLEVVSAMNSSPVYRLDHTFEQIPSRQKKILEEAHELSEDHYKKYLAKLRSINPPCVPFFGIYLTNILKTEEGNPEVLKRHGKELINFSKRRKVAEITGEIQQYQNQPYCLRVESDIKRFFENLNPMGNSMEKEFTDYLFNKSLEIEPRNPKPLPRFPKKYSYPLKSPGVRPSNPRPGTMRHPTPLQQEPRKISYSRIPESETESTASAPNSPRTPLTPPPASGASSTTDVCSVFDSDHSSPFHSRSASVSSISLTKGTDEVPVPPPVPPRRRPESAPAESSPSKIMSKHLDSPPAIPPRQPTSKAYSPRYSISDRTSISDPPESPPLLPPREPVRTPDVFSSSPLHLQPPPLGKKSDHGNAFFPNSPSPFTPPPPQTPSPHGTRRHLPSPPLTQEVDLHSIAGPPVPPRQSTSQHIPKLPPKTYKREHTHPSMHRDGPPLLENAHSS

SEQ ID NO: 82348 - protein, 1333 aa, Homo sapiens [sequence omitted]

SEQ ID NO: 82349 - protein, 1333 aa, Homo sapiens [sequence omitted]

SEQ ID NO: 82350 - protein, 102 aa, Homo sapiens
  Payload ID: 16396
  Gene Symbol: SOS1
  Gene Name: son of sevenless homolog 1 (Drosophila)
  ENSP ID: ENSP00000393899
MLCQAQPRSASDVEERVQKSFPHPIDKWAIADAQSAIEKRKRRNPLSLPVEKIHPLLKEVLGYKIDHQVSVYIVAVLEYISADILKLVGNYVRNIRHYEITK

SEQ ID NO: 82351 - protein, 1332 aa, Homo sapiens [sequence omitted]

SEQ ID NO: 82352 - protein, 1299 aa, Homo sapiens
  Payload ID: 16397
  Gene Symbol: SOS2
  Gene Name: son of sevenless homolog 2 (Drosophila)
  Uniprot ID: Q07890
  ENSP ID: ENSP00000445328
MQQAPQPYEFFSEENSPKWRGLLVSALRKVQEQVHPTLSANEESLYYIEELIFQLLNKLCMAQPRTVQDVEERVQKTFPHPIDKWAIADAQSAIEKRKRRNPLLLPVDKIHPSLKEVLGYKVDYHVSLYIVAVLEYISADILKLAGNYVFNIRHYEISQQDIKVSMCADKVLMDMFDQDDIGLVSLCEDEPSSSGELNYYDLVRTEIAEERQYLRELNMIIKVFREAFLSDRKLFKPSDIEKIFSNISDIHELTVKLLGLIEDTVEMTDESSPHPLAGSCFEDLAEEQAFDPYETLSQDILSPEFHEHFNKLMARPAVALHFQQLKACSEEQEDRECLNQAITALMNLQGSMDRIYKQYSPRRRPGDPVCPFYSHQLRSKHLAIKKMNEIQKNIDGWEGKDIGQCCNEFIMEGPLTRIGAKHERHIFLFDGLMISCKPNHGQTRLPGYSSAEYRLKEKFVMRKIQICDKEDTCEHKHAFELVSKDENSIIFAAKSAEEKNNWMAALISLHYRSTLDRMLDSVLLKEENEQPLRLPSPEVYRFVVKDSEENIVFEDNLQSRSGIPIIKGGTVVKLIERLTYHMYADPNFVRTFLTTYRSFCKPQELLSLLIERFEIPEPEPTDADKLAIEKGEQPISADLKRFRKEYVQPVQLRILNVFRHWVEHHFYDFERDLELLERLESFISSVRGKAMKKWVESIAKIIRRKKQAQANGVSHNITFESPPPPIEWHISKPGQFETFDLMTLHPIEIARQLTLLESDLYRKVQPSELVGSVWTKEDKEINSPNLLKMIRHTTNLTLWFEKCIVEAENFEERVAVLSRIIEILQVFQDLNNFNGVLEIVSAVNSVSVYRLDHTFEALQERKRKILDEAVELSQDHFKKYLVKLKSINPPCVPFFGIYLTNILKTEEGNNDFLKKKGKDLINFSKRRKVAEITGEIQQYQNQPYCLRIEPDMRRFFENLNPMGSASEKEFTDYLFNKSLEIEPRNCKQPPRFPRKSTFSLKSPGIRPNTGRHGSTSGTLRGHPTPLEREPCKISFSRIAETELESTVSAPTSPNTPSTPPVSASSDLSVFLDVDLNSSCGSNSIFAPVLLPHSKSFFSSCGSLHKLSEEPLIPPPLPPRKKFDHDASNSKGNMKSDDDPPAIPPRQPPPPKVKPRVPVPTGAFDGPLHSPPPPPPRDPLPDTPPPVPLRPPEHFINCPFNLQPPPLGHLHRDSDWLRDISTCPNSPSTPPSTPSPRVPRRCYVLSSSQNNLAHPPAPPVPPRQNSSPHLPKLPPKTYKRELSHPPLYRLPLLENAETPQ

SEQ ID NO: 82353 - protein, 70 aa, Homo sapiens
  Payload ID: 16397
  Gene Symbol: SOS2
  Gene Name: son of sevenless homolog 2 (Drosophila)
  ENSP ID: ENSP00000452553
MQQAPQPYEFFSEENSPKWRGLLVSALRKKCKAWFSSIVLLMSCYSIYGFRNKCIPLSQLMKSLSIILKS

SEQ ID NO: 82354 - protein, 419 aa, Homo sapiens
  Payload ID: 16397
  Gene Symbol: SOS2
  Gene Name: son of sevenless homolog 2 (Drosophila)
  ENSP ID: ENSP00000484766
  MOD_RES (1)..(1): Any amino acid
XSQDILSPEFHEHFNKLMARPAVALHFQSIADGFKEAVRYVLPRLMLVPVYHCWHYFELLKQLKACSEEQEDRECLNQAITALMNLQGSMDRIYKQYSPRRRPGDPVCPFYSHQLRSKHLAIKKMNEIQKNIDGWEGKDIGQCCNEFIMEGPLTRIGAKHERHIFLFDGLMISCKPNHGQTRLPGYSSAEYRLKEKFVMRKIQICDKEDTCEHKHAFELVSKDENSIIFAAKSAEEKNNWMAALISLHYRSTLDRMLDSVLLKEENEQPLRLPSPEVYRFVVKDSEENIVFEDNLQSRSGIPIIKGGTVVKLIERLTYHMYADPNFVRTFLTTYRSFCKPQELLSLLIERFEIPEPEPTDADKLAIEKGEQPISADLKRFRKEYVQPVQLRFGLNIFYIYIYTHIYTHTHTFYVSVFNI

SEQ ID NO: 82355 - protein, 462 aa, Homo sapiens
  Payload ID: 16398
  Gene Symbol: SHH
  Gene Name: sonic hedgehog
  Uniprot ID: Q15465
  ENSP ID: ENSP00000297261
MLLLARCLLLVLVSSLLVCSGLACGPGRGFGKRRHPKKLTPLAYKQFIPNVAEKTLGASGRYEGKISRNSERFKELTPNYNPDIIFKDEENTGADRLMTQRCKDKLNALAISVMNQWPGVKLRVTEGWDEDGHHSEESLHYEGRAVDITTSDRDRSKYGMLARLAVEAGFDWVYYESKAHIHCSVKAENSVAAKSGGCFPGSATVHLEQGGTKLVKDLSPGDRVLAADDQGRLLYSDFLTFLDRDDGAKKVFYVIETREPRERLLLTAAHLLFVAPHNDSATGEPEASSGSGPPSGGALGPRALFASRVRPGQRVYVVAERDGDRRLLPAAVHSVTLSEEAAGAYAPLTAQGTILINRVLASCYAVIEEHSWAHRAFAPFRLAHALLAALAPARTDRGGDSGGGDRGGGGGRVALTAPGAADAPGAGATAGIHWYSQLLYQIGTWLLDSEALHPLGMAVKSS

SEQ ID NO: 82356 - protein, 169 aa, Homo sapiens
  Payload ID: 16398
  Gene Symbol: SHH
  Gene Name: sonic hedgehog
  ENSP ID: ENSP00000396621
MLSLFPSPGPGSSRCKDKLNALAISVMNQWPGVKLRVTEGWDEDGHHSEESLHYEGRAVDITTSDRDRSKYGMLARLAVEAGFDWVYYESKAHIHCSVKAGKERKPLLRDTRYRASRGCSPAPPGRGADFSFRVDGAKSLCKMYAWWLLPASLMTKCISIPVKTCITMY

SEQ ID NO: 82357 - protein, 126 aa, Homo sapiens
  Payload ID: 16398
  Gene Symbol: SHH
  Gene Name: sonic hedgehog
  ENSP ID: ENSP00000410546
MLSLFPSPGPGSSRCKDKLNALAISVMNQWPGVKLRVTEGWDEDGHHSEESLHYEGRAVDITTSDRDRSKYGMLARLAVEAGFDWVYYESKAHIHCSVKAGGQQVPGWCLQSRRKCDGFCSFDSSV

SEQ ID NO: 82358 - protein, 123 aa, Homo sapiens
  Payload ID: 16398
  Gene Symbol: SHH
  Gene Name: sonic hedgehog
  ENSP ID: ENSP00000413871
MLSLFPSPGPGSSRCKDKLNALAISVMNQWPGVKLRVTEGWDEDGHHSEESLHYEGRAVDITTSDRDRSKYGMLARLAVEAGFDWVYYESKAHIHCSVKAVQSDFKSVESEPEAPGTAAPLAV

SEQ ID NO: 82359 - protein, 1151 aa, Homo sapiens
  Payload ID: 16399
  Gene Symbol: SORBS1
  Gene Name: sorbin and SH3 domain containing 1
  Uniprot ID: Q9BX66
  ENSP ID: ENSP00000277982
MSSECDGGSKAVMNGLAPGSNGQDKATADPLRARSISAVKIIPVKTVKNASGLVLPTDMDLTKICTGKGAVTLRASSSYRETPSSSPASPQETRQHESKPGLEPEPSSADEWRLSSSADANGNAQPSSLAAKGYRSVHPNLPSDKSQDATSSSAAQPEVIVVPLYLVNTDRGQEGTARPPTPLGPLGCVPTIPATASAASPLTFPTLDDFIPPHLQRWPHHSQPARASGSFAPISQTPPSFSPPPPLVPPAPEDLRRVSEPDLTGAVSSTDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDTPEENPYFPTYKFPELPEIQQTSEETKSCSVMSPRLECSGTVIAHCSLKLLDSSNPPTSASQVAGTADDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSRDISPEEIDLKNEPWYKFFSELEFGKPPPKKIWDYTPGDCSILPREDRKTNLDKDLSLCQTELEADLEKMETLNKAPSANVPQSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQPWREESGQYERKAERGAGERGPGGPKISKKSCLKPSDVVRCLSTEQRLSDLNTPEESRPGKPLGSAFPGSEAEQTERHRGGEQAGRKAARRGGSQQPQAQQRRVTPDRSQTSQDLFSYQALYSYIPQNDDELELRDGDIVDVMEKCDDGWFVGTSRRTKQFGTFPGNYVKPLYL

SEQ ID NO: 82360 - protein, 1004 aa, Homo sapiens
  Payload ID: 16399
  Gene Symbol: SORBS1
  Gene Name: sorbin and SH3 domain containing 1
  Uniprot ID: Q9BX66
  ENSP ID: ENSP00000277984
MSSECDGGSKAVMNGLAPGSNGQDKATADPLRARSISAVKIIPVKTVKNASGLVLPTDMDLTKICTGKGAVTLRASSSYRETPSSSPASPQETRQHESKPDEWRLSSSADANGNAQPSSLAAKGYRSVHPNLPSDKSQDATSSSAAQPEVIVVPLYLVNTDRGQEGTARPPTPLGPLGCVPTIPATASAASPLTFPTLDDFIPPHLQRWPHHSQPARASGSFAPISQTPPSFSPPPPLVPPAPEDLRRVSEPDLTGAVSSTDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDTPEENPYFPTYKFPELPEIQQTSEDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSRDISPEEIDLKNEPWYKFFSELEFGKPPPKKIWDYTPGDCSILPREDRKTNLDKDLSLCQTELEADLEKMETLNKAPSANVPQSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQQPQAQQRRVTPDRSQTSQDLFSYQALYSYIPQNDDELELRDGDIVDVMEKCDDGWFVGTSRRTKQFGTFPGNYVKPLYL

SEQ ID NO: 82361 - protein, 781 aa, Homo sapiens
  Payload ID: 16399
  Gene Symbol: SORBS1
  Gene Name: sorbin and SH3 domain containing 1
  Uniprot ID: Q9BX66
  ENSP ID: ENSP00000302556
MSSECDGGSKAVMNGLAPGSNGQDKATADPLRARSISAVKIIPVKTVKNASGLVLPTDMDLTKICTGKGAVTLRASSSYRETPSSSPASPQETRQHESKPGLEPEPSSADEWRLSSSADANGNAQPSSLAAKGYRSVHPNLPSDKSQDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQQPQAQQRRVTPDRSQTSQDLFSYQALYSYIPQNDDELELRDGDIVDVMEKCDDGWFVGTSRRTKQFGTFPGNYVKPLYL

SEQ ID NO: 82362 - protein, 1292 aa, Homo sapiens
  Payload ID: 16399
  Gene Symbol: SORBS1
  Gene Name: sorbin and SH3 domain containing 1
  Uniprot ID: Q9BX66
  ENSP ID: ENSP00000355136
MSSECDGGSKAVMNGLAPGSNGQDKATADPLRARSISAVKIIPVKTVKNASGLVLPTDMDLTKICTGKGAVTLRASSSYRETPSSSPASPQETRQHESKPGLEPEPSSADEWRLSSSADANGNAQPSSLAAKGYRSVHPNLPSDKSQDATSSSAAQPEVIVVPLYLVNTDRGQEGTARPPTPLGPLGCVPTIPATASAASPLTFPTLDDFIPPHLQRWPHHSQPARASGSFAPISQTPPSFSPPPPLVPPAPEDLRRVSEPDLTGAVSSTDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDTPEENPYFPTYKFPELPEIQQTSEEDNPYTPTYQFPASTPSPKSEDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSRDISPEEIDLKNEPWYKFFSELEFGKPPPKKIWDYTPGDCSILPREDRKTNLDKDLSLCQTELEADLEKMETLNKAPSANVPQSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQFSSHSKLITPAPSSLPHSRRALSPEMHAVTSEWISLTVGVPGRRSLALTPPLPPLPEASIYNTDHLALSPRASPSLSLSLPHLSWSDRPTPRSVASPLALPSPHKTYSLAPTSQASLHMNGDGGVHTPSSGIHQDSFLQLPLGSSDSVISQLSDAFSSQSKRQPWREESGQYERKAERGAGERGPGGPKISKKSCLKPSDVVRCLSTEQRLSDLNTPEESRPGKPLGSAFPGSEAEQTERHRGGEQAGRKAARRGGSQQPQAQQRRVTPDRSQTSQDLFSYQALYSYIPQNDDELELRDGDIVDVMEKCDDGWFVGTSRRTKQFGTFPGNYVKPLYL

SEQ ID NO: 82363 - protein, 1266 aa, Homo sapiens
  Payload ID: 16399
  Gene Symbol: SORBS1
  Gene Name: sorbin and SH3 domain containing 1
  Uniprot ID: Q9BX66
  ENSP ID: ENSP00000360271
MSSECDGGSKAVMNGLAPGSNGQDKATADPLRARSISAVKIIPVKTVKNASGLVLPTDMDLTKICTGKGAVTLRASSSYRETPSSSPASPQETRQHESKPGLEPEPSSADEWRLSSSADANGNAQPSSLAAKGYRSVHPNLPSDKSQDATSSSAAQPEVIVVPLYLVNTDRGQEGTARPPTPLGPLGCVPTIPATASAASPLTFPTLDDFIPPHLQRWPHHSQPARASGSFAPISQTPPSFSPPPPLVPPAPEDLRRVSEPDLTGAVSSTDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSRDISPEEIDLKNEPWYKFFSELEFGKPPPKKIWDYTPGDCSILPREDRKTNLDKDLSLCQTELEADLEKMETLNKAPSANVPQSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQFSSHSKLITPAPSSLPHSRRALSPEMHAVTSEWISLTVGVPGRRSLALTPPLPPLPEASIYNTDHLALSPRASPSLSLSLPHLSWSDRPTPRSVASPLALPSPHKTYSLAPTSQASLHMNGDGGVHTPSSGIHQDSFLQLPLGSSDSVISQLSDAFSSQSKRQPWREESGQYERKAERGAGERGPGGPKISKKSCLKPSDVVRCLSTEQRLSDLNTPEESRPGKPLGSAFPGSEAEQTERHRGGEQAGRKAARRGGSQLSHHSLRAGPDLTESEKSYVQPQAQQRRVTPDRSQTSQDLFSYQALYSYIPQNDDELELRDGDIVDVMEKCDDGWFVGTSRRTKQFGTFPGNYVKPLYL

SEQ ID NO: 82364 - protein, 186 aa, Homo sapiens
  Payload ID: 16399
  Gene Symbol: SORBS1
  Gene Name: sorbin and SH3 domain containing 1
  ENSP ID: ENSP00000360272
  MOD_RES (1)..(1): Any amino acid
XQTSRQPEWRLDARGDKSTLLRNIYLMSPLPFRLKKPLHHHPRQPSPGDSSGLLVGQKPDLPSQPHQDQPPSGGKPVVPTRLSSRHTMARLSRSSEPSQERPTALEDYPRAINNGNSVPYSDHSLDRNNNPQSELAPSRGDSESPRHFIPADYLESTEEFIRRRHDDKEMRPARAKFDFKAQTLKE

SEQ ID NO: 82365 - protein, 811 aa, Homo sapiens
  Payload ID: 16399
  Gene Symbol: SORBS1
  Gene Name: sorbin and SH3 domain containing 1
  Uniprot ID: Q9BX66
  ENSP ID: ENSP00000360283
MSSECDGGSKAVMNGLAPGSNGQDKDMDLTKICTGKGAVTLRASSSYRETPSSSPASPQETRQHESKPGLEPEPSSADEWRLSSSADANGNAQPSSLAAKGYRSVHPNLPSDKSQDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSRDISPEEIDLKNEPWYKFFSELEFGKPTNLDKDLSLCQTELEADLEKMETLNKAPSANVPQSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQQPQAQQRRVTPDRSQTSQDLFSYQALYSYIPQNDDELELRDGDIVDVMEKCDDGWFVGTSRRTKQFGTFPGNYVKPLYL

SEQ ID NO: 82366 - protein, 684 aa, Homo sapiens
  Payload ID: 16399
  Gene Symbol: SORBS1
  Gene Name: sorbin and SH3 domain containing 1
  Uniprot ID: Q9BX66
  ENSP ID: ENSP00000360285
MSSECDGGSKAVMNGLAPGSNGQDKDMDLTKICTGKGAVTLRASSSYRETPSSSPASPQETRQHESKPDEWRLSSSADANGNAQPSSLAAKGYRSVHPNLPSDKSQDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQQPQAQQRRVTPDRSQTSQDLFSYQALYSYIPQNDDELELRDGDIVDVMEKCDDGWFVGTSRRTKQFGTFPGNYVKPLYL

SEQ ID NO: 82367 - protein, 905 aa, Homo sapiens
  Payload ID: 16399
  Gene Symbol: SORBS1
  Gene Name: sorbin and SH3 domain containing 1
  Uniprot ID: Q9BX66
  ENSP ID: ENSP00000360291
MSSECDGGSKAVMNGLAPGSNGQDKATADPLRARSISAVKIIPVKTVKNASGLVLPTDMDLTKICTGKGAVTLRASSSYRETPSSSPASPQETRQHESKPGLEPEPSSADEWRLSSSADANGNAQPSSLAAKGYRSVHPNLPSDKSQRWPHHSQPARASGSFAPISQTPPSFSPPPPLVPPAPEDLRRVSEPDLTGAVSSTDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSRDISPEEIDLKNEPWYKFFSELEFGKPPPKKIWDYTPGDCSILPREDRKSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQLSHHSLRAGPDLTESEKSYVQPQAQQRRVTPDRSQTSQDLFSYQALYSYIPQNDDELELRDGDIVDVMEKCDDGWFVGTSRRTKQFGTFPGNYVKPLYL

SEQ ID NO: 82368 - protein, 1151 aa, Homo sapiens; identical to SEQ ID NO: 82359
  Payload ID: 16399
  Gene Symbol: SORBS1
  Gene Name: sorbin and SH3 domain containing 1
  Uniprot ID: Q9BX66
  ENSP ID: ENSP00000360292

SEQ ID NO: 82369 - protein, 1292 aa, Homo sapiens; identical to SEQ ID NO: 82362
  Payload ID: 16399
  Gene Symbol: SORBS1
  Gene Name: sorbin and SH3 domain containing 1
  Uniprot ID: Q9BX66
  ENSP ID: ENSP00000360293

SEQ ID NO: 82370 - protein, 816 aa, Homo sapiens
  Payload ID: 16399
  Gene Symbol: SORBS1
  Gene Name: sorbin and SH3 domain containing 1
  Uniprot ID: Q9BX66
  ENSP ID: ENSP00000360295
MSSECDGGSKAVMNGLAPGSNGQDKDMDLTKICTGKGAVTLRASSSYRETPSSSPASPQETRQHESKPGLEPEPSSADEWRLSSSADANGNAQPSSLAAKGYRSVHPNLPSDKSQDATSSSAAQPEVIVVPLYLVNTDRGQEGTARPPTPLGPLGCVPTIPATASAASPLTFPTLDDFIPPHLQRWPHHSQPARASGSFAPISQTPPSFSPPPPLVPPAPEDLRRVSEPDLTGAVSSTDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQQPQAQQRRVTPDRSQTSQDLFSYQALYSYIPQNDDELELRDGDIVDVMEKCDDGWFVGTSRRTKQFGTFPGNYVKPLYL

SEQ ID NO: 82371 - protein, 192 aa, Homo sapiens
  Payload ID: 16399
  Gene Symbol: SORBS1
  Gene Name: sorbin and SH3 domain containing 1
  ENSP ID: ENSP00000473813
  MOD_RES (1)..(1): Any amino acid
XTAGTGKPPPAPPPDPPKLFFDIRKDAVNRGESPSLGTQASFPDVRPPVLGPRVTSDPENRKSKESYLLQPSYPAKDSSPLLNEVSSSLIGTDSQAFPSVSKPSSAYPSTTIVNPTIVLLQHNREQQKRLSSLSDPVSERRVGEQDSAPTQEKPTSPGKAIEKRAKDDSRRVVKSTQDLSDVSMDEVGIPLR

SEQ ID NO: 82372 - protein, 145 aa, Homo sapiens
  Payload ID: 16399
  Gene Symbol: SORBS1
  Gene Name: sorbin and SH3 domain containing 1
  ENSP ID: ENSP00000474932
MSSECDGGSKAVMNGLAPGSNGQDKDMDLTKICTGKGAVTLRASSSYRETPSSSPASPQETRQHESKPDEWRLSSSADANGNAQPSSLAAKGYRSVHPNLPSDKSQDATSSSAAQPEVIVVPLYLVNTDRGQEGTARPPTPLGPL

SEQ ID NO: 82373 - protein, 1294 aa, Homo sapiens
  Payload ID: 16399
  Gene Symbol: SORBS1
  Gene Name: sorbin and SH3 domain containing 1
  Uniprot ID: Q9BX66
  ENSP ID: ENSP00000475901
MSSECDGGSKAVMNGLAPGSNGQDKDMDLTKICTGKGAVTLRASSSYRETPSSSPASPQETRQHESKPGLEPEPSSADEWRLSSSADANGNAQPSSLAAKGYRSVHPNLPSDKSQDSSPLLNEVSSSLIGTDSQAFPSVSKPSSAYPSTTIVNPTIVLLQHNRDPVSERRVGEQDSAPTQEKPTSPGKAIEKRAKDDSRRVVKSTQDLSDVSMDEVGIPLRNTERSKDWYKTMFKQIHKLNRDDDSDLYSPRYSFSEDTKSPLSVPRSKSEMSYIDGEKVVKRSATLPLPARSSSLKSSSERNDWEPPDKKVDTRKYRAEPKSIYEYQPGKSSVLTNEKMSRDISPEEIDLKNEPWYKFFSELEFGKPTNLDKDLSLCQTELEADLEKMETLNKAPSANVPQSSAISPTPEISSETPGYIYSSNFHAVKRESDGAPGDLTSLENERQIYKSVLEGGDIPLQGLSGLKRPSSSASTKVDRKGGNAHMISSSSVHSRTFNTSNALGPVCKHKKPLSAAKACISEILPSKFKPRLSAPSALLQEQKSILLPSEKAQSCENLCVSGSLNDSKRGLPLQVGGSIENLLMRSRRDYDSKSSSTMSLQEYSTSGRRPCPLSRKAGMQFTMLYRDMHQINRSGLFLGSISSSSSVRDLASHFEKSSLALSRGELGPSQEGSEHIPKHTVSSRITAFEQLIQRSRSMPSLDLSGRLSKSPTPVLSRGSLTSARSAESLLESTKLHPKEMDGMNSSGVYASPTCSNMAHHALSFRGLVPSEPLSTCSDDVDRCSNISTDSREGSGGSVHGDFPKHRLNKCKGTCPASYTRFTTIRKHEQQQTSRQPEWRLDARGDKSTLLRNIYLMSPLPFRLKKPLHHHPRQPSPGDSSGLLVGQKPDLPSQPHQDQPPSGGKPVVPTRLSSRHTMARLSRSSEPSQERPTALEDYPRAINNGNSVPYSDHSLDRNNNPQSELAPSRGDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQQPQAQQRRVTPDRSQTSQDLFSYQALYSYIPQNDDELELRDGDIVDVMEKCDDGWFVGTSRRTKQFGTFPGNYVKPLYL

SEQ ID NO: 82374 - protein, 507 aa, Homo sapiens
  Payload ID: 16399
  Gene Symbol: SORBS1
  Gene Name: sorbin and SH3 domain containing 1
  ENSP ID: ENSP00000489022
  MOD_RES (1)..(1): Any amino acid
XPLSVPRSKSEMSYIDGEKVVKRSATLPLPARSSSLKSSSERNDWEPPDKKVDTRKYRAEPKSIYEYQPGKSSVLTNEKMSRDISPEEIDLKNEPWYKFFSELEFGKPSSAISPTPEISSETPGYIYSSNFHAVKRESDGAPGDLTSLENERQIYKSVLEGGDIPLQGLSGLKRPSSSASTKDSESPRHFIPADYLESTEEFIRRRHDDKEKLLADQRRLKREQEEADIAARRHTGVIPTHHQFITNERFGDLLNIDDTAKRKSGSEMRPARAKFDFKAQTLKELPLQKGDIVYIYKQIDQNWYEGEHHGRVGIFPRTYIELLPPAEKAQPKKLTPVQVLEYGEAIAKFNFNGDTQVEMSFRKGERITLLRQVDENWYEGRIPGTSRQGIFPITYVDVIKRPLVKNPVDYMDLPFSSSPSRSATASPQQPQAQQRRVTPDRSQTSQDLFSYQALYSYIPQNDDELELRDGDIVDVMEKCDDGWFVGTSRRTKQFGTFPGNYVKPLYL

SEQ ID NO: 82375 - protein, 1100 aa, Homo sapiens
  Payload ID: 16400
  Gene Symbol: SORBS2
  Gene Name: sorbin and SH3 domain containing 2
  Uniprot ID: O94875
  ENSP ID: ENSP00000284776
MSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPASLYQSSIDRSLERPMSSASMASDFRKRRKSEPAVGPPRGLGDQSASRTSPGRVDLPGSSTTLTKSFTSSSPSSPSRAKGGDDSKICPSLCSYSGLNGNPSSELDYCSTYRQHLDVPRDSPRAISFKNGWQMARQNAEIWSSTEETVSPKIKSRSCDDLLNDDCDSFPDPKVKSESMGSLLCEEDSKESCPMAWGSPYVPEVRSNGRSRIRHRSARNAPGFLKMYKKMHRINRKDLMNSEVICSVKSRILQYESEQQHKDLLRAWSQCSTEEVPRDMVPTRISEFEKLIQKSKSMPNLGDDMLSPVTLEPPQNGLCPKRRFSIEYLLEEENQSGPPARGRRGCQSNALVPIHIEVTSDEQPRAHVEFSDSDQDGVVSDHSDYIHLEGSSFCSESDFDHFSFTSSESFYGSSHHHHHHHHHHHRHLISSCKGRCPASYTRFTTMLKHERARHENTEEPRRQEMDPGLSKLAFLVSPVPFRRKKNSAPKKQTEKAKCKASVFEALDSALKDICDQIKAEKKRGSLPDNSILHRLISELLPDVPERNSSLRALRRSPLHQPLHPLPPDGAIHCPPYQNDCGRMPRSASFQDVDTANSSCHHQDRGGALQDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 82376 - protein, 636 aa, Homo sapiens
  Payload ID: 16400
  Gene Symbol: SORBS2
  Gene Name: sorbin and SH3 domain containing 2
  ENSP ID: ENSP00000321983
MNTGRDSQSPDSAKGFRSVRPNLQDKRSPTQSQITVNGNSGGAVSPMSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPPPLPTTPTPVPREPGRKPLSSSRLGEVTGSPSPPPRSGAPTPSSRAPALSPTRPPKKPLDYVQDHSSGVFNEASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEP

SEQ ID NO: 82377 - protein, 731 aa, Homo sapiens
  Payload ID: 16400
  Gene Symbol: SORBS2
  Gene Name: sorbin and SH3 domain containing 2
  Uniprot ID: O94875
  ENSP ID: ENSP00000322182
MSVTLTSVKRVQSSPNLLAAGRDSQSPDSAWRSYNDGNQETLNGDATYSSLAAKGFRSVRPNLQDKRSPTQSQITVNGNSGGAVSPMSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPPPLPTTPTPVPREPGRKPLSSSRLGEVTGSPSPPPRSGAPTPSSRAPALSPTRPPKKPLDYVQDHSSGVFNEASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 82378 - protein, 1200 aa, Homo sapiens
  Payload ID: 16400
  Gene Symbol: SORBS2
  Gene Name: sorbin and SH3 domain containing 2
  Uniprot ID: O94875
  ENSP ID: ENSP00000347852
MNTDSGGCARKRAAMSVTLTSVKRVQSSPNLLAAGRDSQSPDSAWRSYNDGNQETLNGDATYSSLAAKGFRSVRPNLQDKRSPTQSQITVNGNSGGAVSPMSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPASLYQSSIDRSLERPMSSASMASDFRKRRKSEPAVGPPRGLGDQSASRTSPGRVDLPGSSTTLTKSFTSSSPSSPSRAKGGDDSKICPSLCSYSGLNGNPSSELDYCSTYRQHLDVPRDSPRAISFKNGWQMARQNAEIWSSTEETVSPKIKSRSCDDLLNDDCDSFPDPKVKSESMGSLLCEEDSKESCPMAWGSPYVPEVRSNGRSRIRHRSARNAPGFLKMYKKMHRINRKDLMNSEVICSVKSRILQYESEQQHKDLLRAWSQCSTEEVPRDMVPTRISEFEKLIQKSKSMPNLGDDMLSPVTLEPPQNGLCPKRRFSIEYLLEEENQSGPPARGRRGCQSNALVPIHIEVTSDEQPRAHVEFSDSDQDGVVSDHSDYIHLEGSSFCSESDFDHFSFTSSESFYGSSHHHHHHHHHHHRHLISSCKGRCPASYTRFTTMLKHERARHENTEEPRRQEMDPGLSKLAFLVSPVPFRRKKNSAPKKQTEKAKCKASVFEALDSALKDICDQIKAEKKRGSLPDNSILHRLISELLPDVPERNSSLRALRRSPLHQPLHPLPPDGAIHCPPYQNDCGRMPRSASFQDVDTANSSCHHQDRGGALQDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 82379 - protein, 9 aa, Homo sapiens
  Payload ID: 16400
  Gene Symbol: SORBS2
  Gene Name: sorbin and SH3 domain containing 2
  ENSP ID: ENSP00000377158
MSYYQRPFS

SEQ ID NO: 82380 - protein, 666 aa, Homo sapiens
  Payload ID: 16400
  Gene Symbol: SORBS2
  Gene Name: sorbin and SH3 domain containing 2
  Uniprot ID: O94875
  ENSP ID: ENSP00000377162
MNTGRDSQSPDSAKGFRSVRPNLQDKRSPTQSQITVNGNSGGAVSPMSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPTDRINPDDIDLENEPWYKFFSELEFGRPPPKKPLDYVQDHSSGVFNEASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 82381 - protein, 15 aa, Homo sapiens
  Payload ID: 16400
  Gene Symbol: SORBS2
  Gene Name: sorbin and SH3 domain containing 2
  ENSP ID: ENSP00000389829
MNTDSGGCARKRAAM

SEQ ID NO: 82382 - protein, 291 aa, Homo sapiens
  Payload ID: 16400
  Gene Symbol: SORBS2
  Gene Name: sorbin and SH3 domain containing 2
  ENSP ID: ENSP00000389995
  MOD_RES (1)..(1): Any amino acid
XSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDF

SEQ ID NO: 82383 - protein, 70 aa, Homo sapiens
  Payload ID: 16400
  Gene Symbol: SORBS2
  Gene Name: sorbin and SH3 domain containing 2
  ENSP ID: ENSP00000390162
MSVTLTSVKRVQSSPNLLAAGRDSQSPDSAWRSYNDGNQETLNGDATYSSLAAKGFRSVRPNLQDKRSPT

SEQ ID NO: 82384 - protein, 253 aa, Homo sapiens
  Payload ID: 16400
  Gene Symbol: SORBS2
  Gene Name: sorbin and SH3 domain containing 2
  ENSP ID: ENSP00000391940
  MOD_RES (1)..(1): Any amino acid
XQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPPPLPTTPTPVPREPGRKPLSSSRLGEVTGSPSPPPRSGAPTPSSRAPALSPTRSSIDRSLERPMSSASMASDFRKRRKSEPAVGPPRGLGDQSASRTSPGRVDLPGSSTTLTKSFTSSSPSSPSRAK

SEQ ID NO: 82385 - protein, 182 aa, Homo sapiens
  Payload ID: 16400
  Gene Symbol: SORBS2
  Gene Name: sorbin and SH3 domain containing 2
  ENSP ID: ENSP00000393258
MNTDSGGCARKRAAMSVTLTSVKRVQSSPNLLAAGRDSQSPDSAWRSYNDGNQETLNGDATYSSLAAKGFRSVRPNLQDKRSPTQAPPPPERKESFHSSLITSHTKGVILDQLVTNTQIPSSTEYFANKKPLQGTMYSNEDSRQTIVYSEESNTTMSYTQKITNPLPAASSTDPAPFANINT

SEQ ID NO: 82386 - protein, 824 aa, Homo sapiens
  Payload ID: 16400
  Gene Symbol: SORBS2
  Gene Name: sorbin and SH3 domain containing 2
  Uniprot ID: O94875
  ENSP ID: ENSP00000396008
MYSNEDSRQTIVYSEESNTTMSYTQKITNPLPAASSTDPAPFANINTPVLQEDYRQDSQTRRISTLKLTHNQDLGSSSPISTPQFSKSVEVPSFLKRPRSLTPNPVPETHTASLSIQIAPLSGQDLESHKQLPELSPETAKIPLQQERQKSAVAAASQSSDCRVSQITVNGNSGGAVSPMSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPPPLPTTPTPVPREPGRKPLSSSRLGEVTGSPSPPPRSGAPTPSSRAPALSPTRPPKKPLDYVQDHSSGVFNEASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 82387 - protein, 100 aa, Homo sapiens
  Payload ID: 16400
  Gene Symbol: SORBS2
  Gene Name: sorbin and SH3 domain containing 2
  ENSP ID: ENSP00000396183
MSVTLTSVKRVQSSPNLLAAGRDSQSPDSAKGFRSVRPNLQDKRSPTQSQITVNGNSGGAVSPMSYYQRPFSPSAYSLPASLNSSIVMQHGTSLDSTDTY

SEQ ID NO: 82388 - protein, 644 aa, Homo sapiens
  Payload ID: 16400
  Gene Symbol: SORBS2
  Gene Name: sorbin and SH3 domain containing 2
  Uniprot ID: O94875
  ENSP ID: ENSP00000397262
MSVTLTSVKRVQSSPNLLAAGRDSQSPDSAWRSYNDGNQETLNGDATYSSLAAKGFRSVRPNLQDKRSPTQSQITVNGNSGGAVSPMSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 82389 - protein, 1004 aa, Homo sapiens
  Payload ID: 16400
  Gene Symbol: SORBS2
  Gene Name: sorbin and SH3 domain containing 2
  Uniprot ID: O94875
  ENSP ID: ENSP00000397482
MKATTPLQTVDRPKDWYKTMFKQIHMVHKPGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPASLYQSSIDRSLERPMSSASMASDFRKRRKSEPAVGPPRGLGDQSASRTSPGRVDLPGSSTTLTKSFTSSSPSSPSRAKGGDDSKICPSLCSYSGLNGNPSSELDYCSTYRQHLDVPRDSPRAISFKNGWQMARQNAEIWSSTEETVSPKIKSRSCDDLLNDDCDSFPDPKVKSESMGSLLCEEDSKESCPMAWGSPYVPEVRSNGRSRIRHRSARNAPGFLKMYKKMHRINRKDLMNSEVICSVKSRILQYESEQQHKDLLRAWSQCSTEEVPRDMVPTRISEFEKLIQKSKSMPNLGDDMLSPVTLEPPQNGLCPKRRFSIEYLLEEENQSGPPARGRRGCQSNALVPIHIEVTSDEQPRAHVEFSDSDQDGVVSDHSDYIHLEGSSFCSESDFDHFSFTSSESFYGSSHHHHHHHHHHHRHLISSCKGRCPASYTRFTTMLKHERARHENTEEPRRQEMDPGLSKLAFLVSPVPFRRKKNSAPKKQTEKAKCKASVFEALDSALKDICDQIKAEKKRGSLPDNSILHRLISELLPDVPERNSSLRALRRSPLHQPLHPLPPDGAIHCPPYQNDCGRMPRSASFQDVDTANSSCHHQDRGGALQDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 82390 - protein, 68 aa, Homo sapiens
  Payload ID: 16400
  Gene Symbol: SORBS2
  Gene Name: sorbin and SH3 domain containing 2
  ENSP ID: ENSP00000397664
MSYYQRPFSPSAYSLPASLNSSIVMQHGTSLDSTDTYPQHAQSLDGTTSSSIPLYRSSEEEKRVTVIK

SEQ ID NO: 82391 - protein, 59 aa, Homo sapiens
  Payload ID: 16400
  Gene Symbol: SORBS2
  Gene Name: sorbin and SH3 domain containing 2
  ENSP ID: ENSP00000398335
MSYYQRPFSPSAYSLPASLNSSIVMQHGTSLDSTDTYPQHAQSLDGTTSSSIPLYRSSE

SEQ ID NO: 82392 - protein, 100 aa, Homo sapiens
  Payload ID: 16400
  Gene Symbol: SORBS2
  Gene Name: sorbin and SH3 domain containing 2
  ENSP ID: ENSP00000399048
MSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKT

SEQ ID NO: 82393 - protein, 291 aa, Homo sapiens
  Payload ID: 16400
  Gene Symbol: SORBS2
  Gene Name: sorbin and SH3 domain containing 2
  ENSP ID: ENSP00000401818
QTYRPLSKSHSDNSPNAFKDASSPVPPPHVPPPVPPLRPRDRSSTEKHDWDPPDRKVDTRKFRSEPRSIFEYEPGKSSILQHERPPPKKPLDYVQDHSSGVFNEASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGE

SEQ ID NO: 82394 - protein, 85 aa, Homo sapiens
  Payload ID: 16400
  Gene Symbol: SORBS2
  Gene Name: sorbin and SH3 domain containing 2
  ENSP ID: ENSP00000402328
MNTGRDSQSPDSAWRSYNDGNQETLNGDATYSSLAAKGFRSVRPNLQDKRSPTQLGNQNLPASVLEVNASQTHRQTTPEASPPCP

SEQ ID NO: 82395 - protein, 116 aa, Homo sapiens
  Payload ID: 16400
  Gene Symbol: SORBS2
  Gene Name: sorbin and SH3 domain containing 2
  ENSP ID: ENSP00000403417
MSVTLTSVKRVQSSPNLLAAGRDSQSPDSAWRSYNDGNQETLNGDATYSSLAAKGFRSVRPNLQDKRSPTQSQITVNGNSGGAVSPMSYYQRPFSPSAYSLPASLNSSIVMQHGTS

SEQ ID NO: 82396 - protein, 118 aa, Homo sapiens
  Payload ID: 16400
  Gene Symbol: SORBS2
  Gene Name: sorbin and SH3 domain containing 2
  ENSP ID: ENSP00000404430
MNTDSGGCARKRAAMSVTLTSVKRVQSSPNLLAAGRDSQSPDSAKGFRSVRPNLQDKRSPTQLGNQNLPASVLEVNASQTHRQTTPEASPPCPPSVVPLNRATFSPGSGTSSASLSLP

SEQ ID NO: 82397 - protein, 109 aa, Homo sapiens
  Payload ID: 16400
  Gene Symbol: SORBS2
  Gene Name: sorbin and SH3 domain containing 2
  ENSP ID: ENSP00000405092
MNTGRDSQSPDSAWRSYNDGNQETLNGDATYSSLAAKGFRSVRPNLQDKRSPTQSQITVNGNSGGAVSPMSYYQRPFSPSAYSLPASLNSSIVMQHGTSLDSTDTYPQH

SEQ ID NO: 82398 - protein, 96 aa, Homo sapiens
  Payload ID: 16400
  Gene Symbol: SORBS2
  Gene Name: sorbin and SH3 domain containing 2
  ENSP ID: ENSP00000405314
MNTDSGGCARKRAAMSVTLTSVKRVQSSPNLLAAGRDSQSPDSAWRSYNDGNQETLNGDATYSSLAAKGFRSVRPNLQDKRSPTQSQITVNGNSGG

SEQ ID NO: 82399 - protein, 119 aa, Homo sapiens
  Payload ID: 16400
  Gene Symbol: SORBS2
  Gene Name: sorbin and SH3 domain containing 2
  ENSP ID: ENSP00000405349
MNTGRDSQSPDSAKGFRSVRPNLQDKRSPTQSQITVNGNSGGAVSPMSYYQRPFSPSAYSLPASLNSSIVMQHGTSLDSTDTYPQHAQSLDGTTSSSIPLYRSSEEEKRVTVIKAPHYP

SEQ ID NO: 82400 - protein, 80 aa, Homo sapiens
  Payload ID: 16400
  Gene Symbol: SORBS2
  Gene Name: sorbin and SH3 domain containing 2
  ENSP ID: ENSP00000405432
MSVTLTSVKRVQSSPNLLAAGRDSQSPDSAWRSYNDGNQETLNGDATYSSLAAKGFRSVRPNLQDKRSPTQSQITVNGNS

SEQ ID NO: 82401 - protein, 75 aa, Homo sapiens
  Payload ID: 16400
  Gene Symbol: SORBS2
  Gene Name: sorbin and SH3 domain containing 2
  ENSP ID: ENSP00000405646
MNTDSGGCARKRAAMSVTLTSVKRVQSSPNLLAAGRDSQSPDSAKGFRSVRPNLQDKRSPTQSQITVNGNSGGAV

SEQ ID NO: 82402 - protein, 87 aa, Homo sapiens
  Payload ID: 16400
  Gene Symbol: SORBS2
  Gene Name: sorbin and SH3 domain containing 2
  ENSP ID: ENSP00000407006
MNTDSGGCARKRAAMSVTLTSVKRVQSSPNLLAAGRDSQSPDSAWRSYNDGNQETLNGDATYSSLAAKGFRSVRPNLQDKRSPTQSQ

SEQ ID NO: 82403 - protein, 113 aa, Homo sapiens
  Payload ID: 16400
  Gene Symbol: SORBS2
  Gene Name: sorbin and SH3 domain containing 2
  ENSP ID: ENSP00000408504
MNTDSGGCARKRAAMSVTLTSVKRVQSSPNLLAAGRDSQSPDSAWRSYNDGNQETLNGDATYSSLAAKGFRSVRPNLQDKRSPTQSQITVNGNSGGAVSPMSYYQRPFSPSAY

SEQ ID NO: 82404 - protein, 93 aa, Homo sapiens
  Payload ID: 16400
  Gene Symbol: SORBS2
  Gene Name: sorbin and SH3 domain containing 2
  ENSP ID: ENSP00000408909
MSYYQRPFSPSAYSLPASLNSSIVMQHGTSLDSTDTYPQHAQSLDGTTSSSIPLYRSSEEEKRVTVIKAPHYPGIGPVDESGIPTAIRTTVDR

SEQ ID NO: 82405 - protein, 661 aa, Homo sapiens
  Payload ID: 16400
  Gene Symbol: SORBS2
  Gene Name: sorbin and SH3 domain containing 2
  Uniprot ID: O94875
  ENSP ID: ENSP00000409158
MNTGRDSQSPDSAWRSYNDGNQETLNGDATYSSLAAKGFRSVRPNLQDKRSPTQSQITVNGNSGGAVSPMSYYQRPFSPSAYSLPASLNSSIVMQHGTSLDSTDTYPQHAQSLDGTTSSSIPLYRSSEEEKRVTVIKAPHYPGIGPVDESGIPTAIRTTVDRPKDWYKTMFKQIHMVHKPDDDTDMYNTPYTYNAGLYNPPYSAQSHPAAKTQTYRPLSKSHSDNSPNAFKDASSPVPPPHVPPPVPPLRPRDRSSTEKHDWDPPDRKVDTRKFRSEPRSIFEYEPGKSSILQHERPPPKKPLDYVQDHSSGVFNEASLYQSSIDRSLERPMSSASMASDFRKRRKSEPAVGPPRGLGDQSASRTSPGRVDLPGSSTTLTKSFTSSSPSSPSRAKDRESPRSYSSTLTDMGRSAPRERRGTPEKEKLPAKAVYDFKAQTSKELSFKKGDTVYILRKIDQNWYEGEHHGRVGIFPISYVEKLTPPEKAQPARPPPPAQPGEIGEAIAKYNFNADTNVELSLRKGDRVILLKRVDQNWYEGKIPGTNRQGIFPVSYVEVVKKNTKGAEDYPDPPIPHSYSSDRIHSLSSNKPQRPVFTHENIQGGGEPFQALYNYTPRNEDELELRESDVIDVMEKCDDGWFVGTSRRTKFFGTFPGNYVKRL

SEQ ID NO: 82406 - protein, 107 aa, Homo sapiens
  Payload ID: 16400
  Gene Symbol: SORBS2
  Gene Name: sorbin and SH3 domain containing 2
  ENSP ID: ENSP00000410233
MNTDSGGCARKRAAMSVTLTSVKRVQSSPNLLAAGRDSQSPDSAWRSYNDGNQETLNGDATYSSLAAKGFRSVRPNLQDKRSPTQSQITVNGNSGGAVSPMSYYQRP

SEQ ID NO: 82407 - protein, 89 aa, Homo sapiens
  Payload ID: 16400
  Gene Symbol: SORBS2
  Gene Name: sorbin and SH3 domain containing 2
  ENSP ID: ENSP00000410483
MSYYQRPFSPSAYSLPASLNSSIVMQHGTSLDSTDTYPQHAQSLDGTTSSSIPLYRSSEEEKRVTVIKAPHYPGIGPVDESGIPTAIRT

SEQ ID NO: 82408 - protein, 55 aa, Homo sapiens
  Payload ID: 16400
  Gene Symbol: SORBS2
  Gene Name: sorbin and SH3 domain containing 2
  ENSP ID: ENSP00000410967
MSYYQRPFSPSAYSLPASLNSSIVMQHGTSLDSTDTYPQHAQSLDGTTSSSIPLY

SEQ ID NO: 82409 - protein, 71 aa, Homo sapiens
  Payload ID: 16400
  Gene Symbol: SORBS2
  Gene Name: sorbin and SH3 domain containing 2
  ENSP ID: ENSP00000412447
MSVTLTSVKRVQSSPNLLAAGRDSQSPDSAWRSYNDGNQETLNGDATYSSLAAKGFRSVRPNLQDKRSPTQ

SEQ ID NO: 82410 - protein, 80 aa, Homo sapiens; identical to SEQ ID NO: 82400
  Payload ID: 16400
  Gene Symbol: SORBS2
  Gene Name: sorbin and SH3 domain containing 2
  ENSP ID: ENSP00000415166

SEQ ID NO: 82411 - protein, 80 aa, Homo sapiens; identical to SEQ ID NO: 82400
  Payload ID: 16400
  Gene Symbol: SORBS2
  Gene Name: sorbin and SH3 domain containing 2
  ENSP ID: ENSP00000415392

SEQ ID NO: 82412 - protein, 121 aa, Homo sapiens
  Payload ID: 16400
  Gene Symbol: SORBS2
  Gene Name: sorbin and SH3 domain containing 2
  ENSP ID: ENSP00000415637
MNTGRDSQSPDSAWRSYNDGNQETLNGDATYSSLAAKGFRSVRPNLQDKRSPTQSQITVNGNSGGAVSPMSYYQRPFSPSAYSLPASLNSSIVMQHGTSLDSTDTYPQHAQSLDGTTSSSI

SEQ ID NO: 82413 - protein, 73 aa, Homo sapiens
  Payload ID: 16400
  Gene Symbol: SORBS2
  Gene Name: sorbin and SH3 domain containing 2
  ENSP ID: ENSP00000415680
MSYYQRPFSPSAYSLPASLNSSIVMQHGTSLDSTDTYPQHAQSLDGTTSSSIPLYRSSEEEKRVTVIKAPHYP

SEQ ID NO: 82414 - protein, 120 aa, Homo sapiens
  Payload ID: 16400
  Gene Symbol: SORBS2
  Gene Name: sorbin and SH3 domain containing 2
  ENSP ID: ENSP00000416464
MNTGRDSQSPDSAWRSYNDGNQETLNGDATYSSLAAKGFRSVRPNLQDKRSPTQSQITVNGNSGGAVSPMSYYQRPFSPSAYSLPASLNSSIVMQHGTSLDSTDTYPQHAQSLDGTTSSS

SEQ ID NO: 82415 - protein, 671 aa, Homo sapiens
  Payload ID: 16401
  Gene Symbol: SORBS3
  Gene Name: sorbin and SH3 domain containing 3
  Uniprot ID: O60504
  ENSP ID: ENSP00000240123
MQGPPRSLRAGLSLDDFIPGHLQSHIGSSSRGTRVPVIRNGGSNTLNFQFHDPAPRTVCNGGYTPRRDASQHPDPAWYQTWPGPGSKPSASTKIPASQHTQNWSATWTKDSKRRDKRWVKYEGIGPVDESGMPIAPRSSVDRPRDWYRRMFQQIHRKMPDLQLDWTFEEPPRDPRHLGAQQRPAHRPGPATSSSGRSWDHSEELPRSTFNYRPGAFSTVLQPSNQVLRRREKVDNVWTEESWNQFLQELETGQRPKKPLVDDPGEKPSQPIEVLLERELAELSAELDKDLRAIETRLPSPKSSPAPRRAPEQRPPAGPASAWSSSYPHAPYLGSARSLSPHKMADGGSPFLGRRDFVYPSSTRDPSASNGGGSPARREEKKRKAARLKFDFQAQSPKELTLQKGDIVYIHKEVDKNWLEGEHHGRLGIFPANYVEVLPADEIPKPIKPPTYQVLEYGEAVAQYTFKGDLEVELSFRKGEHICLIRKVNENWYEGRITGTGRQGIFPASYVQVSREPRLRLCDDGPQLPTSPRLTAAARSARHPSSPSALRSPADPIDLGGQTSPRRTGFSFPTQEPRPQTQNLGTPGPALSHSRGPSHPLDLGTSSPNTSQIHWTPYRAMYQYRPQNEDELELREGDRVDVMQQCDDGWFVGVSRRTQKFGTFPGNYVAPV

SEQ ID NO: 82416 - protein, 152 aa, Homo sapiens
  Payload ID: 16401
  Gene Symbol: SORBS3
  Gene Name: sorbin and SH3 domain containing 3
  ENSP ID: ENSP00000428102
  MOD_RES (1)..(1): Any amino acid
XNFQFHDPAPRTVCNGGYTPRRDASQHPDPAWYQTWPGPGSKPSASTKIPASQHTQNWSATWTKDSKRRDKRWVKYEGIGPVDESGMPIAPRSSVDRPRDWYRRMFQQIHRKMPEEAGTTLKSYLEAPSTTDLEHSPLCCSPQIRCSDAGKK

SEQ ID NO: 82417 - protein, 186 aa, Homo sapiens
  Payload ID: 16401
  Gene Symbol: SORBS3
  Gene Name: sorbin and SH3 domain containing 3
  ENSP ID: ENSP00000428327
  MOD_RES (1)..(1): Any amino acid
XNWYEGRITGTGRQGIFPASYVQVSREPRLRLCDDGPQLPTSPRLTAAARSARHPSSPSALRSPADPIDLGGQTSPRRTGFSFPTQEPRPQTQNLGTPGPALSHSRGPSHPLDLGTSSPNTSQIHWTPYRAMYQYRPQNEDELELREGDRVDVMQQCDDGWFVGVSRRTQKFGTFPGNYVAPVGLL

SEQ ID NO: 82418 - protein, 226 aa, Homo sapiens
  Payload ID: 16401
  Gene Symbol: SORBS3
  Gene Name: sorbin and SH3 domain containing 3
  ENSP ID: ENSP00000428678
AVLVPTCRELTLQKGDIVYIHKEVDKNWLEGEHHGRLGIFPANYVEVLPADEIPKPIKPPTYQVLEYGEAVAQYTFKGDLEVELSFRKGEHICLIRKVNENWYEGRITGTGRQGIFPASYVQVSREPRLRLCDDGPQLPTSPRLTAAARSARHPSSPSALRSPADPIDLGGQTSPRRTGFSFPTQEPRPQTQNLGTPGPALSHSRGPSHPLDLGTSSPNTSQIHWT

SEQ ID NO: 82419 - protein, 94 aa, Homo sapiens
  Payload ID: 16401
  Gene Symbol: SORBS3
  Gene Name: sorbin and SH3 domain containing 3
  ENSP ID: ENSP00000429479
MADGGSPFLGRRDFVYPSSTRDPSASNGGGSPARREEKKRKAARLKFDFQAQSPKELTLQKGDIVYIHKEVDKNWLEGEHHGRLGIFPANYVEV

SEQ ID NO: 82420 - protein, 328 aa, Homo sapiens
  Payload ID: 16401
  Gene Symbol: SORBS3
  Gene Name: sorbin and SH3 domain containing 3
  ENSP ID: ENSP00000429723
MQGPPRSLRAGLSLDDFIPGHLQSHIGSSSRGTRVPVIRNGGSNTLNFQFHDPAPRTVCNGGYTPRRDASQHPDPAWYQTWPGPGSKPSASTKIPASQHTQNWSATWTKDSKRRDKRWVKYEGIGPVDESGMPIAPRSSVDRPRDWYRRMFQQIHRKMPDLQLDWTFEEPPRDPRHLGAQQRPAHRPGPATSSSGRSWDHSEELPRSTFNYRPGAFSTVLQPSNQVLRRREKVDNVWTEESWNQFLQELETGQRPKKPLVDDPGEKPSQPIEVLLERELAELSAELDKDLRAIETRLPSPKPGLSLELQLPTCTLPGFRPVPESPQNG

SEQ ID NO: 82421 - protein, 329 aa, Homo sapiens
  Payload ID: 16401
  Gene Symbol: SORBS3
  Gene Name: sorbin and SH3 domain containing 3
  Uniprot ID: O60504
  ENSP ID: ENSP00000429764
MADGGSPFLGRRDFVYPSSTRDPSASNGGGSPARREEKKRKAARLKFDFQAQSPKELTLQKGDIVYIHKEVDKNWLEGEHHGRLGIFPANYVEVLPADEIPKPIKPPTYQVLEYGEAVAQYTFKGDLEVELSFRKGEHICLIRKVNENWYEGRITGTGRQGIFPASYVQVSREPRLRLCDDGPQLPTSPRLTAAARSARHPSSPSALRSPADPIDLGGQTSPRRTGFSFPTQEPRPQTQNLGTPGPALSHSRGPSHPLDLGTSSPNTSQIHWTPYRAMYQYRPQNEDELELREGDRVDVMQQCDDGWFVGVSRRTQKFGTFPGNYVAPV

SEQ ID NO: 82422 - protein, 174 aa, Homo sapiens
  Payload ID: 16401
  Gene Symbol: SORBS3
  Gene Name: sorbin and SH3 domain containing 3
  ENSP ID: ENSP00000431128
MADGGSPFLGRRDFVYPSSTRDPSASNGGGSPARREEKKRKAARLKFDFQAQSPKELTLQKGDIVYIHKEVDKNWLEGEHHGRLGIFPANYVEVLPADEIPKPIKPPTYQVLEYGEAVAQYTFKGDLEVELSFRKGEHICLIRKVNENWYEGRITGTGRQGIFPASYVQVSREP

SEQ ID NO: 82423 - protein, 357 aa, Homo sapiens
  Payload ID: 16402
  Gene Symbol: SORD
  Gene Name: sorbitol dehydrogenase
  Uniprot ID: Q00796
  ENSP ID: ENSP00000267814
MAAAAKPNNLSLVVHGPGDLRLENYPIPEPGPNEVLLRMHSVGICGSDVHYWEYGRIGNFIVKKPMVLGHEASGTVEKVGSSVKHLKPGDRVAIEPGAPRENDEFCKMGRYNLSPSIFFCATPPDDGNLCRFYKHNAAFCYKLPDNVTFEEGALIEPLSVGIHACRRGGVTLGHKVLVCGAGPIGMVTLLVAKAMGAAQVVVTDLSATRLSKAKEIGADLVLQISKESPQEIARKVEGQLGCKPEVTIECTGAEASIQAGIYATRSGGNLVLVGLGSEMTTVPLLHAAIREVDIKGVFRYCNTWPVAISMLASKSVNVKPLVTHRFPLEKALEAFETFKKGLGLKIMLKCDPSDQNP

SEQ ID NO: 82424 - protein, 117 aa, Homo sapiens
  Payload ID: 16402
  Gene Symbol: SORD
  Gene Name: sorbitol dehydrogenase
  ENSP ID: ENSP00000452731
MAAAAKPNNLSLVVHGPGDLRLENYPIPEPGPNEVLLRMHSVGICGSDVHYWEYGRIGNFIVKKPMVLGHEASGTVEKVGSSVKHLKPGWKTKNQTKERADSAPTLGHGAIFVFLSR

SEQ ID NO: 82425 - protein, 336 aa, Homo sapiens
  Payload ID: 16402
  Gene Symbol: SORD
  Gene Name: sorbitol dehydrogenase
  ENSP ID: ENSP00000453122
MENYPIPEPGPNEVLLRMHSVGICGSDVHYWEYGRIGNFIVKKPMVLGHEASGTVEKVGSSVKHLKPGDRVAIEPGAPRENDEFCKMGRYNLSPSIFFCATPPDDGNLCRFYKHNAAFCYKLPDNVTFEEGALIEPLSVGIHACRRGGVTLGHKVLVCGAGPIGMVTLLVAKAMGAAQVVVTDLSATRLSKAKEIGADLVLQISKESPQEIARKVEGQLGCKPEVTIECTGAEASIQAGIYATRSGGNLVLVGLGSEMTTVPLLHAAIREVDIKGVFRYCNTWPVAISMLASKSVNVKPLVTHRFPLEKALEAFETFKKGLGLKIMLKCDPSDQNP

SEQ ID NO: 82426 - protein, 100 aa, Homo sapiens
  Payload ID: 16402
  Gene Symbol: SORD
  Gene Name: sorbitol dehydrogenase
  Uniprot ID: Q00796
  ENSP ID: ENSP00000453904
MAAAAKPNNLSLVVHGPGDLRLENYPIPEPGPNEVLLRMHSVGICGSDVHYWEYGRIGNFIVKKPMVLGHEASGTVEKVGSSVKHLKPGFLTMSPLRKAP

SEQ ID NO: 82427 - protein, 198 aa, Homo sapiens
  Payload ID: 16403
  Gene Symbol: SRI
  Gene Name: sorcin
  Uniprot ID: P30626
  ENSP ID: ENSP00000265729
MAYPGHPGAGGGYYPGGYGGAPGGPAFPGQTQDPLYGYFAAVAGQDGQIDADELQRCLTQSGIAGGYKPFNLETCRLMVSMLDRDMSGTMGFNEFKELWAVLNGWRQHFISFDTDRSGTVDPQELQKALTTMGFRLSPQAVNSIAKRYSTNGKITFDDYIACCVKLRALTDSFRRRDTAQQGVVNFPYDDFIQCVMSV

SEQ ID NO: 82428 - protein, 183 aa, Homo sapiens
  Payload ID: 16403
  Gene Symbol: SRI
  Gene Name: sorcin
  Uniprot ID: P30626
  ENSP ID: ENSP00000378137
MQYGGAPGGPAFPGQTQDPLYGYFAAVAGQDGQIDADELQRCLTQSGIAGGYKPFNLETCRLMVSMLDRDMSGTMGFNEFKELWAVLNGWRQHFISFDTDRSGTVDPQELQKALTTMGFRLSPQAVNSIAKRYSTNGKITFDDYIACCVKLRALTDSFRRRDTAQQGVVNFPYDDFIQCVMSV

SEQ ID NO: 82429 - protein, 180 aa, Homo sapiens
  Payload ID: 16403
  Gene Symbol: SRI
  Gene Name: sorcin
  Uniprot ID: P30626
  ENSP ID: ENSP00000391148
MQYGGAPGGPAFPGQTQDPLYGYFAAVAGQDGQIDADELQRCLTQSGIAGGYKPFNLETCRLMVSMLDRDMSGTMGFNEFKELWAVLNGWRQHFISFDTDRSGTVDPQELQKALTTMGFRLSPQAVNSIAKRYSTNGKITFDDYIACCVKLRALTDSFRRRDTAQQGVVNFPYDDVSLRN

SEQ ID NO: 82430 - protein, 158 aa, Homo sapiens
  Payload ID: 16403
  Gene Symbol: SRI
  Gene Name: sorcin
  ENSP ID: ENSP00000397609
MAYPGHPGAGGGYYPGGYGGAPGGPAFPGQTQDPLYGYFAAVAGQDGQIDADELQRCLTQSGIAGGYKPFNLETCRLMVSMLDRDMSGTMGFNEFKELWAVNSIAKRYSTNGKITFDDYIACCVKLRALTDSFRRRDTAQQGVVNFPYDDFIQCVMSV

SEQ ID NO: 82431 - protein, 72 aa, Homo sapiens
  Payload ID: 16403
  Gene Symbol: SRI
  Gene Name: sorcin
  ENSP ID: ENSP00000415271
MAYPGHPGAGGGYYPGGYGGAPGGPAFPGQTQDPLYGYFAAVAGQDGQIDADELQRCLTQSGIAGGYKLVRL

SEQ ID NO: 82432 - protein, 155 aa, Homo sapiens
  Payload ID: 16403
  Gene Symbol: SRI
  Gene Name: sorcin
  ENSP ID: ENSP00000418512
MQDGQIDADELQRCLTQSGIAGGYKPFNLETCRLMVSMLDRDMSGTMGFNEFKELWAVLNGWRQHFISFDTDRSGTVDPQELQKALTTMGFRLSPQAVNSIAKRYSTNGKITFDDYIACCVKLRALTDSFRRRDTAQQGVVNFPYDDFIQCVMSV

SEQ ID NO: 82433 - protein, 831 aa, Homo sapiens
  Payload ID: 16404
  Gene Symbol: SORT1
  Gene Name: sortilin 1
  Uniprot ID: Q99523
  ENSP ID: ENSP00000256637
MERPWGAADGLSRWPHGLGLLLLLQLLPPSTLSQDRLDAPPPPAAPLPRWSGPIGVSWGLRAAAAGGAFPRGGRWRRSAPGEDEECGRVRDFVAKLANNTHQHVFDDLRGSVSLSWVGDSTGVILVLTTFHVPLVIMTFGQSKLYRSEDYGKNFKDITDLINNTFIRTEFGMAIGPENSGKVVLTAEVSGGSRGGRIFRSSDFAKNFVQTDLPFHPLTQMMYSPQNSDYLLALSTENGLWVSKNFGGKWEEIHKAVCLAKWGSDNTIFFTTYANGSCKADLGALELWRTSDLGKSFKTIGVKIYSFGLGGRFLFASVMADKDTTRRIHVSTDQGDTWSMAQLPSVGQEQFYSILAANDDMVFMHVDEPGDTGFGTIFTSDDRGIVYSKSLDRHLYTTTGGETDFTNVTSLRGVYITSVLSEDNSIQTMITFDQGGRWTHLRKPENSECDATAKNKNECSLHIHASYSISQKLNVPMAPLSEPNAVGIVIAHGSVGDAISVMVPDVYISDDGGYSWTKMLEGPHYYTILDSGGIIVAIEHSSRPINVIKFSTDEGQCWQTYTFTRDPIYFTGLASEPGARSMNISIWGFTESFLTSQWVSYTIDFKDILERNCEEKDYTIWLAHSTDPEDYEDGCILGYKEQFLRLRKSSVCQNGRDYVVTKQPSICLCSLEDFLCDFGYYRPENDSKCVEQPELKGHDLEFCLYGREEHLTTNGYRKIPGDKCQGGVNPVREVKDLKKKCTSNFLSPEKQNSKSNSVPIILAIVGLMLVTVVAGVLIVKKYVCGGRFLVHRYSVLQQHAEANGVDGVDALDTASHTNKSGYHDDSDEDLLE

SEQ ID NO: 82434 - protein, 694 aa, Homo sapiens
  Payload ID: 16404
  Gene Symbol: SORT1
  Gene Name: sortilin 1
  Uniprot ID: Q99523
  ENSP ID: ENSP00000438597
MTFGQSKLYRSEDYGKNFKDITDLINNTFIRTEFGMAIGPENSGKVVLTAEVSGGSRGGRIFRSSDFAKNFVQTDLPFHPLTQMMYSPQNSDYLLALSTENGLWVSKNFGGKWEEIHKAVCLAKWGSDNTIFFTTYANGSCTDLGALELWRTSDLGKSFKTIGVKIYSFGLGGRFLFASVMADKDTTRRIHVSTDQGDTWSMAQLPSVGQEQFYSILAANDDMVFMHVDEPGDTGFGTIFTSDDRGIVYSKSLDRHLYTTTGGETDFTNVTSLRGVYITSVLSEDNSIQTMITFDQGGRWTHLRKPENSECDATAKNKNECSLHIHASYSISQKLNVPMAPLSEPNAVGIVIAHGSVGDAISVMVPDVYISDDGGYSWTKMLEGPHYYTILDSGGIIVAIEHSSRPINVIKFSTDEGQCWQTYTFTRDPIYFTGLASEPGARSMNISIWGFTESFLTSQWVSYTIDFKDILERNCEEKDYTIWLAHSTDPEDYEDGCILGYKEQFLRLRKSSVCQNGRDYVVTKQPSICLCSLEDFLCDFGYYRPENDSKCVEQPELKGHDLEFCLYGREEHLTTNGYRKIPGDKCQGGVNPVREVKDLKKKCTSNFLSPEKQNSKSNSVPIILAIVGLMLVTVVAGVLIVKKYVCGGRFLVHRYSVLQQHAEANGVDGVDALDTASHTNKSGYHDDSDEDLLE

SEQ ID NO: 82435 - protein, 104 aa, Homo sapiens
  Payload ID: 16404
  Gene Symbol: SORT1
  Gene Name: sortilin 1
  ENSP ID: ENSP00000487674
  MOD_RES (1)..(1): Any amino acid
XSRWPHGLGLLLLLQLLPPSTLSQDRLDAPPPPAAPLPRWSGPIGVSWGLRAAAAGGAFPRGGRWRRSAPGEDEECGRVRDFVAKLANNTHQLSKSLEHRFSSV

SEQ ID NO: 82436 - protein, 60 aa, Homo sapiens
  Payload ID: 16404
  Gene Symbol: SORT1
  Gene Name: sortilin 1
  ENSP ID: ENSP00000487712
MTFGQSKLYRSEDYGKNFKDITDLINNTFIRTEFGMAIGPENSGKVVLTAEVSGGSRGGR

SEQ ID NO: 82437 - protein, 118 aa, Homo sapiens
  Payload ID: 16404
  Gene Symbol: SORT1
  Gene Name: sortilin 1
  ENSP ID: ENSP00000488262
MTFGQSKLYRSEDYGKNFKDITDLINNTFIRTEFGMAIGPENSGKVVLTAEVSGGSRGGRIFRSSDFAKNFVQTDLPFHPLTQMMYSPQNSDYLLALSTENGLWVSKNFGGKWEEIHK

SEQ ID NO: 82438 - protein, 20 aa, Homo sapiens
  Payload ID: 16404
  Gene Symbol: SORT1
  Gene Name: sortilin 1
  ENSP ID: ENSP00000488662
MTFGQSKLYRSEDYGKNFKD

SEQ ID NO: 82439 - protein, 2214 aa, Homo sapiens
  Payload ID: 16405
  Gene Symbol: SORL1
  Gene Name: sortilin-related receptor, L(DLR class) A repeats containing
  Uniprot ID: Q92673
  ENSP ID: ENSP00000260197
MATRSSRRESRLPFLFTLVALLPPGALCEVWTQRLHGGSAPLPQDRGFLVVQGDPRELRLWARGDARGASRADEKPLRRKRSAALQPEPIKVYGQVSLNDSHNQMVVHWAGEKSNVIVALARDSLALARPKSSDVYVSYDYGKSFKKISDKLNFGLGNRSEAVIAQFYHSPADNKRYIFADAYAQYLWITFDFCNTLQGFSIPFRAADLLLHSKASNLLLGFDRSHPNKQLWKSDDFGQTWIMIQEHVKSFSWGIDPYDKPNTIYIERHEPSGYSTVFRSTDFFQSRENQEVILEEVRDFQLRDKYMFATKVVHLLGSEQQSSVQLWVSFGRKPMRAAQFVTRHPINEYYIADASEDQVFVCVSHSNNRTNLYISEAEGLKFSLSLENVLYYSPGGAGSDTLVRYFANEPFADFHRVEGLQGVYIATLINGSMNEENMRSVITFDKGGTWEFLQAPAFTGYGEKINCELSQGCSLHLAQRLSQLLNLQLRRMPILSKESAPGLIIATGSVGKNLASKTNVYISSSAGARWREALPGPHYYTWGDHGGIITAIAQGMETNELKYSTNEGETWKTFIFSEKPVFVYGLLTEPGEKSTVFTIFGSNKENVHSWLILQVNATDALGVPCTENDYKLWSPSDERGNECLLGHKTVFKRRTPHATCFNGEDFDRPVVVSNCSCTREDYECDFGFKMSEDLSLEVCVPDPEFSGKSYSPPVPCPVGSTYRRTRGYRKISGDTCSGGDVEARLEGELVPCPLAEENEFILYAVRKSIYRYDLASGATEQLPLTGLRAAVALDFDYEHNCLYWSDLALDVIQRLCLNGSTGQEVIINSGLETVEALAFEPLSQLLYWVDAGFKKIEVANPDGDFRLTIVNSSVLDRPRALVLVPQEGVMFWTDWGDLKPGIYRSNMDGSAAYHLVSEDVKWPNGISVDDQWIYWTDAYLECIERITFSGQQRSVILDNLPHPYAIAVFKNEIYWDDWSQLSIFRASKYSGSQMEILANQLTGLMDMKIFYKGKNTGSNACVPRPCSLLCLPKANNSRSCRCPEDVSSSVLPSGDLMCDCPQGYQLKNNTCVKQENTCLRNQYRCSNGNCINSIWWCDFDNDCGDMSDERNCPTTICDLDTQFRCQESGTCIPLSYKCDLEDDCGDNSDESHCEMHQCRSDEYNCSSGMCIRSSWVCDGDNDCRDWSDEANCTAIYHTCEASNFQCRNGHCIPQRWACDGDTDCQDGSDEDPVNCEKKCNGFRCPNGTCIPSSKHCDGLRDCSDGSDEQHCEPLCTHFMDFVCKNRQQCLFHSMVCDGIIQCRDGSDEDAAFAGCSQDPEFHKVCDEFGFQCQNGVCISLIWKCDGMDDCGDYSDEANCENPTEAPNCSRYFQFRCENGHCIPNRWKCDRENDCGDWSDEKDCGDSHILPFSTPGPSTCLPNYYRCSSGTCVMDTWVCDGYRDCADGSDEEACPLLANVTAASTPTQLGRCDRFEFECHQPKTCIPNWKRCDGHQDCQDGRDEANCPTHSTLTCMSREFQCEDGEACIVLSERCDGFLDCSDESDEKACSDELTVYKVQNLQWTADFSGDVTLTWMRPKKMPSASCVYNVYYRVVGESIWKTLETHSNKTNTVLKVLKPDTTYQVKVQVQCLSKAHNTNDFVTLRTPEGLPDAPRNLQLSLPREAEGVIVGHWAPPIHTHGLIREYIVEYSRSGSKMWASQRAASNFTEIKNLLVNTLYTVRVAAVTSRGIGNWSDSKSITTIKGKVIPPPDIHIDSYGENYLSFTLTMESDIKVNGYVVNLFWAFDTHKQERRTLNFRGSILSHKVGNLTAHTSYEISAWAKTDLGDSPLAFEHVMTRGVRPPAPSLKAKAINQTAVECTWTGPRNVVYGIFYATSFLDLYRNPKSLTTSLHNKTVIVSKDEQYLFLVRVVVPYQGPSSDYVVVKMIPDSRLPPRHLHVVHTGKTSVVIKWESPYDSPDQDLLYAVAVKDLIRKTDRSYKVKSRNSTVEYTLNKLEPGGKYHIIVQLGNMSKDSSIKITTVSLSAPDALKIITENDHVLLFWKSLALKEKHFNESRGYEIHMFDSAMNITAYLGNTTDNFFKISNLKMGHNYTFTVQARCLFGNQICGEPAILLYDELGSGADASATQAARSTDVAAVVVPILFLILLSLGVGFAILYTKHRRLQSSFTAFANSHYSSRLGSAIFSSGDDLGEDDEDAPMITGFSDDVPMVIA

SEQ ID NO: 82440 - protein, 1060 aa, Homo sapiens
  Payload ID: 16405
  Gene Symbol: SORL1
  Gene Name: sortilin-related receptor, L(DLR class) A repeats containing
  ENSP ID: ENSP00000432131
MHQCRSDEYNCSSGMCIRSSWVCDGDNDCRDWSDEANCTAIYHTCEASNFQCRNGHCIPQRWACDGDTDCQDGSDEDPVNCEKKCNGFRCPNGTCIPSSKHCDGLRDCSDGSDEQHCEPLCTHFMDFVCKNRQQCLFHSMVCDGIIQCRDGSDEDAAFAGCSQDPEFHKVCDEFGFQCQNGVCISLIWKCDGMDDCGDYSDEANCENPTEAPNCSRYFQFRCENGHCIPNRWKCDRENDCGDWSDEKDCGDSHILPFSTPGPSTCLPNYYRCSSGTCVMDTWVCDGYRDCADGSDEEACPLLANVTAASTPTQLGRCDRFEFECHQPKTCIPNWKRCDGHQDCQDGRDEANCPTHSTLTCMSREFQCEDGEACIVLSERCDGFLDCSDESDEKACSDELTVYKVQNLQWTADFSGDVTLTWMRPKKMPSASCVYNVYYRVVGESIWKTLETHSNKTNTVLKVLKPDTTYQVKVQVQCLSKAHNTNDFVTLRTPEGLPDAPRNLQLSLPREAEGVIVGHWAPPIHTHGLIREYIVEYSRSGSKMWASQRAASNFTEIKNLLVNTLYTVRVAAVTSRGIGNWSDSKSITTIKGKVIPPPDIHIDSYGENYLSFTLTMESDIKVNGYVVNLFWAFDTHKQERRTLNFRGSILSHKVGNLTAHTSYEISAWAKTDLGDSPLAFEHVMTRGVRPPAPSLKAKAINQTAVECTWTGPRNVVYGIFYATSFLDLYRNPKSLTTSLHNKTVIVSKDEQYLFLVRVVVPYQGPSSDYVVVKMIPDSRLPPRHLHVVHTGKTSVVIKWESPYDSPDQDLLYAVAVKDLIRKTDRSYKVKSRNSTVEYTLNKLEPGGKYHIIVQLGNMSKDSSIKITTVSLSAPDALKIITENDHVLLFWKSLALKEKHFNESRGYEIHMFDSAMNITAYLGNTTDNFFKISNLKMGHNYTFTVQARCLFGNQICGEPAILLYDELGSGADASATQAARSTDVAAVVVPILFLILLSLGVGFAILYTKHRRLQSSFTAFANSHYSSRLGSAIFSSGDDLGEDDEDAPMITGFSDDVPMVIA

SEQ ID NO: 82441 - protein, 1158 aa, Homo sapiens
  Payload ID: 16405
  Gene Symbol: SORL1
  Gene Name: sortilin-related receptor, L(DLR class) A repeats containing
  ENSP ID: ENSP00000434634
MCDCPQGYQLKNNTCVKQENTCLRNQYRCSNGNCINSIWWCDFDNDCGDMSDERNCPTTICDLDTQFRCQESGTCIPLSYKCDLEDDCGDNSDESHCEMHQCRSDEYNCSSGMCIRSSWVCDGDNDCRDWSDEANCTAIYHTCEASNFQCRNGHCIPQRWACDGDTDCQDGSDEDPVNCEKKCNGFRCPNGTCIPSSKHCDGLRDCSDGSDEQHCEPLCTHFMDFVCKNRQQCLFHSMVCDGIIQCRDGSDEDAAFAGCSQDPEFHKVCDEFGFQCQNGVCISLIWKCDGMDDCGDYSDEANCENPTEAPNCSRYFQFRCENGHCIPNRWKCDRENDCGDWSDEKDCGDSHILPFSTPGPSTCLPNYYRCSSGTCVMDTWVCDGYRDCADGSDEEACPLLANVTAASTPTQLGRCDRFEFECHQPKTCIPNWKRCDGHQDCQDGRDEANCPTHSTLTCMSREFQCEDGEACIVLSERCDGFLDCSDESDEKACSDELTVYKVQNLQWTADFSGDVTLTWMRPKKMPSASCVYNVYYRVVGESIWKTLETHSNKTNTVLKVLKPDTTYQVKVQVQCLSKAHNTNDFVTLRTPEGLPDAPRNLQLSLPREAEGVIVGHWAPPIHTHGLIREYIVEYSRSGSKMWASQRAASNFTEIKNLLVNTLYTVRVAAVTSRGIGNWSDSKSITTIKGKVIPPPDIHIDSYGENYLSFTLTMESDIKVNGYVVNLFWAFDTHKQERRTLNFRGSILSHKVGNLTAHTSYEISAWAKTDLGDSPLAFEHVMTRGVRPPAPSLKAKAINQTAVECTWTGPRNVVYGIFYATSFLDLYRNPKSLTTSLHNKTVIVSKDEQYLFLVRVVVPYQGPSSDYVVVKMIPDSRLPPRHLHVVHTGKTSVVIKWESPYDSPDQDLLYAVAVKDLIRKTDRSYKVKSRNSTVEYTLNKLEPGGKYHIIVQLGNMSKDSSIKITTVSLSAPDALKIITENDHVLLFWKSLALKEKHFNESRGYEIHMFDSAMNITAYLGNTTDNFFKISNLKMGHNYTFTVQARCLFGNQICGEPAILLYDELGSGADASATQAARSTDVAAVVVPILFLILLSLGVGFAILYTKHRRLQSSFTAFANSHYSSRLGSAIFSSGDDLGEDDEDAPMITGFSDDVPMVIA

SEQ ID NO: 82442 - protein, 829 aa, Homo sapiens
  Payload ID: 16405
  Gene Symbol: SORL1
  Gene Name: sortilin-related receptor, L(DLR class) A repeats containing
  ENSP ID: ENSP00000435405
MISRLAAAQSCASHWPPSADSHILPFSTPGPSTCLPNYYRCSSGTCVMDTWVCDGYRDCADGSDEEACPLLANVTAASTPTQLGRCDRFEFECHQPKTCIPNWKRCDGHQDCQDGRDEANCPTHSTLTCMSREFQCEDGEACIVLSERCDGFLDCSDESDEKACSDELTVYKVQNLQWTADFSGDVTLTWMRPKKMPSASCVYNVYYRVVGESIWKTLETHSNKTNTVLKVLKPDTTYQVKVQVQCLSKAHNTNDFVTLRTPEGLPDAPRNLQLSLPREAEGVIVGHWAPPIHTHGLIREYIVEYSRSGSKMWASQRAASNFTEIKNLLVNTLYTVRVAAVTSRGIGNWSDSKSITTIKGKVIPPPDIHIDSYGENYLSFTLTMESDIKVNGYVVNLFWAFDTHKQERRTLNFRGSILSHKVGNLTAHTSYEISAWAKTDLGDSPLAFEHVMTRGVRPPAPSLKAKAINQTAVECTWTGPRNVVYGIFYATSFLDLYRNPKSLTTSLHNKTVIVSKDEQYLFLVRVVVPYQGPSSDYVVVKMIPDSRLPPRHLHVVHTGKTSVVIKWESPYDSPDQDLLYAVAVKDLIRKTDRSYKVKSRNSTVEYTLNKLEPGGKYHIIVQLGNMSKDSSIKITTVSLSAPDALKIITENDHVLLFWKSLALKEKHFNESRGYEIHMFDSAMNITAYLGNTTDNFFKISNLKMGHNYTFTVQARCLFGNQICGEPAILLYDELGSGADASATQAARSTDVAAVVVPILFLILLSLGVGFAILYTKHRRLQSSFTAFANSHYSSRLGSAIFSSGDDLGEDDEDAPMITGFSDDVPMVIA

SEQ ID NO: 82443 - protein, 1124 aa, Homo sapiens
  Payload ID: 16405
  Gene Symbol: SORL1
  Gene Name: sortilin-related receptor, L(DLR class) A repeats containing
  ENSP ID: ENSP00000436447
MQTSRHSFSQTTGCVCRSPLFLESSTSWPPLSLLPNLLPIIASIENNICGEHWDEWTRMLLSREMHQCRSDEYNCSSGMCIRSSWVCDGDNDCRDWSDEANCTAIYHTCEASNFQCRNGHCIPQRWACDGDTDCQDGSDEDPVNCEKKCNGFRCPNGTCIPSSKHCDGLRDCSDGSDEQHCEPLCTHFMDFVCKNRQQCLFHSMVCDGIIQCRDGSDEDAAFAGCSQDPEFHKVCDEFGFQCQNGVCISLIWKCDGMDDCGDYSDEANCENPTEAPNCSRYFQFRCENGHCIPNRWKCDRENDCGDWSDEKDCGDSHILPFSTPGPSTCLPNYYRCSSGTCVMDTWVCDGYRDCADGSDEEACPLLANVTAASTPTQLGRCDRFEFECHQPKTCIPNWKRCDGHQDCQDGRDEANCPTHSTLTCMSREFQCEDGEACIVLSERCDGFLDCSDESDEKACSDELTVYKVQNLQWTADFSGDVTLTWMRPKKMPSASCVYNVYYRVVGESIWKTLETHSNKTNTVLKVLKPDTTYQVKVQVQCLSKAHNTNDFVTLRTPEGLPDAPRNLQLSLPREAEGVIVGHWAPPIHTHGLIREYIVEYSRSGSKMWASQRAASNFTEIKNLLVNTLYTVRVAAVTSRGIGNWSDSKSITTIKGKVIPPPDIHIDSYGENYLSFTLTMESDIKVNGYVVNLFWAFDTHKQERRTLNFRGSILSHKVGNLTAHTSYEISAWAKTDLGDSPLAFEHVMTRGVRPPAPSLKAKAINQTAVECTWTGPRNVVYGIFYATSFLDLYRNPKSLTTSLHNKTVIVSKDEQYLFLVRVVVPYQGPSSDYVVVKMIPDSRLPPRHLHVVHTGKTSVVIKWESPYDSPDQDLLYAVAVKDLIRKTDRSYKVKSRNSTVEYTLNKLEPGGKYHIIVQLGNMSKDSSIKITTVSLSAPDALKIITENDHVLLFWKSLALKEKHFNESRGYEIHMFDSAMNITAYLGNTTDNFFKISNLKMGHNYTFTVQARCLFGNQICGEPAILLYDELGSGADASATQAARSTDVAAVVVPILFLILLSLGVGFAILYTKHRRLQSSFTAFANSHYSSRLGSAIFSSGDDLGEDDEDAPMITGFSDDVPMVIA

SEQ ID NO: 82444 - protein, 1168 aa, Homo sapiens
  Payload ID: 16406
  Gene Symbol: SORCS1
  Gene Name: sortilin-related VPS10 domain containing receptor 1
  Uniprot ID: Q8WY21
  ENSP ID: ENSP00000263054
MGKVGAGGGSQARLSALLAGAGLLILCAPGVCGGGSCCPSPHPSSAPRSASTPRGFSHQGRPGRAPATPLPLVVRPLFSVAPGDRALSLERARGTGASMAVAARSGRRRRSGADQEKAERGEGASRSPRGVLRDGGQQEPGTRERDPDKATRFRMEELRLTSTTFALTGDSAHNQAMVHWSGHNSSVILILTKLYDYNLGSITESSLWRSTDYGTTYEKLNDKVGLKTILSYLYVCPTNKRKIMLLTDPEIESSLLISSDEGATYQKYRLNFYIQSLLFHPKQEDWILAYSQDQKLYSSAEFGRRWQLIQEGVVPNRFYWSVMGSNKEPDLVHLEARTVDGHSHYLTCRMQNCTEANRNQPFPGYIDPDSLIVQDHYVFVQLTSGGRPHYYVSYRRNAFAQMKLPKYALPKDMHVISTDENQVFAAVQEWNQNDTYNLYISDTRGVYFTLALENVQSSRGPEGNIMIDLYEVAGIKGMFLANKKIDNQVKTFITYNKGRDWRLLQAPDTDLRGDPVHCLLPYCSLHLHLKVSENPYTSGIIASKDTAPSIIVASGNIGSELSDTDISMFVSSDAGNTWRQIFEEEHSVLYLDQGGVLVAMKHTSLPIRHLWLSFDEGRSWSKYSFTSIPLFVDGVLGEPGEETLIMTVFGHFSHRSEWQLVKVDYKSIFDRRCAEEDYRPWQLHSQGEACIMGAKRIYKKRKSERKCMQGKYAGAMESEPCVCTEADFDCDYGYERHSNGQCLPAFWFNPSSLSKDCSLGQSYLNSTGYRKVVSNNCTDGVREQYTAKPQKCPGKAPRGLRIVTADGKLTAEQGHNVTLMVQLEEGDVQRTLIQVDFGDGIAVSYVNLSSMEDGIKHVYQNVGIFRVTVQVDNSLGSDSAVLYLHVTCPLEHVHLSLPFVTTKNKEVNATAVLWPSQVGTLTYVWWYGNNTEPLITLEGSISFRFTSEGMNTITVQVSAGNAILQDTKTIAVYEEFRSLRLSFSPNLDDYNPDIPEWRRDIGRVIKKSLVEATGVPGQHILVAVLPGLPTTAELFVLPYQDPAGENKRSTDDLEQISELLIHTLNQNSVHFELKPGVRVLVHAAHLTAAPLVDLTPTHSGSAMLMLLSVVFVGLAVFVIYKFKRRVALPSPPSPSTQPGDSSLRLQRARHATPPSTPKRGSAGAQYAI

SEQ ID NO: 82445 - protein, 945 aa, Homo sapiens
  Payload ID: 16406
  Gene Symbol: SORCS1
  Gene Name: sortilin-related VPS10 domain containing receptor 1
  ENSP ID: ENSP00000345964
IMLLTDPEIESSLLISSDEGATYQKYRLNFYIQSLLFHPKQEDWILAYSQDQKLYSSAEFGRRWQLIQEGVVPNRFYWSVMGSNKEPDLVHLEARTVDGHSHYLTCRMQNCTEANRNQPFPGYIDPDSLIVQDHYVFVQLTSGGRPHYYVSYRRNAFAQMKLPKYALPKDMHVISTDENQVFAAVQEWNQNDTYNLYISDTRGVYFTLALENVQSSRGPEGNIMIDLYEVAGIKGMFLANKKIDNQVKTFITYNKGRDWRLLQAPDTDLRGDPVHCLLPYCSLHLHLKVSENPYTSGIIASKDTAPSIIVASGNIGSELSDTDISMFVSSDAGNTWRQIFEEEHSVLYLDQGGVLVAMKHTSLPIRHLWLSFDEGRSWSKYSFTSIPLFVDGVLGEPGEETLIMTVFGHFSHRSEWQLVKVDYKSIFDRRCAEEDYRPWQLHSQGEACIMGAKRIYKKRKSERKCMQGKYAGAMESEPCVCTEADFDCDYGYERHSNGQCLPAFWFNPSSLSKDCSLGQSYLNSTGYRKVVSNNCTDGVREQYTAKPQKCPGKAPRGLRIVTADGKLTAEQGHNVTLMVQLEEGDVQRTLIQVDFGDGIAVSYVNLSSMEDGIKHVYQNVGIFRVTVQVDNSLGSDSAVLYLHVTCPLEHVHLSLPFVTTKNKEVNATAVLWPSQVGTLTYVWWYGNNTEPLITLEGSISFRFTSEGMNTITVQVSAGNAILQDTKTIAVYEEFRSLRLSFSPNLDDYNPDIPEWRRDIGRVIKKSLVEATGVPGQHILVAVLPGLPTTAELFVLPYQDPAGENKRSTDDLEQISELLIHTLNQNSVHFELKPGVRVLVHAAHLTAAPLVDLTPTHSGSAMLMLLSVVFVGLAVFVIYKFKRKIPGINVYAQMQNEKEQEMISPVSHSESRPNVPQTELRRPGQLIDEKVESQLIGRYRSTLQSL

SEQ ID NO: 82446 - protein, 714 aa, Homo sapiens
  Payload ID: 16406
  Gene Symbol: SORCS1
  Gene Name: sortilin-related VPS10 domain containing receptor 1
  ENSP ID: ENSP00000358712
MIDLYEVAGIKGMFLANKKIDNQVKTFITYNKGRDWRLLQAPDTDLRGDPVHCLLPYCSLHLHLKVSENPYTSGIIASKDTAPSIIVASGNIGSELSDTDISMFVSSDAGNTWRQIFEEEHSVLYLDQGGVLVAMKHTSLPIRHLWLSFDEGRSWSKYSFTSIPLFVDGVLGEPGEETLIMTVFGHFSHRSEWQLVKVDYKSIFDRRCAEEDYRPWQLHSQGEACIMGAKRIYKKRKSERKCMQGKYAGAMESEPCVCTEADFDCDYGYERHSNGQCLPAFWFNPSSLSKDCSLGQSYLNSTGYRKVVSNNCTDGVREQYTAKPQKCPGKAPRGLRIVTADGKLTAEQGHNVTLMVQLEEGDVQRTLIQVDFGDGIAVSYVNLSSMEDGIKHVYQNVGIFRVTVQVDNSLGSDSAVLYLHVTCPLEHVHLSLPFVTTKNKEVNATAVLWPSQVGTLTYVWWYGNNTEPLITLEGSISFRFTSEGMNTITVQVSAGNAILQDTKTIAVYEEFRSLRLSFSPNLDDYNPDIPEWRRDIGRVIKKSLVEATGVPGQHILVAVLPGLPTTAELFVLPYQDPAGENKRSTDDLEQISELLIHTLNQNSVHFELKPGVRVLVHAAHLTAAPLVDLTPTHSGSAMLMLLSVVFVGLAVFVIYKFKRKIPGINVYAQMQNEKEQEMISPVSHSESRPNVPQTELRRPGQLIDEKVESQLIGE

SEQ ID NO: 82447 - protein, 213 aa, Homo sapiens
  Payload ID: 16406
  Gene Symbol: SORCS1
  Gene Name: sortilin-related VPS10 domain containing receptor 1
  ENSP ID: ENSP00000407769
  MOD_RES (1)..(1): Any amino acid
XLDDYNPDIPEWRRDIGRVIKKSLVEATGVPGQHILVAVLPGLPTTAELFVLPYQDPAGENKRSTDDLEQISELLIHTLNQNSVHFELKPGVRVLVHAAHLTAAPLVDLTPTHSGSAMLMLLSVVFVGLAVFVIYKFKRKIPGINVYAQMQNEKEQEMISPVSHSESRPNVPQTELRRPGQLIDEKVESQLIGSISIVAENQSTKEIPTYVNV

SEQ ID NO: 82448 - protein, 926 aa, Homo sapiens
  Payload ID: 16406
  Gene Symbol: SORCS1
  Gene Name: sortilin-related VPS10 domain containing receptor 1
  ENSP ID: ENSP00000477888
IMLLTDPEIESSLLISSDEGATYQKYRLNFYIQSLLFHPKQEDWILAYSQDQKLYSSAEFGRRWQLIQEGVVPNRFYWSVMGSNKEPDLVHLEARTVDGHSHYLTCRMQNCTEANRNQPFPGYIDPDSLIVQDHYVFVQLTSGGRPHYYVSYRRNAFAQMKLPKYALPKDMHVISTDENQVFAAVQEWNQNDTYNLYISDTRGVYFTLALENVQSSRGPEGNIMIDLYEVAGIKGMFLANKKIDNQVKTFITYNKGRDWRLLQAPDTDLRGDPVHCLLPYCSLHLHLKVSENPYTSGIIASKDTAPSIIVASGNIGSELSDTDISMFVSSDAGNTWRQIFEEEHSVLYLDQGGVLVAMKHTSLPIRHLWLSFDEGRSWSKYSFTSIPLFVDGVLGEPGEETLIMTVFGHFSHRSEWQLVKVDYKSIFDRRCAEEDYRPWQLHSQGEACIMGAKRIYKKRKSERKCMQGKYAGAMESEPCVCTEADFDCDYGYERHSNGQCLPAFWFNPSSLSKDCSLGQSYLNSTGYRKVVSNNCTDGVREQYTAKPQKCPGKAPRGLRIVTADGKLTAEQGHNVTLMVQLEEGDVQRTLIQVDFGDGIAVSYVNLSSMEDGIKHVYQNVGIFRVTVQVDNSLGSDSAVLYLHVTCPLEHVHLSLPFVTTKNKEVNATAVLWPSQVGTLTYVWWYGNNTEPLITLEGSISFRFTSEGMNTITVQVSAGNAILQDTKTIAVYEEFRSLRLSFSPNLDDYNPDIPEWRRDIGRVIKKSLVEATGVPGQHILVAVLPGLPTTAELFVLPYQDPAGENKRSTDDLEQISELLIHTLNQNSVHFELKPGVRVLVHAAHLTAAPLVDLTPTHSGSAMLMLLSVVFVGLAVFVIYKFKRRVALPSPPSPSTQPGDSSLRLQRARHATPPSTPKRGSAGAQYAI

SEQ ID NO: 82449 - protein, 937 aa, Homo sapiens
  Payload ID: 16406
  Gene Symbol: SORCS1
  Gene Name: sortilin-related VPS10 domain containing receptor 1
  ENSP ID: ENSP00000478065
IMLLTDPEIESSLLISSDEGATYQKYRLNFYIQSLLFHPKQEDWILAYSQDQKLYSSAEFGRRWQLIQEGVVPNRFYWSVMGSNKEPDLVHLEARTVDGHSHYLTCRMQNCTEANRNQPFPGYIDPDSLIVQDHYVFVQLTSGGRPHYYVSYRRNAFAQMKLPKYALPKDMHVISTDENQVFAAVQEWNQNDTYNLYISDTRGVYFTLALENVQSSRGPEGNIMIDLYEVAGIKGMFLANKKIDNQVKTFITYNKGRDWRLLQAPDTDLRGDPVHCLLPYCSLHLHLKVSENPYTSGIIASKDTAPSIIVASGNIGSELSDTDISMFVSSDAGNTWRQIFEEEHSVLYLDQGGVLVAMKHTSLPIRHLWLSFDEGRSWSKYSFTSIPLFVDGVLGEPGEETLIMTVFGHFSHRSEWQLVKVDYKSIFDRRCAEEDYRPWQLHSQGEACIMGAKRIYKKRKSERKCMQGKYAGAMESEPCVCTEADFDCDYGYERHSNGQCLPAFWFNPSSLSKDCSLGQSYLNSTGYRKVVSNNCTDGVREQYTAKPQKCPGKAPRGLRIVTADGKLTAEQGHNVTLMVQLEEGDVQRTLIQVDFGDGIAVSYVNLSSMEDGIKHVYQNVGIFRVTVQVDNSLGSDSAVLYLHVTCPLEHVHLSLPFVTTKNKEVNATAVLWPSQVGTLTYVWWYGNNTEPLITLEGSISFRFTSEGMNTITVQVSAGNAILQDTKTIAVYEEFRSLRLSFSPNLDDYNPDIPEWRRDIGRVIKKSLVEATGVPGQHILVAVLPGLPTTAELFVLPYQDPAGENKRSTDDLEQISELLIHTLNQNSVHFELKPGVRVLVHAAHLTAAPLVDLTPTHSGSAMLMLLSVVFVGLAVFVIYKFKRKIPGINVYAQMQNEKEQEMISPVSHSESRPNVPQTELRRPGQLIDEKVESQLIGE

SEQ ID NO: 82450 - protein, 987 aa, Homo sapiens
  Payload ID: 16407
  Gene Symbol: SORCS2
  Gene Name: sortilin-related VPS10 domain containing receptor 2
  ENSP ID: ENSP00000329124
MGKVLESSLWRSSDFGTSYTKLTLQPGVTTVIDNFYICPTNKRKVILVSSSLSDRDQSLFLSADEGATFQKQPIPFFVETLIFHPKEEDKVLAYTKESKLYVSSDLGKKWTLLQERVTKDHVFWSVSGVDADPDLVHVEAQDLGGDFRYVTCAIHNCSEKMLTAPFAGPIDHGSLTVQDDYIFFKATSANQTKYYVSYRRNEFVLMKLPKYALPKDLQIISTDESQVFVAVQEWYQMDTYNLYQSDPRGVRYALVLQDVRSSRQAEESVLIDILEVRGVKGVFLANQKIDGKVMTLITYNKGRDWDYLRPPSMDMNGKPTNCKPPDCHLHLHLRWADNPYVSGTVHTKDTAPGLIMGAGNLGSQLVEYKEEMYITSDCGHTWRQVFEEEHHILYLDHGGVIVAIKDTSIPLKILKFSVDEGLTWSTHNFTSTSVFVDGLLSEPGDETLVMTVFGHISFRSDWELVKVDFRPSFSRQCGEEDYSSWELSNLQGDRCIMGQQRSFRKRKSTSWCIKGRSFTSALTSRVCECRDSDFLCDYGFERSSSSESSTNKCSANFWFNPLSPPDDCALGQTYTSSLGYRKVVSNVCEGGVDMQQSQVQLQCPLTPPRGLQVSIQGEAVAVRPGEDVLFVVRQEQGDVLTTKYQVDLGDGFKAMYVNLTLTGEPIRHRYESPGIYRVSVRAENTAGHDEAVLFVQVNSPLQALYLEVVPVIGLNQEVNLTAVLLPLNPNLTVFYWWIGHSLQPLLSLDNSVTTRFSDTGDVRVTVQAACGNSVLQDSRVLRVLDQFQVMPLQFSKELDAYNPNTPEWREDVGLVVTRLLSKETSVPQELLVTVVKPGLPTLADLYVLLPPPRPTRKRSLSSDKRLAAIQQVLNAQKISFLLRGGVRVLVALRDTGTGAEQLGGGGGYWAVVVLFVIGLFAAGAFILYNFIRKRPGRTVYAQMHNEKEQEMTSPVSHSEDVQGAVQGNHSGVVLSINSREMHSYLVS

SEQ ID NO: 82451 - protein, 1159 aa, Homo sapiens
  Payload ID: 16407
  Gene Symbol: SORCS2
  Gene Name: sortilin-related VPS10 domain containing receptor 2
  Uniprot ID: Q96PQ0
  ENSP ID: ENSP00000422185
MAHRGPSRASKGPGPTARAPSPGAPPPPRSPRSRPLLLLLLLLGACGAAGRSPEPGRLGPHAQLTRVPRSPPAGRAEPGGGEDRQARGTEPGAPGPSPGPAPGPGEDGAPAAGYRRWERAAPLAGVASRAQVSLISTSFVLKGDATHNQAMVHWTGENSSVILILTKYYHADMGKVLESSLWRSSDFGTSYTKLTLQPGVTTVIDNFYICPTNKRKVILVSSSLSDRDQSLFLSADEGATFQKQPIPFFVETLIFHPKEEDKVLAYTKESKLYVSSDLGKKWTLLQERVTKDHVFWSVSGVDADPDLVHVEAQDLGGDFRYVTCAIHNCSEKMLTAPFAGPIDHGSLTVQDDYIFFKATSANQTKYYVSYRRNEFVLMKLPKYALPKDLQIISTDESQVFVAVQEWYQMDTYNLYQSDPRGVRYALVLQDVRSSRQAEESVLIDILEVRGVKGVFLANQKIDGKVMTLITYNKGRDWDYLRPPSMDMNGKPTNCKPPDCHLHLHLRWADNPYVSGTVHTKDTAPGLIMGAGNLGSQLVEYKEEMYITSDCGHTWRQVFEEEHHILYLDHGGVIVAIKDTSIPLKILKFSVDEGLTWSTHNFTSTSVFVDGLLSEPGDETLVMTVFGHISFRSDWELVKVDFRPSFSRQCGEEDYSSWELSNLQGDRCIMGQQRSFRKRKSTSWCIKGRSFTSALTSRVCECRDSDFLCDYGFERSSSSESSTNKCSANFWFNPLSPPDDCALGQTYTSSLGYRKVVSNVCEGGVDMQQSQVQLQCPLTPPRGLQVSIQGEAVAVRPGEDVLFVVRQEQGDVLTTKYQVDLGDGFKAMYVNLTLTGEPIRHRYESPGIYRVSVRAENTAGHDEAVLFVQVNSPLQALYLEVVPVIGLNQEVNLTAVLLPLNPNLTVFYWWIGHSLQPLLSLDNSVTTRFSDTGDVRVTVQAACGNSVLQDSRVLRVLDQFQVMPLQFSKELDAYNPNTPEWREDVGLVVTRLLSKETSVPQELLVTVVKPGLPTLADLYVLLPPPRPTRKRSLSSDKRLAAIQQVLNAQKISFLLRGGVRVLVALRDTGTGAEQLGGGGGYWAVVVLFVIGLFAAGAFILYKFKRKRPGRTVYAQMHNEKEQEMTSPVSHSEDVQGAVQGNHSGVVLSINSREMHSYLVS

SEQ ID NO: 82452 - protein, 101 aa, Homo sapiens
  Payload ID: 16407
  Gene Symbol: SORCS2
  Gene Name: sortilin-related VPS10 domain containing receptor 2
  ENSP ID: ENSP00000424194
QLGGGGGYWAVVVLFVIGLFAAGAFILYKFKRKRPGRTVYAQMHNEKEQEMTSPVSHSEDVQGAVQGEEFIDDDLDSQTLGNHSGVVLSINSREMHSYLVS

SEQ ID NO: 82453 - protein, 1222 aa, Homo sapiens
  Payload ID: 16408
  Gene Symbol: SORCS3
  Gene Name: sortilin-related VPS10 domain containing receptor 3
  Uniprot ID: Q9UPU3
  ENSP ID: ENSP00000358713
MEAARTERPAGRPGAPLVRTGLLLLSTWVLAGAEITWDATGGPGRPAAPASRPPALSPLSPRAVASQWPEELASARRAAVLGRRAGPELLPQQGGGRGGEMQVEAGGTSPAGERRGRGIPAPAKLGGARRSRRAQPPITQERGDAWATAPADGSRGSRPLAKGSREEVKAPRAGGSAAEDLRLPSTSFALTGDSAHNQAMVHWSGHNSSVILILTKLYDFNLGSVTESSLWRSTDYGTTYEKLNDKVGLKTVLSYLYVNPTNKRKIMLLSDPEMESSILISSDEGATYQKYRLTFYIQSLLFHPKQEDWVLAYSLDQKLYSSMDFGRRWQLMHERITPNRFYWSVAGLDKEADLVHMEVRTTDGYAHYLTCRIQECAETTRSGPFARSIDISSLVVQDEYIFIQVTTSGRASYYVSYRREAFAQIKLPKYSLPKDMHIISTDENQVFAAVQEWNQNDTYNLYISDTRGIYFTLAMENIKSSRGLMGNIIIELYEVAGIKGIFLANKKVDDQVKTYITYNKGRDWRLLQAPDVDLRGSPVHCLLPFCSLHLHLQLSENPYSSGRISSKETAPGLVVATGNIGPELSYTDIGVFISSDGGNTWRQIFDEEYNVWFLDWGGALVAMKHTPLPVRHLWVSFDEGHSWDKYGFTSVPLFVDGALVEAGMETHIMTVFGHFSLRSEWQLVKVDYKSIFSRHCTKEDYQTWHLLNQGEPCVMGERKIFKKRKPGAQCALGRDHSGSVVSEPCVCANWDFECDYGYERHGESQCVPAFWYNPASPSKDCSLGQSYLNSTGYRRIVSNNCTDGLREKYTAKAQMCPGKAPRGLHVVTTDGRLVAEQGHNATFIILMEEGDLQRTNIQLDFGDGIAVSYANFSPIEDGIKHVYKSAGIFQVTAYAENNLGSDTAVLFLHVVCPVEHVHLRVPFVAIRNKEVNISAVVWPSQLGTLTYFWWFGNSTKPLITLDSSISFTFLAEGTDTITVQVAAGNALIQDTKEIAVHEYFQSQLLSFSPNLDYHNPDIPEWRKDIGNVIKRALVKVTSVPEDQILIAVFPGLPTSAELFILPPKNLTERRKGNEGDLEQIVETLFNALNQNLVQFELKPGVQVIVYVTQLTLAPLVDSSAGHSSSAMLMLLSVVFVGLAVFLIYKFKRKIPWINIYAQVQHDKEQEMIGSVSQSENAPKITLSDFTEPEELLDKELDTRVIGGIATIANSESTKEIPNCTSV

SEQ ID NO: 82454 - protein, 1222 aa, Homo sapiens; identical to SEQ ID NO: 82453
  Payload ID: 16408
  Gene Symbol: SORCS3
  Gene Name: sortilin-related VPS10 domain containing receptor 3
  Uniprot ID: Q9UPU3
  ENSP ID: ENSP00000358715

SEQ ID NO: 82455 - protein, 152 aa, Homo sapiens
  Payload ID: 16408
  Gene Symbol: SORCS3
  Gene Name: sortilin-related VPS10 domain containing receptor 3
  ENSP ID: ENSP00000376876
ENPYSSGRISSKETAPGLVVATGNIGPELSYTDIGVFISSDGGNTWRQIFDEEYNVWFLDWGGALVAMKHTPLPVRHLWVSFDEGHSWDKYGFTSVPLFVDGALVEAGMETHIMTDYGYERHGESQCVPAFWYNPASPSKDCSLGQSYLNST

SEQ ID NO: 82456 - protein, 557 aa, Homo sapiens
  Payload ID: 16409
  Gene Symbol: SNX1
  Gene Name: sorting nexin 1
  Uniprot ID: Q13596
  ENSP ID: ENSP00000261889
MASGGGGCSASERLPPPFPGLEPESEGAAGGSEPEAGDSDTEGEDIFTGAAVVSKHQSPKITTSLLPINNGSKENGIHEEQDQEPQDLFADATVELSLDSTQNNQKKVLAKTLISLPPQEATNSSKPQPTYEELEEEEQEDQFDLTVGITDPEKIGDGMNAYVAYKVTTQTSLPLFRSKQFAVKRRFSDFLGLYEKLSEKHSQNGFIVPPPPEKSLIGMTKVKVGKEDSSSAEFLEKRRAALERYLQRIVNHPTMLQDPDVREFLEKEELPRAVGTQTLSGAGLLKMFNKATDAVSKMTIKMNESDIWFEEKLQEVECEEQRLRKLHAVVETLVNHRKELALNTAQFAKSLAMLGSSEDNTALSRALSQLAEVEEKIEQLHQEQANNDFFLLAELLSDYIRLLAIVRAAFDQRMKTWQRWQDAQATLQKKREAEARLLWANKPDKLQQAKDEILEWESRVTQYERDFERISTVVRKEVIRFEKEKSKDFKNHVIKYLETLLYSQQQAGEQLGIRSGILLTKKLPRYSKFFSTVHKFCAAASLWKWGFFLSAYLSYLF

SEQ ID NO: 82457 - protein, 102 aa, Homo sapiens
  Payload ID: 16409
  Gene Symbol: SNX1
  Gene Name: sorting nexin 1
  ENSP ID: ENSP00000369638
MASGGGGCSASERLPPPFPGLEPESEGAAGGSEPEAGDSDTEGEDIFTGAAVVSKHQSPKITTSLLPINNGSKENGIHEEQDQEPQDLFAGSHKFFEAPANL

SEQ ID NO: 82458 - protein, 304 aa, Homo sapiens
  Payload ID: 16409
  Gene Symbol: SNX1
  Gene Name: sorting nexin 1
  ENSP ID: ENSP00000452651
MTKVKVGKEDSSSAEFLEKRRAALERYLQRIVNHPTMLQDPDVREFLEKEELPRAVGTQTLSGAGLLKMFNKATDAVSKMTIKMNESDIWFEEKLQEVECEEQRLRKLHAVVETLVNHRKELALNTAQFAKSLAMLGSSEDNTALSRALSQLAEVEEKIEQLHQEQANNDFFLLAELLSDYIRLLAIVRAAFDQRMKTWQRWQDAQATLQKKREAEARLLWANKPDKLQQAKDEILEWESRVTQYERDFERISTVVRKEVIRFEKEKSKDFKNHVIKYLETLLYSQQQLAKYWEAFLPEAKAIS

SEQ ID NO: 82459 - protein, 19 aa, Homo sapiens
  Payload ID: 16409
  Gene Symbol: SNX1
  Gene Name: sorting nexin 1
  ENSP ID: ENSP00000452652
MNAYVAYKVTTQTSLPLFR

SEQ ID NO: 82460 - protein, 128 aa, Homo sapiens
  Payload ID: 16409
  Gene Symbol: SNX1
  Gene Name: sorting nexin 1
  ENSP ID: ENSP00000452668
GGGCSASERLPPPFPGLEPESEGAAGGSEPEAGDSDTEGEDIFTGAAVVSKHQSPKITTSLLPINNGSKENGIHEEQDQEPQDLFADATVELSLDSTQNNQKKCWDYRREPPHPALSCFLKDLKASTQ

SEQ ID NO: 82461 - protein, 107 aa, Homo sapiens
  Payload ID: 16409
  Gene Symbol: SNX1
  Gene Name: sorting nexin 1
  ENSP ID: ENSP00000452759
MASGGGGCSASERLPPPFPGLEPESEGAAGGSEPEAGDSDTEGEDIFTGAAVVSKHQSPKITTSLLPINNGSKENGIHEEQDQEPQDLFADKLTIVQKQTVCSKKKI

SEQ ID NO: 82462 - protein, 111 aa, Homo sapiens
  Payload ID: 16409
  Gene Symbol: SNX1
  Gene Name: sorting nexin 1
  ENSP ID: ENSP00000452852
  MOD_RES (1)..(1): Any amino acid
XGCSASERLPPPFPGLEPESEGAAGGSEPEAGDSDTEGEDIFTGAAVVSKHQSPKITTSLLPINNGSKENGIHEEQDQEPQDLFAGSHSVAQAGVQWCGHGSLQPRPPRLK

SEQ ID NO: 82463 - protein, 70 aa, Homo sapiens
  Payload ID: 16409
  Gene Symbol: SNX1
  Gene Name: sorting nexin 1
  ENSP ID: ENSP00000452931
WESRVTQYERDFERISTVVRKEVIRFEKEKSKDFKNHVIKYLETLLYSQQQAGEQLGIRSGILLTKKLPR

SEQ ID NO: 82464 - protein, 457 aa, Homo sapiens
  Payload ID: 16409
  Gene Symbol: SNX1
  Gene Name: sorting nexin 1
  Uniprot ID: Q13596
  ENSP ID: ENSP00000453567
MASGGGGCSASERLPPPFPGLEPESEGAAGGSEPEAGDSDTEGEDIFTGAAVVSKHQSPKITTSLLPINNGSKENGIHEEQDQEPQDLFAGDGMNAYVAYKVTTQTSLPLFRSKQFAVKRRFSDFLGLYEKLSEKHSQNGFIVPPPPEKSLIGMTKVKVGKEDSSSAEFLEKRRAALERYLQRIVNHPTMLQDPDVREFLEKEELPRAVGTQTLSGAGLLKMFNKATDAVSKMTIKMNESDIWFEEKLQEVECEEQRLRKLHAVVETLVNHRKELALNTAQFAKSLAMLGSSEDNTALSRALSQLAEVEEKIEQLHQEQANNDFFLLAELLSDYIRLLAIVRAAFDQRMKTWQRWQDAQATLQKKREAEARLLWANKPDKLQQAKDEILEWESRVTQYERDFERISTVVRKEVIRFEKEKSKDFKNHVIKYLETLLYSQQQLAKYWEAFLPEAKAIS

SEQ ID NO: 82465 - protein, 522 aa, Homo sapiens
  Payload ID: 16409
  Gene Symbol: SNX1
  Gene Name: sorting nexin 1
  Uniprot ID: Q13596
  ENSP ID: ENSP00000453785
MASGGGGCSASERLPPPFPGLEPESEGAAGGSEPEAGDSDTEGEDIFTGAAVVSKHQSPKITTSLLPINNGSKENGIHEEQDQEPQDLFADATVELSLDSTQNNQKKVLAKTLISLPPQEATNSSKPQPTYEELEEEEQEDQFDLTVGITDPEKIGDGMNAYVAYKVTTQTSLPLFRSKQFAVKRRFSDFLGLYEKLSEKHSQNGFIVPPPPEKSLIGMTKVKVGKEDSSSAEFLEKRRAALERYLQRIVNHPTMLQDPDVREFLEKEELPRAVGTQTLSGAGLLKMFNKATDAVSKMTIKMNESDIWFEEKLQEVECEEQRLRKLHAVVETLVNHRKELALNTAQFAKSLAMLGSSEDNTALSRALSQLAEVEEKIEQLHQEQANNDFFLLAELLSDYIRLLAIVRAAFDQRMKTWQRWQDAQATLQKKREAEARLLWANKPDKLQQAKDEILEWESRVTQYERDFERISTVVRKEVIRFEKEKSKDFKNHVIKYLETLLYSQQQLAKYWEAFLPEAKAIS

SEQ ID NO: 82466 - protein, 107 aa, Homo sapiens; identical to SEQ ID NO: 82461
  Payload ID: 16409
  Gene Symbol: SNX1
  Gene Name: sorting nexin 1
  ENSP ID: ENSP00000486714

SEQ ID NO: 82467 - protein, 201 aa, Homo sapiens
  Payload ID: 16410
  Gene Symbol: SNX10
  Gene Name: sorting nexin 10
  Uniprot ID: Q9Y5X0
  ENSP ID: ENSP00000343709
MFPEQQKEEFVSVWVRDPRIQKEDFWHSYIDYEICIHTNSMCFTMKTSCVRRRYREFVWLRQRLQSNALLVQLPELPSKNLFFNMNNRQHVDQRRQGLEDFLRKVLQNALLLSDSSLHLFLQSHLNSEDIEACVSGQTKYSVEEAIHKFALMNRRFPEEDEEGKKENDIDYDSESSSSGLGHSSDDSSSHGCKVNTAPQES

SEQ ID NO: 82468 - protein, 201 aa, Homo sapiens; identical to SEQ ID NO: 82467
  Payload ID: 16410
  Gene Symbol: SNX10
  Gene Name: sorting nexin 10
  Uniprot ID: Q9Y5X0
  ENSP ID: ENSP00000379661

SEQ ID NO: 82469 - protein, 117 aa, Homo sapiens
  Payload ID: 16410
  Gene Symbol: SNX10
  Gene Name: sorting nexin 10
  Uniprot ID: Q9Y5X0
  ENSP ID: ENSP00000386540
MNNRQHVDQRRQGLEDFLRKVLQNALLLSDSSLHLFLQSHLNSEDIEACVSGQTKYSVEEAIHKFALMNRRFPEEDEEGKKENDIDYDSESSSSGLGHSSDDSSSHGCKVNTAPQES

SEQ ID NO: 82470 - protein, 161 aa, Homo sapiens
  Payload ID: 16410
  Gene Symbol: SNX10
  Gene Name: sorting nexin 10
  ENSP ID: ENSP00000387274
MCFTMKTSCVRRRYREFVWLRQRLQSNALLVQLPELPSKNLFFNMNNRQHVDQRRQGLEDFLRKVLQNALLLSDSSLHLFLQSHLNSEDIEACVSGQTKYSVEEAIHKFALMNRRFPEEDEEGKKENDIDYDSESSSSGLGHSSDDSSSHGCKVNTAPQES

SEQ ID NO: 82471 - protein, 53 aa, Homo sapiens
  Payload ID: 16410
  Gene Symbol: SNX10
  Gene Name: sorting nexin 10
  ENSP ID: ENSP00000393690
MILMEGIGCMRHSSLTRQPKLPYRSLASARGGLQEFVSVWVRDPRIQKEDFWH

SEQ ID NO: 82472 - protein, 201 aa, Homo sapiens; identical to SEQ ID NO: 82467
  Payload ID: 16410
  Gene Symbol: SNX10
  Gene Name: sorting nexin 10
  Uniprot ID: Q9Y5X0
  ENSP ID: ENSP00000395474

SEQ ID NO: 82473 - protein, 197 aa, Homo sapiens
  Payload ID: 16410
  Gene Symbol: SNX10
  Gene Name: sorting nexin 10
  ENSP ID: ENSP00000408164
MILMEGIGCMRHSSLTRQPKLPYRSLASARGGLQEFVSVWVRDPRIQKEDFWHSYIDYEICIHTNSMCFTMKTSCVRRRYREFVWLRQRLQSNALLVQLPELPSKNLFFNMNNRQHVDQRRQGLEDFLRKVLQNALLLSDSSLHLFLQSHLNSEDIEACVSGQTKYSVEEAIHKFALMNRRFPEEDEEGKKENDIDY

SEQ ID NO: 82474 - protein, 201 aa, Homo sapiens [sequence omitted]

SEQ ID NO: 82475 - protein, 270 aa, Homo sapiens
  Payload ID: 16411
  Gene Symbol: SNX11
  Gene Name: sorting nexin 11
  Uniprot ID: Q9Y5W9
  ENSP ID: ENSP00000352175
MGFWCRMSENQEQEEVITVRVQDPRVQNEGSWNSYVDYKIFLHTNSKAFTAKTSCVRRRYREFVWLRKQLQRNAGLVPVPELPGKSTFFGTSDEFIEKRRQGLQHFLEKVLQSVVLLSDSQLHLFLQSQLSVPEIEACVQGRSTMTVSDAILRYAMSNCGWAQEERQSSSHLAKGDQPKSCCFLPRSGRRSSPSPPPSEEKDHLEVWAPVVDSEVPSLESPTLPPLSSPLCCDFGRPKEGTSTLQSVRRAVGGDHAVPLDPGQLETVLEK

SEQ ID NO: 82476 - protein, 270 aa, Homo sapiens; identical to SEQ ID NO: 82475
  Payload ID: 16411
  Gene Symbol: SNX11
  Gene Name: sorting nexin 11
  Uniprot ID: Q9Y5W9
  ENSP ID: ENSP00000377059

SEQ ID NO: 82477 - protein, 126 aa, Homo sapiens
  Payload ID: 16411
  Gene Symbol: SNX11
  Gene Name: sorting nexin 11
  ENSP ID: ENSP00000396790
MTVSDAILRYAMSNCGWAQEERQSSSHLAKGDQPKSCCFLPRSGRRSSPSPPPSEEKDHLEVWAPVVDSEVPSLESPTLPPLSSPLCCDFGRPKEGTSTLQSVRRAVGGDHAVPLDPGQLETVLEK

SEQ ID NO: 82478 - protein, 262 aa, Homo sapiens
  Payload ID: 16411
  Gene Symbol: SNX11
  Gene Name: sorting nexin 11
  Uniprot ID: Q9Y5W9
  ENSP ID: ENSP00000462188
MVCREQEVITVRVQDPRVQNEGSWNSYVDYKIFLHTNSKAFTAKTSCVRRRYREFVWLRKQLQRNAGLVPVPELPGKSTFFGTSDEFIEKRRQGLQHFLEKVLQSVVLLSDSQLHLFLQSQLSVPEIEACVQGRSTMTVSDAILRYAMSNCGWAQEERQSSSHLAKGDQPKSCCFLPRSGRRSSPSPPPSEEKDHLEVWAPVVDSEVPSLESPTLPPLSSPLCCDFGRPKEGTSTLQSVRRAVGGDHAVPLDPGQLETVLEK

SEQ ID NO: 82479 - protein, 177 aa, Homo sapiens
  Payload ID: 16411
  Gene Symbol: SNX11
  Gene Name: sorting nexin 11
  ENSP ID: ENSP00000463076
MGFWCRMSENQEQEEVITVRVQDPRVQNEGSWNSYVDYKIFLHTNSKAFTAKTSCVRRRYREFVWLRKQLQRNAGLVPVPELPGKSTFFGTSDEFIEKRRQGLQHFLEKVLQSVVLLSDSQLHLFLQSQLSVPEIEACVQGRSTMTVSDAILRYAMSNCGWAQEERQSSSHLAKGDQ

SEQ ID NO: 82480 - protein, 57 aa, Homo sapiens
  Payload ID: 16411
  Gene Symbol: SNX11
  Gene Name: sorting nexin 11
  ENSP ID: ENSP00000463250
MGFWCRMSENQEQEEVITVRVQDPRVQNEGSWNSYVDYKIFLHMEFCSCCPGWSAVV

SEQ ID NO: 82481 - protein, 254 aa, Homo sapiens
  Payload ID: 16411
  Gene Symbol: SNX11
  Gene Name: sorting nexin 11
  ENSP ID: ENSP00000463726
MGFWCRMSENQEQEEVITVRVQDPRVQNEGSWNSYVDYKIFLHTNSKAFTAKTSCVRRRYREFVWLRKQLQRNAGLVPVPELPGKSTFFGTSDEFIEKRRQGLQHFLEKVLQSVVLLSDSQLHLFLQSQLSVPEIEACVQGRSTMTVSDAILRYAMSNCGWAQEERQSSSHLAKGDQPKSCCFLPRSGRRSSPSPPPSEEKDHLEVWAPVVDSEVPSLESPTLPPLSSPLCCDFGRPKEGTSTLQSVRRAVGGD

SEQ ID NO: 82482 - protein, 262 aa, Homo sapiens; identical to SEQ ID NO: 82478
  Payload ID: 16411
  Gene Symbol: SNX11
  Gene Name: sorting nexin 11
  Uniprot ID: Q9Y5W9
  ENSP ID: ENSP00000463948

SEQ ID NO: 82483 - protein, 172 aa, Homo sapiens
  Payload ID: 16411
  Gene Symbol: SNX11
  Gene Name: sorting nexin 11
  ENSP ID: ENSP00000464136
MGFWCRMSENQEQEEVITVRVQDPRVQNEGSWNSYVDYKIFLHTNSKAFTAKTSCVRRRYREFVWLRKQLQRNAGLVPVPELPGKSTFFGTSDEFIEKRRQGLQHFLEKVLQSVVLLSDSQLHLFLQSQLSVPEIEACVQGRSTMTVSDAILRYAMSNCGWAQEERQSSSHL

SEQ ID NO: 82484 - protein, 46 aa, Homo sapiens
  Payload ID: 16411
  Gene Symbol: SNX11
  Gene Name: sorting nexin 11
  ENSP ID: ENSP00000464410
MGFWCRMSENQEQEEVITVRVQDPRVQNEGSWNSYVDYKIFLHACS

SEQ ID NO: 82485 - protein, 158 aa, Homo sapiens
  Payload ID: 16412
  Gene Symbol: SNX12
  Gene Name: sorting nexin 12
  Uniprot ID: Q9UMY4
  ENSP ID: ENSP00000276105
MSDTAVADTRRLNSKPQDLTDAYGPPSNFLEIDIFNPQTVGVGRARFTTYETNLPIFKLKESCVRRRYSDFEWLKNELERDSKIVVPPLPGKALKRQLPFRGDEGIFEESFIEERRQGLEQFINKIAGHPLAQNERCLHMFLQEEAIDRNYVPGKVRQ

SEQ ID NO: 82486 - protein, 162 aa, Homo sapiens
  Payload ID: 16412
  Gene Symbol: SNX12
  Gene Name: sorting nexin 12
  Uniprot ID: Q9UMY4
  ENSP ID: ENSP00000363392
MSDTAVADTRRLNSKPQDLTDAYGPPSNFLEIDIFNPQTVGVGRARFTTYEVRMRTNLPIFKLKESCVRRRYSDFEWLKNELERDSKIVVPPLPGKALKRQLPFRGDEGIFEESFIEERRQGLEQFINKIAGHPLAQNERCLHMFLQEEAIDRNYVPGKVRQ

SEQ ID NO: 82487 - protein, 162 aa, Homo sapiens; identical to SEQ ID NO: 82486
  Payload ID: 16412
  Gene Symbol: SNX12
  Gene Name: sorting nexin 12
  Uniprot ID: Q9UMY4
  ENSP ID: ENSP00000481314

SEQ ID NO: 82488 - protein, 172 aa, Homo sapiens
  Payload ID: 16412
  Gene Symbol: SNX12
  Gene Name: sorting nexin 12
  ENSP ID: ENSP00000483613
MSDTAVADTRRLNSKPQDLTDAYGPPSNFLEIDIFNPQTVGVGRARFTTYEVRMRTNLPIFKLKESCVRRRYSDFEWLKNELERDSKIVVPPLPGKALKRQLPFRGDEGIFEESFIEERRQGLEQFINKIAGHPLAQNERCLHMFLQEEAIDRNYVPGKSFSQCCPGWSAVA

SEQ ID NO: 82489 - protein, 189 aa, Homo sapiens
  Payload ID: 16413
  Gene Symbol: SNX13
  Gene Name: sorting nexin 13
  ENSP ID: ENSP00000386639
MLTEASLSIWGWGSLGIVLFLITFGPFVIFYLTFYILCFVGGGLVVTLLFGKTNSEKYLEQCEHSFLPPTSPGVPKCLEEMKREARTIKIDRRLTGANIIDEPLQQVIQFSLRDYVQYWYYTLSDDESFLLEIRQTLQNALIQFATRVSPCRPGWSTMAQSRLTATSASWNPVLFNKTLVSLCLLEYVI

SEQ ID NO: 82490 - protein, 154 aa, Homo sapiens
  Payload ID: 16413
  Gene Symbol: SNX13
  Gene Name: sorting nexin 13
  ENSP ID: ENSP00000387053
MLTEASLSIWGWGSLGIVLFLITFGPFVIFYLTFYILCFVGGGLVVTLLFGKTNSEKYLEQCEHSFLPPTSPGVPKCLEEMKREARTIKIDRRLTGANIIDEPLQQVIQFSLRDYVQYWYYTLSDDESFLLEIRQTLQNALIQFATRCWGYSSE

SEQ ID NO: 82491 - protein, 43 aa, Homo sapiens
  Payload ID: 16413
  Gene Symbol: SNX13
  Gene Name: sorting nexin 13
  ENSP ID: ENSP00000397768
MLTEASLSIWGWGSLGIVLFLITFGPFVIFYLTFYILCFVGGA

SEQ ID NO: 82492 - protein, 957 aa, Homo sapiens
  Payload ID: 16413
  Gene Symbol: SNX13
  Gene Name: sorting nexin 13
  Uniprot ID: Q9Y5W8
  ENSP ID: ENSP00000398789
MLTEASLSIWGWGSLGIVLFLITFGPFVIFYLTFYILCFVGGGLVVTLLFGKTNSEKYLEQCEHSFLPPTSPGVPKCLEEMKREARTIKIDRRLTGANIIDEPLQQVIQFSLRDYVQYWYYTLSDDESFLLEIRQTLQNALIQFATRSKEIDWQPYFTTRIVDDFGTHLRVFRKAQQKITEKDDQVKGTAEDLVDTFFEVEVEMEKEVCRDLVCTSPKDEEGFLRDLCEVLLYLLLPPGDFQNKIMRYFVREILARGILLPLINQLSDPDYINQYVIWMIRDSNCNYEAFMNIIKLSDNIGELEAVRDKAAEELQYLRSLDTAGDDINTIKNQINSLLFVKKVCDSRIQRLQSGKEINTVKLAANFGKLCTVPLDSILVDNVALQFFMDYMQQTGGQAHLFFWMTVEGYRVTAQQQLEVLLSRQRDGKHQTNQTKGLLRAAAVGIYEQYLSEKASPRVTVDDYLVAKLADTLNHEDPTPEIFDDIQRKVYELMLRDERFYPSFRQNALYVRMLAELDMLKDPSFRGSDDGDGESFNGSPTGSINLSLDDLSNVSSDDSVQLHAYISDTGVCNDHGKTYALYAITVHRRNLNSEEMWKTYRRYSDFHDFHMRITEQFESLSSILKLPGKKTFNNMDRDFLEKRKKDLNAYLQLLLAPEMMKASPALAHYVYDFLENKAYSKGKGDFARKMDTFVNPLRNSMRNVSNAVKSLPDSLAEGMTKMSDNMGKMSERLGQDIKQSFFKVPPLIPKTDSDPEHRRVSAQLDDNVDDNIPLRVMLLLMDEVFDLKERNQWLRRNIKNLLQQLIRATYGDTINRKIVDHVDWMTSPEQVADSVKRFRDAFWPNGILAEAVPCRDKSIRMRTRVAGKTKLLAIMPDELKHIIGAETTRKGILRVFEMFQHNQLNRRMVYVFLEGFLETLFPQYKFRELFNKLHSRSKQMQKYKQKLQTTQAPSLQKR

SEQ ID NO: 82493 - protein, 888 aa, Homo sapiens
  Payload ID: 16413
  Gene Symbol: SNX13
  Gene Name: sorting nexin 13
  ENSP ID: ENSP00000479044
MLTEASLSIWGWGSLGIVLFLITFGPFVIFYLTFYILCFVGGGLVVTLLFGKTNSEKYLEQCEHSFLPPTSPGVPKCLEEMKREARTIKIDRRLTGANIIDEPLQQVIQFSLRDYVQYWYYTLSDDESFLLEIRQTLQNALIQFATRSKEIDWQPYFTTRIVDDFGTHLRVFRKAQQKITEKDDQVKGTAEDLVDTFFEVEVEMEKEVCRDLVCTSPKDEEGFLRDLCEVLLYLLLPPGDFQNKIMRYFVREILARGILLPLINQLSDPDYINQYVIWMIRDSNCNYEAFMNIIKLSDNIGELEAVRDKAAEELQYLRSLDTAGDDINTIKNQINSLLFVKKVCDSRIQRLQSGKEINTVKLAANFGKLCTVPLDSILVDNVALQFFMDYMQQTGGQAHLFFWMTVEGYRVTAQQQLEVLLSRQRDGKHQTNQTKGLLRAAAVGIYEQYLSEKASPRVTVDDYLVAKLADTLNHEDPTPEIFDDIQRKVYELMLRDERFYPSFRQNALYVRMLAELDMLKDPSFRGSDDGDGESFNGSPTGSINLSLDDLSNVSSDDSVQLHAYISDTVYADYDPYAVAGVCNDHGKTYALYAITVHRRNLNSEEMWKTYRRYSDFHDFHMRITEQFESLSSILKLPGKKTFNNMDRDFLEKRKKDLNAYLQLLLAPEMMKASPALAHYVYDFLENKAYSKGKGDFARKMDTFVNPLRNSMRNVSNAVKSLPDSLAEGMTKMSDNMGKMSERLGQDIKQSFFKVPPLIPKTDSDPEHRRVSAQLDDNVDDNIPLRVMLLLMDEVFDLKERNQWLRRNIKNLLQQLIRATYGDTINRKIVDHVDWMTSPEQVADSVKRFRDAFWPNGILAEAVPCRDKSIRMRTRVAGKTKLLAIMPGE

SEQ ID NO: 82494 - protein, 893 aa, Homo sapiens
  Payload ID: 16414
  Gene Symbol: SNX14
  Gene Name: sorting nexin 14
  Uniprot ID: Q9Y5W7
  ENSP ID: ENSP00000257769
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 82495 - protein, 946 aa, Homo sapiens
  Payload ID: 16414
  Gene Symbol: SNX14
  Gene Name: sorting nexin 14
  Uniprot ID: Q9Y5W7
  ENSP ID: ENSP00000313121
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRGSLSLDDFRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 82496 - protein, 937 aa, Homo sapiens
  Payload ID: 16414
  Gene Symbol: SNX14
  Gene Name: sorting nexin 14
  Uniprot ID: Q9Y5W7
  ENSP ID: ENSP00000358641
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 82497 - protein, 183 aa, Homo sapiens
  Payload ID: 16414
  Gene Symbol: SNX14
  Gene Name: sorting nexin 14
  ENSP ID: ENSP00000358649
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHK

SEQ ID NO: 82498 - protein, 212 aa, Homo sapiens
  Payload ID: 16414
  Gene Symbol: SNX14
  Gene Name: sorting nexin 14
  ENSP ID: ENSP00000391981
DAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVDAIFCENTEPRSLQDKQKGAKQTFEEMMNYIPDLLVKCIGEETKYESIRL

SEQ ID NO: 82499 - protein, 665 aa, Homo sapiens
  Payload ID: 16414
  Gene Symbol: SNX14
  Gene Name: sorting nexin 14
  ENSP ID: ENSP00000420938
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRRKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 82500 - protein, 178 aa, Homo sapiens
  Payload ID: 16414
  Gene Symbol: SNX14
  Gene Name: sorting nexin 14
  ENSP ID: ENSP00000422814
  MOD_RES (1)..(1): Any amino acid
XKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVTEKQ

SEQ ID NO: 82501 - protein, 145 aa, Homo sapiens
  Payload ID: 16414
  Gene Symbol: SNX14
  Gene Name: sorting nexin 14
  ENSP ID: ENSP00000424302
MIFWSFVAGVVTFYCSLGPDSLLPNIFFTIKYKPKQLGLQELFPQGHSCAVCGKVKCKRHRPSLLLENYQPWLDLKISSKVDASLSEVDIPSIITKKLLKAAMKHIEVIVKARQKVKNTEFLQQAALEEYGPELHVALRSRRDEL

SEQ ID NO: 82502 - protein, 236 aa, Homo sapiens
  Payload ID: 16414
  Gene Symbol: SNX14
  Gene Name: sorting nexin 14
  ENSP ID: ENSP00000425387
MVPWVRTMGQKLKQRLRLDVGREICRQYPLFCFLLLCLSAASLLLNRYIHILMIFWSFVAGVVTFYCSLGPDSLLPNIFFTIKYKPKLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSR

SEQ ID NO: 82503 - protein, 833 aa, Homo sapiens
  Payload ID: 16414
  Gene Symbol: SNX14
  Gene Name: sorting nexin 14
  ENSP ID: ENSP00000425630
MKMKTFVIIHFHLIQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQ

SEQ ID NO: 82504 - protein, 91 aa, Homo sapiens
  Payload ID: 16414
  Gene Symbol: SNX14
  Gene Name: sorting nexin 14
  ENSP ID: ENSP00000426806
MIFWSFVAGVVTFYCSLGPDSLLPNIFFTIKYKPKQLGLQELFPQGHSCAVCGKVKCKRHRPSLLLENYQPWLDLKISSKVDASLSEGCDR

SEQ ID NO: 82505 - protein, 894 aa, Homo sapiens
  Payload ID: 16414
  Gene Symbol: SNX14
  Gene Name: sorting nexin 14
  Uniprot ID: Q9Y5W7
  ENSP ID: ENSP00000427380
MIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRGSLSLDDFRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 82506 - protein, 256 aa, Homo sapiens
  Payload ID: 16415
  Gene Symbol: SNX15
  Gene Name: sorting nexin 15
  Uniprot ID: Q9NRS6
  ENSP ID: ENSP00000316410
MSRQAKDDFLRHYTVSDPRTHPKGYTEYKVTAQFISKKDPEDVKEVVVWKRYSDFRKLHGDLAYTHRNLFRRLEEFPAFPRAQVFGRFEASVIEERRKGAEDLLRFTVHIPALNNSPQLKEFFRGGEVTRPLEVSRDLHILPPPLIPTPPPDDPRLSQLLPAERRGLEELEVPVDPPPSSPAQEALDLLFNCESTEEASGSPARGPLTEAELALFDPFSKEGDPLPARQEGVKKKAAEYLKRAEEILRLHLSQLPP

SEQ ID NO: 82507 - protein, 342 aa, Homo sapiens
  Payload ID: 16415
  Gene Symbol: SNX15
  Gene Name: sorting nexin 15
  Uniprot ID: Q9NRS6
  ENSP ID: ENSP00000366452
MSRQAKDDFLRHYTVSDPRTHPKGYTEYKVTAQFISKKDPEDVKEVVVWKRYSDFRKLHGDLAYTHRNLFRRLEEFPAFPRAQVFGRFEASVIEERRKGAEDLLRFTVHIPALNNSPQLKEFFRGGEVTRPLEVSRDLHILPPPLIPTPPPDDPRLSQLLPAERRGLEELEVPVDPPPSSPAQEALDLLFNCESTEEASGSPARGPLTEAELALFDPFSKEEGAAPSPTHVAELATMEVESARLDQEPWEPGGQEEEEDGEGGPTPAYLSQATELITQALRDEKAGAYAAALQGYRDGVHVLLQGVPSDPLPARQEGVKKKAAEYLKRAEEILRLHLSQLPP

SEQ ID NO: 82508 - protein, 192 aa, Homo sapiens
  Payload ID: 16415
  Gene Symbol: SNX15
  Gene Name: sorting nexin 15
  ENSP ID: ENSP00000431690
MSRQAKDDFLRHYTVSDPRTHPKGYTEYKVTAQVVVWKRYSDFRKLHGDLAYTHRNLFRRLEEFPAFPRAQVFGRFEASVIEERRKGAEDLLRFTVHIPALNNSPQLKEFFRGGEVTRPLEVSRDLHILPPPLIPTPPPDDPRLSQLLPAERRGLEELEVPVDPPPSSPAQEALDLLFNCESTEEASGSPAR

SEQ ID NO: 82509 - protein, 114 aa, Homo sapiens
  Payload ID: 16415
  Gene Symbol: SNX15
  Gene Name: sorting nexin 15
  ENSP ID: ENSP00000434778
MSRQAKDDFLRHYTVSDPRTHPKGYTEYKVTAQFISKKDPEDVKEVRLLGGRGTVLQFQIWKLSRGSWWWSGSGTATSASCMETWPTPTATSSAASRSSLLSPGPRCLAGLKPQ

SEQ ID NO: 82510 - protein, 66 aa, Homo sapiens
  Payload ID: 16415
  Gene Symbol: SNX15
  Gene Name: sorting nexin 15
  ENSP ID: ENSP00000436023
MSKRWWSGSGTATSASCMETWPTPTATSSAASRSSLLSPGPRCLGGEVTRPLEVSRDLHILPPPLI

SEQ ID NO: 82511 - protein, 217 aa, Homo sapiens
  Payload ID: 16415
  Gene Symbol: SNX15
  Gene Name: sorting nexin 15
  ENSP ID: ENSP00000437277
MSRQAKDDFLRHYTVSDPRTHPKGYTEYKFISKKDPEDVKEVVVWKRYSDFRKLHGDLAYTHRNLFRRLEEFPAFPRAQVFGRFEASVIEERRKGAEDLLRFTVHIPALNNSPQLKEFFRGGEVTRPLEVSRDLHILPPPLIPTPPPDDPRLSQLLPAERRGLEELEVPVDPPPSSPAQEALDLLFNCESTEEASGSPARGPLTEAELALFDPFSKE

SEQ ID NO: 82512 - protein, 315 aa, Homo sapiens
  Payload ID: 16416
  Gene Symbol: SNX16
  Gene Name: sorting nexin 16
  Uniprot ID: P57768
  ENSP ID: ENSP00000322631
MATPYVPVPMPIGNSASSFTTNRNQRSSSFGSVSTSSNSSKGQLEDSNMGNFKQTSVPDQMDNTSSVCSSPLIRTKFTGTASSIEYSTRPRDTEEQNPETVNWEDRPSTPTILGYEVMEERAKFTLKEMFPGFRLALPPKRWFKDNYNADFLEDRQLGLQAFLQNLVAHKDIANCLAVREFLCLDDPPGPFDSLEESRAFCETLEETNYRLQKELLEKQKEMESLKKLLSEKQLHIDTLENRIRTLSLEPEESLDVSETEGEQILKVESSALEVDQDVLDEESRADNKPCLSFSEPENAVSEIEVAEVAYDAEED

SEQ ID NO: 82513 - protein, 344 aa, Homo sapiens
  Payload ID: 16416
  Gene Symbol: SNX16
  Gene Name: sorting nexin 16
  Uniprot ID: P57768
  ENSP ID: ENSP00000322652
MATPYVPVPMPIGNSASSFTTNRNQRSSSFGSVSTSSNSSKGQLEDSNMGNFKQTSVPDQMDNTSSVCSSPLIRTKFTGTASSIEYSTRPRDTEEQNPETVNWEDRPSTPTILGYEVMEERAKFTVYKILVKKTPEESWVVFRRYTDFSRLNDKLKEMFPGFRLALPPKRWFKDNYNADFLEDRQLGLQAFLQNLVAHKDIANCLAVREFLCLDDPPGPFDSLEESRAFCETLEETNYRLQKELLEKQKEMESLKKLLSEKQLHIDTLENRIRTLSLEPEESLDVSETEGEQILKVESSALEVDQDVLDEESRADNKPCLSFSEPENAVSEIEVAEVAYDAEED

SEQ ID NO: 82514 - protein, 344 aa, Homo sapiens; identical to SEQ ID NO: 82513
  Payload ID: 16416
  Gene Symbol: SNX16
  Gene Name: sorting nexin 16
  Uniprot ID: P57768
  ENSP ID: ENSP00000379621

SEQ ID NO: 82515 - protein, 73 aa, Homo sapiens
  Payload ID: 16416
  Gene Symbol: SNX16
  Gene Name: sorting nexin 16
  ENSP ID: ENSP00000427876
MATPYVPVPMPIGNSASSFTTNRNQRSSSFGSVSTSSNSSKGQLEDSNMGTASSIEYSTRPRDTEEQNPETVN

SEQ ID NO: 82516 - protein, 84 aa, Homo sapiens
  Payload ID: 16416
  Gene Symbol: SNX16
  Gene Name: sorting nexin 16
  ENSP ID: ENSP00000428289
MATPYVPVPMPIGNSASSFTTNRNQRSSSFGSVSTSSNSSKGQLEDSNMGNFKQTSVPDQMDNTSSVCSSPLIRTKFTGTASSI

SEQ ID NO: 82517 - protein, 92 aa, Homo sapiens
  Payload ID: 16416
  Gene Symbol: SNX16
  Gene Name: sorting nexin 16
  ENSP ID: ENSP00000428591
MATPYVPVPMPIGNSASSFTTNRNQRSSSFGSVSTSSNSSKGQLEDSNMGNFKQTSVPDQMDNTSSVCSSPLIRTKFTGTASSIEYSTRPRD

SEQ ID NO: 82518 - protein, 162 aa, Homo sapiens
  Payload ID: 16416
  Gene Symbol: SNX16
  Gene Name: sorting nexin 16
  ENSP ID: ENSP00000428699
MATPYVPVPMPIGNSASSFTTNRNQRSSSFGSVSTSSNSSKGQLEDSNMGNFKQTSVPDQMDNTSSVCSSPLIRTKFTGTASSIEYSTRPRDTEEQNPETVNWEDRPSTPTILGYEVMEERAKFTAFCETLEETNYRLQKELLEKQKEMESLKKLLSEKQLH

SEQ ID NO: 82519 - protein, 203 aa, Homo sapiens
  Payload ID: 16416
  Gene Symbol: SNX16
  Gene Name: sorting nexin 16
  ENSP ID: ENSP00000428734
MATPYVPVPMPIGNSASSFTTNRNQRSSSFGSVSTSSNSSKGQLEDSNMGNFKQTSVPDQMDNTSSVCSSPLIRTKFTGTASSIEYSTRPRDTEEQNPETVNWEDRPSTPTILGYEVMEERAKFTVYKILVKKTPEESWVVFRRYTDFSRLNDKLKEMFPGFRLALPPKRWFKDNYNADFLEDRQLGLQAFLQNLVAHKDIAN

SEQ ID NO: 82520 - protein, 174 aa, Homo sapiens
  Payload ID: 16416
  Gene Symbol: SNX16
  Gene Name: sorting nexin 16
  ENSP ID: ENSP00000430038
MATPYVPVPMPIGNSASSFTTNRNQRSSSFGSVSTSSNSSKGQLEDSNMGTASSIEYSTRPRDTEEQNPETVNWEDRPSTPTILGYEVMEERAKFTVYKILVKKTPEESWVVFRRYTDFSRLNDKLKEMFPGFRLALPPKRWFKDNYNADFLEDRQLGLQAFLQNLVAHKDIAN

SEQ ID NO: 82521 - protein, 36 aa, Homo sapiens
  Payload ID: 16416
  Gene Symbol: SNX16
  Gene Name: sorting nexin 16
  ENSP ID: ENSP00000430585
MATPYVPVPMPIGNSASSFTTNRNQRSSSFGSVSTS

SEQ ID NO: 82522 - protein, 343 aa, Homo sapiens [sequence omitted]

SEQ ID NO: 82523 - protein, 470 aa, Homo sapiens
  Payload ID: 16417
  Gene Symbol: SNX17
  Gene Name: sorting nexin 17
  Uniprot ID: Q15036
  ENSP ID: ENSP00000233575
MHFSIPETESRSGDSGGSAYVAYNIHVNGVLHCRVRYSQLLGLHEQLRKEYGANVLPAFPPKKLFSLTPAEVEQRREQLEKYMQAVRQDPLLGSSETFNSFLRRAQQETQQVPTEEVSLEVLLSNGQKVLVNVLTSDQTEDVLEAVAAKLDLPDDLIGYFSLFLVREKEDGAFSFVRKLQEFELPYVSVTSLRSQEYKIVLRKSYWDSAYDDDVMENRVGLNLLYAQTVSDIERGWILVTKEQHRQLKSLQEKVSKKEFLRLAQTLRHYGYLRFDACVADFPEKDCPVVVSAGNSELSLQLRLPGQQLREGSFRVTRMRCWRVTSSVPLPSGSTSSPGRGRGEVRLELAFEYLMSKDRLQWVTITSPQAIMMSICLQSMVDELMVKKSGGSIRKMLRRRVGGTLRRSDSQQAVKSPPLLESPDATRESMVKLSSKLSAVSLRGIGSPSTDASASDVHGNFAFEGIGDEDL

SEQ ID NO: 82524 - protein, 53 aa, Homo sapiens
  Payload ID: 16417
  Gene Symbol: SNX17
  Gene Name: sorting nexin 17
  ENSP ID: ENSP00000399727
MHFSIPETESRSGDSGGSAYVAYNIHVNGVLHCRVRYSQLLGLHEQVGLAPLP

SEQ ID NO: 82525 - protein, 69 aa, Homo sapiens
  Payload ID: 16417
  Gene Symbol: SNX17
  Gene Name: sorting nexin 17
  ENSP ID: ENSP00000401922
MHFSIPETESRSGDSGGSAYVFGKTHCLGAARLSTVSCVGHNRRHSRSPQRKCPWKCCSATGRKFWSTC

SEQ ID NO: 82526 - protein, 87 aa, Homo sapiens
  Payload ID: 16417
  Gene Symbol: SNX17
  Gene Name: sorting nexin 17
  ENSP ID: ENSP00000405399
MHFSIPETESRSGDSGGSAYVAYNIHVNGVLHCRVRYSQLLGLHEQLRKEYGANVLPAFPPKKLFSLTPAEVEQRREQLEKYMQAVL

SEQ ID NO: 82527 - protein, 445 aa, Homo sapiens
  Payload ID: 16417
  Gene Symbol: SNX17
  Gene Name: sorting nexin 17
  Uniprot ID: Q15036
  ENSP ID: ENSP00000439208
MHFSIPETESRSGDSGGSAYVLRKEYGANVLPAFPPKKLFSLTPAEVEQRREQLEKYMQAVRQDPLLGSSETFNSFLRRAQQETQQVPTEEVSLEVLLSNGQKVLVNVLTSDQTEDVLEAVAAKLDLPDDLIGYFSLFLVREKEDGAFSFVRKLQEFELPYVSVTSLRSQEYKIVLRKSYWDSAYDDDVMENRVGLNLLYAQTVSDIERGWILVTKEQHRQLKSLQEKVSKKEFLRLAQTLRHYGYLRFDACVADFPEKDCPVVVSAGNSELSLQLRLPGQQLREGSFRVTRMRCWRVTSSVPLPSGSTSSPGRGRGEVRLELAFEYLMSKDRLQWVTITSPQAIMMSICLQSMVDELMVKKSGGSIRKMLRRRVGGTLRRSDSQQAVKSPPLLESPDATRESMVKLSSKLSAVSLRGIGSPSTDASASDVHGNFAFEGIGDEDL

SEQ ID NO: 82528 - protein, 628 aa, Homo sapiens
  Payload ID: 16418
  Gene Symbol: SNX18
  Gene Name: sorting nexin 18
  Uniprot ID: Q96RF0
  ENSP ID: ENSP00000317332
MALRARALYDFRSENPGEISLREHEVLSLCSEQDIEGWLEGVNSRGDRGLFPASYVQVIRAPEPGPAGDGGPGAPARYANVPPGGFEPLPVAPPASFKPPPDAFQALLQPQQAPPPSTFQPPGAGFPYGGGALQPSPQQLYGGYQASQGSDDDWDDEWDDSSTVADEPGALGSGAYPDLDGSSSAGVGAAGRYRLSTRSDLSLGSRGGSVPPQHHPSGPKSSATVSRNLNRFSTFVKSGGEAFVLGEASGFVKDGDKLCVVLGPYGPEWQENPYPFQCTIDDPTKQTKFKGMKSYISYKLVPTHTQVPVHRRYKHFDWLYARLAEKFPVISVPHLPEKQATGRFEEDFISKRRKGLIWWMNHMASHPVLAQCDVFQHFLTCPSSTDEKAWKQGKRKAEKDEMVGANFFLTLSTPPAAALDLQEVESKIDGFKCFTKKMDDSALQLNHTANEFARKQVTGFKKEYQKVGQSFRGLSQAFELDQQAFSVGLNQAIAFTGDAYDAIGELFAEQPRQDLDPVMDLLALYQGHLANFPDIIHVQKGKAWPLEQVIWSVLCRLKGATLTAVPLWVSESYSTGEEASRDVDAWVFSLECKLDCSTGSFLLEYLALGNEYSFSKVQRVPLMTVLSF

SEQ ID NO: 82529 - protein, 591 aa, Homo sapiens
  Payload ID: 16418
  Gene Symbol: SNX18
  Gene Name: sorting nexin 18
  Uniprot ID: Q96RF0
  ENSP ID: ENSP00000342276
MALRARALYDFRSENPGEISLREHEVLSLCSEQDIEGWLEGVNSRGDRGLFPASYVQVIRAPEPGPAGDGGPGAPARYANVPPGGFEPLPVAPPASFKPPPDAFQALLQPQQAPPPSTFQPPGAGFPYGGGALQPSPQQLYGGYQASQGSDDDWDDEWDDSSTVADEPGALGSGAYPDLDGSSSAGVGAAGRYRLSTRSDLSLGSRGGSVPPQHHPSGPKSSATVSRNLNRFSTFVKSGGEAFVLGEASGFVKDGDKLCVVLGPYGPEWQENPYPFQCTIDDPTKQTKFKGMKSYISYKLVPTHTQVPVHRRYKHFDWLYARLAEKFPVISVPHLPEKQATGRFEEDFISKRRKGLIWWMNHMASHPVLAQCDVFQHFLTCPSSTDEKAWKQGKRKAEKDEMVGANFFLTLSTPPAAALDLQEVESKIDGFKCFTKKMDDSALQLNHTANEFARKQVTGFKKEYQKVGQSFRGLSQAFELDQQAFSVGLNQAIAFTGDAYDAIGELFAEQPRQDLDPVMDLLALYQGHLANFPDIIHVQKGKAWPLEQVIWSVLCRLKGATLTAVPLWVSESYSTGEEASRDVDAWVFSLE

SEQ ID NO: 82530 - protein, 624 aa, Homo sapiens
  Payload ID: 16418
  Gene Symbol: SNX18
  Gene Name: sorting nexin 18
  Uniprot ID: Q96RF0
  ENSP ID: ENSP00000370817
MALRARALYDFRSENPGEISLREHEVLSLCSEQDIEGWLEGVNSRGDRGLFPASYVQVIRAPEPGPAGDGGPGAPARYANVPPGGFEPLPVAPPASFKPPPDAFQALLQPQQAPPPSTFQPPGAGFPYGGGALQPSPQQLYGGYQASQGSDDDWDDEWDDSSTVADEPGALGSGAYPDLDGSSSAGVGAAGRYRLSTRSDLSLGSRGGSVPPQHHPSGPKSSATVSRNLNRFSTFVKSGGEAFVLGEASGFVKDGDKLCVVLGPYGPEWQENPYPFQCTIDDPTKQTKFKGMKSYISYKLVPTHTQVPVHRRYKHFDWLYARLAEKFPVISVPHLPEKQATGRFEEDFISKRRKGLIWWMNHMASHPVLAQCDVFQHFLTCPSSTDEKAWKQGKRKAEKDEMVGANFFLTLSTPPAAALDLQEVESKIDGFKCFTKKMDDSALQLNHTANEFARKQVTGFKKEYQKVGQSFRGLSQAFELDQQAFSVGLNQAIAFTGDAYDAIGELFAEQPRQDLDPVMDLLALYQGHLANFPDIIHVQKGALTKVKESRRHVEEGKMEVQKADGIQDRCNTISFATLAEIHHFHQIRVRDFKSQMQHFLQQQIIFFQKVTQKLEEALHKYDSV

SEQ ID NO: 82531 - protein, 992 aa, Homo sapiens
  Payload ID: 16419
  Gene Symbol: SNX19
  Gene Name: sorting nexin 19
  Uniprot ID: Q92543
  ENSP ID: ENSP00000265909
MKTETVPPFQETPAGSSCHLNNLLSSRKLMAVGVLLGWLLVIHLLVNVWLLCLLSALLVVLGGWLGSSLAGVASGRLHLERFIPLATCPPCPEAERQLEREINRTIQMIIRDFVLSWYRSVSQEPAFEEEMEAAMKGLVQELRRRMSVMDSHAVAQSVLTLCGCHLQSYIQAKEATAGKNGPVEPSHLWEAYCRATAPHPAVHSPSAEVTYTRGVVNLLLQGLVPKPHLETRTGRHVVVELITCNVILPLISRLSDPDWIHLVLVGIFSKARDPAPCPASAPEQPSVPTSLPLIAEVEQLPEGRASPVAAPVFLSYSEPEGSAGPSPEVEEGHEAVEGDLGGMCEERKVGNNSSHFLQPNVRGPLFLCEDSELESPLSELGKETIMLMTPGSFLSDRIQDALCALESSQALEPKDGEASEGAEAEEGPGTETETGLPVSTLNSCPEIHIDTADKEIEQGDVTASVTALLEGPEKTCPSRPSCLEKDLTNDVSSLDPTLPPVLLSSSPPGPLSSATFSFEPLSSPDGPVIIQNLRITGTITAREHSGTGFHPYTLYTVKYETALDGENSSGLQQLAYHTVNRRYREFLNLQTRLEEKPDLRKFIKNVKGPKKLFPDLPLGNMDSDRVEARKSLLESFLKQLCAIPEIANSEEVQEFLALNTDARIAFVKKPFMVSRIDKMVVSAIVDTLKTAFPRSEPQSPTEELSEAETESKPQTEGKKASKSRLRFSSSKISPALSVTEAQDKILYCLQEGNVESETLSMSAMESFIEKQTKLLEMQPTKAPEKDPEQPPKGRVDSCVSDAAVPAQDPSNSDPGTETELADTALDLLLLLLTEQWKWLCTENMQKFLRLIFGTLVQRWLEVQVANLTSPQRWVQYLLLLQESIWPGGVLPKFPRPVRTQEQKLAAEKQALQSLMGVLPDLVVEILGVNKCRLSWGLVLESLQQPLINRHLIYCLGDIILEFLDLSASVEESAATTSASDTPGNSKRMGVSS

SEQ ID NO: 82532 - protein, 160 aa, Homo sapiens
  Payload ID: 16419
  Gene Symbol: SNX19
  Gene Name: sorting nexin 19
  ENSP ID: ENSP00000413345
MLAPKDFSERIQPSWEGGWCANAASRWLEVQVANLTSPQRWVQYLLLLQESIWPGGVLPKFPRPVRTQEQKLAAEKQALQSLMGVLPDLVVEILGVNKCRLSWGLVLESLQQPLINRHLIYCLGDIILEFLDLSASVEESAATTSASDTPGNSKRMGVSS

SEQ ID NO: 82533 - protein, 372 aa, Homo sapiens
  Payload ID: 16419
  Gene Symbol: SNX19
  Gene Name: sorting nexin 19
  ENSP ID: ENSP00000432307
MDSDRVEARKSLLESFLKQLCAIPEIANSEEVQEFLALNTDARIAFVKKPFMVSRIDKMVVSAIVDTLKTAFPRSEPQSPTEELSEAETESKPQTEGKKASKSRLRFSSSKISPALSVTEAQDKILYCLQEGNVESETLSMSAMESFIEKQTKLLEMQPTKAPEKDPEQPPKGRVDSCVSDAAVPAQDPSNSDPGTETELADTALDLLLLLLTEQWKWLCTENMQKFLRLIFGTLVQRWLEVQVANLTSPQRWVQYLLLLQESIWPGGVLPKFPRPVRTQEQKLAAEKQALQSLMGVLPDLVVEILGVNKCRLSWGLVLESLQQPLINRHLIYCLGDIILEFLDLSASVEESAATTSASDTPGNSKRMGVSS

SEQ ID NO: 82534 - protein, 232 aa, Homo sapiens
  Payload ID: 16419
  Gene Symbol: SNX19
  Gene Name: sorting nexin 19
  ENSP ID: ENSP00000433699
MSAMESFIEKQTKLLEMQPTKAPEKDPEQPPKGRVDSCVSDAAVPAQDPSNSDPGTETELADTALDLLLLLLTEQWKWLCTENMQKFLRLIFGTLVQRWLEVQVANLTSPQRWVQYLLLLQESIWPGGVLPKFPRPVRTQEQKLAAEKQALQSLMGVLPDLVVEILGVNKCRLSWGLVLESLQQPLINRHLIYCLGDIILEFLDLSASVEESAATTSASDTPGNSKRMGVSS

SEQ ID NO: 82535 - protein, 372 aa, Homo sapiens; identical to SEQ ID NO: 82533
  Payload ID: 16419
  Gene Symbol: SNX19
  Gene Name: sorting nexin 19
  ENSP ID: ENSP00000435122

SEQ ID NO: 82536 - protein, 803 aa, Homo sapiens
  Payload ID: 16419
  Gene Symbol: SNX19
  Gene Name: sorting nexin 19
  Uniprot ID: Q92543
  ENSP ID: ENSP00000435390
MKTETVPPFQETPAGSSCHLNNLLSSRKLMAVGVLLGWLLVIHLLVNVWLLCLLSALLVVLGGWLGSSLAGVASGRLHLERFIPLATCPPCPEAERQLEREINRTIQMIIRDFVLSWYRSVSQEPAFEEEMEAAMKGLVQELRRRMSVMDSHAVAQSVLTLCGCHLQSYIQAKEATAGKNGPVEPSHLWEAYCRATAPHPAVHSPSAEVTYTRGVVNLLLQGLVPKPHLETRTGRHVVVELITCNVILPLISRLSDPDWIHLVLVGIFSKARDPAPCPASAPEQPSVPTSLPLIAEVEQLPEGRASPVAAPVFLSYSEPEGSAGPSPEVEEGHEAVEGDLGGMCEERKVGNNSSHFLQPNVRGPLFLCEDSELESPLSELGKETIMLMTPGSFLSDRIQDALCALESSQALEPKDGEASEGAEAEEGPGTETETGLPVSTLNSCPEIHIDTADKEIEQGDVTASVTALLEGPEKTCPSRPSCLEKDLTNDVSSLDPTLPPVLLSSSPPGPLSSATFSFEPLSSPDGPVIIQNLRITGTITAREHSGTGFHPYTLYTVKYETALDGENSSGLQQLAYHTVNRRYREFLNLQTRLEEKPDLRKFIKNVKGPKKLFPDLPLGNMDSDRVEARKSLLESFLKQLCAIPEIANSEEVQEFLALNTDARIAFVKKPFMVSRIDKMVVSAIVDTLKTAFPRSEPQSPTEELSEAETESKPQTEGKKASKSRLRFSSSKISPALSVTEAQDKILYCLQEGNVTKLLEMQPTKAPEKDPEQPPKGRVDSCVSDAAVPAQDPSNSDPAEHAMC

SEQ ID NO: 82537 - protein, 519 aa, Homo sapiens
  Payload ID: 16420
  Gene Symbol: SNX2
  Gene Name: sorting nexin 2
  Uniprot ID: O60749
  ENSP ID: ENSP00000368831
MAAEREPPPLGDGKPTDFEDLEDGEDLFTSTVSTLESSPSSPEPASLPAEDISANSNGPKPTEVVLDDDREDLFAEATEEVSLDSPEREPILSSEPSPAVTPVTPTTLIAPRIESKSMSAPVIFDRSREEIEEEANGDIFDIEIGVSDPEKVGDGMNAYMAYRVTTKTSLSMFSKSEFSVKRRFSDFLGLHSKLASKYLHVGYIVPPAPEKSIVGMTKVKVGKEDSSSTEFVEKRRAALERYLQRTVKHPTLLQDPDLRQFLESSELPRAVNTQALSGAGILRMVNKAADAVNKMTIKMNESDAWFEEKQQQFENLDQQLRKLHVSVEALVCHRKELSANTAAFAKSAAMLGNSEDHTALSRALSQLAEVEEKIDQLHQEQAFADFYMFSELLSDYIRLIAAVKGVFDHRMKCWQKWEDAQITLLKKREAEAKMMVANKPDKIQQAKNEIREWEAKVQQGERDFEQISKTIRKEVGRFEKERVKDFKTVIIKYLESLVQTQQQLIKYWEAFLPEAKAIA

SEQ ID NO: 82538 - protein, 402 aa, Homo sapiens
  Payload ID: 16420
  Gene Symbol: SNX2
  Gene Name: sorting nexin 2
  Uniprot ID: O60749
  ENSP ID: ENSP00000421663
MSAPVIFDRSREEIEEEANGDIFDIEIGVSDPEKVGDGMNAYMAYRVTTKTSLSMFSKSEFSVKRRFSDFLGLHSKLASKYLHVGYIVPPAPEKSIVGMTKVKVGKEDSSSTEFVEKRRAALERYLQRTVKHPTLLQDPDLRQFLESSELPRAVNTQALSGAGILRMVNKAADAVNKMTIKMNESDAWFEEKQQQFENLDQQLRKLHVSVEALVCHRKELSANTAAFAKSAAMLGNSEDHTALSRALSQLAEVEEKIDQLHQEQAFADFYMFSELLSDYIRLIAAVKGVFDHRMKCWQKWEDAQITLLKKREAEAKMMVANKPDKIQQAKNEIREWEAKVQQGERDFEQISKTIRKEVGRFEKERVKDFKTVIIKYLESLVQTQQQLIKYWEAFLPEAKAIA

SEQ ID NO: 82539 - protein, 265 aa, Homo sapiens
  Payload ID: 16420
  Gene Symbol: SNX2
  Gene Name: sorting nexin 2
  ENSP ID: ENSP00000422413
MAAEREPPPLGDGKPTDFEDLEDGEDLFTSTVSTLESSPSSPEPASLPAEDISANSNGPKPTEVVLDDDREDLFAATEEVSLDSPEREPILSSEPSPAVTPVTPTTLIAPRIESKSMSAPVIFDRSREEIEEEANGDIFDIEIGVSDPEKVGDGMNAYMAYRVTTKTSLSMFSKSEFSVKRRFSDFLGLHSKLASKYLHVGYIVPPAPEKSIVGMTKVKVGKEDSSSTEFVEKRRAALERYLQRTVKHPTLLQDPDLRQFLESSE

SEQ ID NO: 82540 - protein, 76 aa, Homo sapiens
  Payload ID: 16420
  Gene Symbol: SNX2
  Gene Name: sorting nexin 2
  ENSP ID: ENSP00000422560
MAAEREPPPLGDGKPTDFEDLEDGEDLFTSTVSTLESSPSSPEPASLPAEDISANSNGPKPTEVVLDDDREDLFAD

SEQ ID NO: 82541 - protein, 129 aa, Homo sapiens
  Payload ID: 16421
  Gene Symbol: SNX20
  Gene Name: sorting nexin 20
  Uniprot ID: Q7Z614
  ENSP ID: ENSP00000300590
MASPEHPGSPGCMGPITQCTARTQQEAPATGPDLPHPGPDGHLDTHSGLSSNSSMTTRELQQYWQNQKCRWKHVKLLFEIASARIEERKVSKFVMGKSRPGEMTYPGSRGETGTAPEPDPRCPRQSDML

SEQ ID NO: 82542 - protein, 316 aa, Homo sapiens
  Payload ID: 16421
  Gene Symbol: SNX20
  Gene Name: sorting nexin 20
  Uniprot ID: Q7Z614
  ENSP ID: ENSP00000332062
MASPEHPGSPGCMGPITQCTARTQQEAPATGPDLPHPGPDGHLDTHSGLSSNSSMTTRELQQYWQNQKCRWKHVKLLFEIASARIEERKVSKFVVYQIIVIQTGSFDNNKAVLERRYSDFAKLQKALLKTFREEIEDVEFPRKHLTGNFAEEMICERRRALQEYLGLLYAIRCVRRSREFLDFLTRPELREAFGCLRAGQYPRALELLLRVLPLQEKLTAHCPAAAVPALCAVLLCHRDLDRPAEAFAAGERALQRLQAREGHRYYAPLLDAMVRLAYALGKDFVTLQERLEESQLRRPTPRGITLKELTVREYLH

SEQ ID NO: 82543 - protein, 102 aa, Homo sapiens
  Payload ID: 16421
  Gene Symbol: SNX20
  Gene Name: sorting nexin 20
  Uniprot ID: Q7Z614
  ENSP ID: ENSP00000388875
MASPEHPGSPGCMGPITQCTARTQQEAPATGPDLPHPGPDGHLDTHSGLSSNSSMTTRELQQYWQNQKCRWKHVKLLFEIASARIEERKVSKFVAPAPDATP

SEQ ID NO: 82544 - protein, 129 aa, Homo sapiens; identical to SEQ ID NO: 82541
  Payload ID: 16421
  Gene Symbol: SNX20
  Gene Name: sorting nexin 20
  Uniprot ID: Q7Z614
  ENSP ID: ENSP00000454863

SEQ ID NO: 82545 - protein, 152 aa, Homo sapiens [sequence omitted]

SEQ ID NO: 82546 - protein, 193 aa, Homo sapiens
  Payload ID: 16422
  Gene Symbol: SNX22
  Gene Name: sorting nexin 22
  Uniprot ID: Q96L94
  ENSP ID: ENSP00000323435
MLEVHIPSVGPEAEGPRQSPEKSHMVFRVEVLCSGRRHTVPRRYSEFHALHKRIKKLYKVPDFPSKRLPNWRTRGLEQRRQGLEAYIQGILYLNQEVPKELLEFLRLRHFPTDPKASNWGTLREFLPGDSSSQQHQRPVLSFHVDPYVCNPSPESLPNVVVNGVLQGLYSFSISPDKAQPKAACHPAPLPPMP

SEQ ID NO: 82547 - protein, 120 aa, Homo sapiens
  Payload ID: 16422
  Gene Symbol: SNX22
  Gene Name: sorting nexin 22
  Uniprot ID: Q96L94
  ENSP ID: ENSP00000452692
MLEVHIPSVGPEAEGPRQSPEKSHMVFRVEVLCSGRRHTVPRRYSEFHALHKRIKKLYKVPDFPSKRLPNWRTRGLEQRRQGLEAYIQGILYLNQEVPKELLEFLRLRHFPTDPKASNWG

SEQ ID NO: 82548 - protein, 169 aa, Homo sapiens
  Payload ID: 16423
  Gene Symbol: SNX24
  Gene Name: sorting nexin 24
  Uniprot ID: Q9Y343
  ENSP ID: ENSP00000261369
MEVYIPSFRYEESDLERGYTVFKIEVLMNGRKHFVEKRYSEFHALHKKLKKCIKTPEIPSKHVRNWVPKVLEQRRQGLETYLQAVILENEELPKLFLDFLNVRHLPSLPKAESCGSFDETESEESSKLSHQPVLLFLRDPYVLPAASDFPNVVIEGVLHGIFYPHLQPR

SEQ ID NO: 82549 - protein, 202 aa, Homo sapiens
  Payload ID: 16423
  Gene Symbol: SNX24
  Gene Name: sorting nexin 24
  ENSP ID: ENSP00000378837
MEVYIPSFRYEESDLERGYTVVIVWHRAFQTKMESYEVIVLEIAFSNGRLTYQVFKIEVLMNGRKHFVEKRYSEFHALHKKLKKCIKTPEIPSKHVRNWVPKVLEQRRQGLETYLQAVILENEELPKLFLDFLNVRHLPSLPKAESCGSFDETESEESSKLSHQPVLLFLRDPYVLPAASDFPNVVIEGVLHGIFYPHLQPR

SEQ ID NO: 82550 - protein, 22 aa, Homo sapiens
  Payload ID: 16423
  Gene Symbol: SNX24
  Gene Name: sorting nexin 24
  ENSP ID: ENSP00000422184
  MOD_RES (1)..(1): Any amino acid
XEESDLERGYTVRVLQCCPGRP

SEQ ID NO: 82551 - protein, 159 aa, Homo sapiens
  Payload ID: 16423
  Gene Symbol: SNX24
  Gene Name: sorting nexin 24
  Uniprot ID: Q9Y343
  ENSP ID: ENSP00000422535
MEVYIPSFRYEESDLERGYTVFKIEVLMNGRKHFVEKRYSEFHALHKKLKKCIKTPEIPSKHVRNWVPKVLEQRRQGLETYLQAVILENEELPKLFLDFLNVRHLPSLPKAESCGSFDETESEESSKLSHQPVLLFLRDPYVLPAASGNQTCHLLTALY

SEQ ID NO: 82552 - protein, 159 aa, Homo sapiens; identical to SEQ ID NO: 82551
  Payload ID: 16423
  Gene Symbol: SNX24
  Gene Name: sorting nexin 24
  Uniprot ID: Q9Y343
  ENSP ID: ENSP00000424149

SEQ ID NO: 82553 - protein, 68 aa, Homo sapiens
  Payload ID: 16423
  Gene Symbol: SNX24
  Gene Name: sorting nexin 24
  ENSP ID: ENSP00000425919
VFKIEVLMNGRKHFVEKRYSEFHALHKKLKKCIKTPEIPSKHVRNWVPKVLEQRRQGLETYLQRNVGA

SEQ ID NO: 82554 - protein, 840 aa, Homo sapiens
  Payload ID: 16424
  Gene Symbol: SNX25
  Gene Name: sorting nexin 25
  Uniprot ID: Q9H3E2
  ENSP ID: ENSP00000264694
MDKALKEVFDYSYRDYILSWYGNLSRDEGQLYHLLLEDFWEIARQLHHRLSHVDVVKVVCNDVVRTLLTHFCDLKAANARHEEQPRPFVLHACLRNSDDEVRFLQTCSRVLVFCLLPSKDVQSLSLRIMLAEILTTKVLKPVVELLSNPDYINQMLLAQLAYREQMNEHHKRAYTYAPSYEDFIKLINSNSDVEFLKQLRYQIVVEIIQATTISSFPQLKRHKGKETAAMKADLLRARNMKRYINQLTVAKKQCEKRIRILGGPAYDQQEDGALDEGEGPQSQKILQFEDILANTFYREHFGMYMERMDKRALISFWESVEHLKNANKNEIPQLVGEIYQNFFVESKEISVEKSLYKEIQQCLVGNKGIEVFYKIQEDVYETLKDRYYPSFIVSDLYEKLLIKEEEKHASQMISNKDEMGPRDEAGEEAVDDGTNQINEQASFAVNKLRELNEKLEYKRQALNSIQNAPKPDKKIVSKLKDEIILIEKERTDLQLHMARTDWWCENLGMWKASITSGEVTEENGEQLPCYFVMVSLQEVGGVETKNWTVPRRLSEFQNLHRKLSECVPSLKKVQLPSLSKLPFKSIDQKFMEKSKNQLNKFLQNLLSDERLCQSEALYAFLSPSPDYLKVIDVQGKKNSFSLSSFLERLPRDFFSHQEEETEEDSDLSDYGDDVDGRKDALAEPCFMLIGEIFELRGMFKWVRRTLIALVQVTFGRTINKQIRDTVSWIFSEQMLVYYINIFRDAFWPNGKLAPPTTIRSKEQSQETKQRAQQKLLENIPDMLQSLVGQQNARHGIIKIFNALQETRANKHLLYALMELLLIELCPELRVHLDQLKAGQV

SEQ ID NO: 82555 - protein, 142 aa, Homo sapiens
  Payload ID: 16424
  Gene Symbol: SNX25
  Gene Name: sorting nexin 25
  ENSP ID: ENSP00000424826
  MOD_RES (1)..(1): Any amino acid
XLKNANKNEIPQLVGEIYQNFFVESKEISVEKSLYKEIQQCLVGNKGIEVFYKIQEDVYETLKDRYYPSFIVSDLYEKLLIKEEEKHASQMISNKDEMGPRDEAGEEAVDDGTNQINEQASFAVNKLRELNEKLEYKRLFPS

SEQ ID NO: 82556 - protein, 840 aa, Homo sapiens; identical to SEQ ID NO: 82554
  Payload ID: 16424
  Gene Symbol: SNX25
  Gene Name: sorting nexin 25
  Uniprot ID: Q9H3E2
  ENSP ID: ENSP00000426255

SEQ ID NO: 82557 - protein, 556 aa, Homo sapiens
  Payload ID: 16424
  Gene Symbol: SNX25
  Gene Name: sorting nexin 25
  Uniprot ID: Q9H3E2
  ENSP ID: ENSP00000483653
MKADLLRARNMKRYINQLTVAKKQCEKRIRILGGPAYDQQEDGALDEGEGPQSQKILQFEDILANTFYREHFGMYMERMDKRALISFWESVEHLKNANKNEIPQLVGEIYQNFFVESKEISVEKSLYKEIQQCLVGNKGIEVFYKIQEDVYETLKDRYYPSFIVSDLYEKLLIKEEEKHASQMISNKDEMGPRDEAGEEAVDDGTNQINEQASFAVNKLRELNEKLEYKRQALNSIQNAPKPDKKIVSKLKDEIILIEKERTDLQLHMARTDWWCENLGMWKASITSGEVTEENGEQLPCYFVMVSLQEVGGVETKNWTVPRRLSEFQNLHRKLSECVPSLKKVQLPSLSKLPFKSIDQKFMEKSKNQLNKFLQEETEEDSDLSDYGDDVDGRKDALAEPCFMLIGEIFELRGMFKWVRRTLIALVQVTFGRTINKQIRDTVSWIFSEQMLVYYINIFRDAFWPNGKLAPPTTIRSKEQSQETKQRAQQKLLENIPDMLQSLVGQQNARHGIIKIFNALQETRANKHLLYALMELLLIELCPELRVHLDQLKAGQV

SEQ ID NO: 82558 - protein, 69 aa, Homo sapiens
  Payload ID: 16425
  Gene Symbol: SNX29
  Gene Name: sorting nexin 29
  ENSP ID: ENSP00000455327
QELIDLRGPVPGDLSQTSEDQSLSDFEISNRALINVWIPSVFLRGKAANAFHVYQLFKNVKIILSLWAV

SEQ ID NO: 82559 - protein, 175 aa, Homo sapiens
  Payload ID: 16425
  Gene Symbol: SNX29
  Gene Name: sorting nexin 29
  ENSP ID: ENSP00000455747
  MOD_RES (1)..(1): Any amino acid
XGHSESPEKPLEGNTCLSQMHSWAPLKVLHNDSDILFPVSGVGSYSPADAPLGSLENGTGPEDHVLPDPGLRYSVEASSPGHGSPLSSLLPSASVPESMTISELRQATVAMMNRKDELEEENRSLRNLLDGEMEHSAALRQEVDTLKRKVAEQEERQGMKVQALASYLCYFVRRF

SEQ ID NO: 82560 - protein, 813 aa, Homo sapiens
  Payload ID: 16425
  Gene Symbol: SNX29
  Gene Name: sorting nexin 29
  Uniprot ID: Q8TEQ0
  ENSP ID: ENSP00000456480
MSGSQNNDKRQFLLERLLDAVKQCQIRFGGRKEIASDSDSRVTCLCAQFEAVLQHGLKRSRGLALTAAAIKQAAGFASKTETEPVFWYYVKEVLNKHELQRFYSLRHIASDVGRGRAWLRCALNEHSLERYLHMLLADRCRLSTFYEDWSFVMDEERSSMLPTMAAGLNSILFAINIDNKDLNGQSKFAPTVSDLLKESTQNVTSLLKESTQGVSSLFREITASSAVSILIKPEQETDPLPVVSRNVSADAKCKKERKKKKKVTNIISFDDEEDEQNSGDVFKKTPGAGESSEDNSDRSSVNIMSAFESPFGPNSNGSQSSNSWKIDSLSLNGEFGYQKLDVKSIDDEDVDENEDDVYGNSSGRKHRGHSESPEKPLEGNTCLSQMHSWAPLKVLHNDSDILFPVSGVGSYSPADAPLGSLENGTGPEDHVLPDPGLRYSVEASSPGHGSPLSSLLPSASVPESMTISELRQATVAMMNRKDELEEENRSLRNLLDGEMEHSAALRQEVDTLKRKVAEQEERQGMKVQALARENEVLKVQLKKYVGAVQMLKREGQTAEVPNLWSVDGEVTVAEQKPGEIAEELASSYERKLIEVAEMHGELIEFNERLHRALVAKEALVSQMRQELIDLRGPVPGDLSQTSEDQSLSDFEISNRALINVWIPSVFLRGKAANAFHVYQVYIRIKDDEWNIYRRYTEFRSLHHKLQNKYPQVRAYNFPPKKAIGNKDAKFVEERRKQLQNYLRSVMNKVIQMVPEFAASPKKETLIQLMPFFVDITPPGEPVNSRPKAASRFPKLSRGQPRETRNVEPQSGDL

SEQ ID NO: 82561 - protein, 282 aa, Homo sapiens
  Payload ID: 16425
  Gene Symbol: SNX29
  Gene Name: sorting nexin 29
  ENSP ID: ENSP00000457017
LKRKVAEQEERQGMKVQALARENEVLKVQLKKYVGAVQMLKREGQTAEVPNLWSVDGEVTVAEQKPGEIAEELASSYERKLIEVAEMHGELIEFNERLHRALVAKEALVSQMRQELIDLRGPVPGDLSQTSEDQSLSDFEISNRALINVWIPSVFLRGKAANAFHVYQVYIRIKDDEWNIYRRYTEFRSLHHKLQNKYPQVRAYNFPPKKAIGNKDAKFVEERRKQLQNYLRSVMNKVIQMVPEFAASPKKETLIQLMPFFVDWISLFGNGRDSSREEFSSS

SEQ ID NO: 82562 - protein, 96 aa, Homo sapiens
  Payload ID: 16425
  Gene Symbol: SNX29
  Gene Name: sorting nexin 29
  ENSP ID: ENSP00000457085
MSGSQNNDKRQFLLERLLDAVKQCQIRFGGRKEIASDSDSRVTCLCAQFEAVLQHGLKRSRGLALTAAAIKQAAGFASKTETDGASLCCPVWSAVA

SEQ ID NO: 82563 - protein, 162 aa, Homo sapiens
  Payload ID: 16426
  Gene Symbol: SNX3
  Gene Name: sorting nexin 3
  Uniprot ID: O60493
  ENSP ID: ENSP00000230085
MAETVADTRRLITKPQNLNDAYGPPSNFLEIDVSNPQTVGVGRGRFTTYEIRVKTNLPIFKLKESTVRRRYSDFEWLRSELERESKVVVPPLPGKAFLRQLPFRGDDGIFDDNFIEERKQGLEQFINKVAGHPLAQNERCLHMFLQDEIIDKSYTPSKIRHA

SEQ ID NO: 82564 - protein, 140 aa, Homo sapiens
  Payload ID: 16426
  Gene Symbol: SNX3
  Gene Name: sorting nexin 3
  Uniprot ID: O60493
  ENSP ID: ENSP00000296991
MAETVADTRRLITKPQNLNDAYGPPSNFLEIDTNLPIFKLKESTVRRRYSDFEWLRSELERESKVVVPPLPGKAFLRQLPFRGDDGIFDDNFIEERKQGLEQFINKVAGHPLAQNERCLHMFLQDEIIDKSYTPSKIRHA

SEQ ID NO: 82565 - protein, 113 aa, Homo sapiens
  Payload ID: 16426
  Gene Symbol: SNX3
  Gene Name: sorting nexin 3
  Uniprot ID: O60493
  ENSP ID: ENSP00000357975
MAETVADTRRLITKPQNLNDAYGPPSNFLEIDVSNPQTVGVGRGRFTTYEIRVKTNLPIFKLKESTVRRRYSDFEWLRSELERESKPCLRMTSEARSHGRTWCAQNDEKLFCD

SEQ ID NO: 82566 - protein, 130 aa, Homo sapiens
  Payload ID: 16426
  Gene Symbol: SNX3
  Gene Name: sorting nexin 3
  Uniprot ID: O60493
  ENSP ID: ENSP00000401779
MAETVADTRRLITKPQNLNDAYGPPSNFLEIDVSNPQTVGVGRGRFTTYEIRVKVVVPPLPGKAFLRQLPFRGDDGIFDDNFIEERKQGLEQFINKVAGHPLAQNERCLHMFLQDEIIDKSYTPSKIRHA

SEQ ID NO: 82567 - protein, 440 aa, Homo sapiens
  Payload ID: 16427
  Gene Symbol: SNX31
  Gene Name: sorting nexin 31
  Uniprot ID: Q8N9S9
  ENSP ID: ENSP00000312368
MKMHFCIPVSQQRSDALGGRYVLYSVHLDGFLFCRVRYSQLHGWNEQLRRVFGNCLPPFPPKYYLAMTTAMADERRDQLEQYLQNVTMDPNVLRSDVFVEFLKLAQLNTFDIATKKAYLDIFLPNEQSIRIEIITSDTAERVLEVVSHKIGLCRELLGYFGLFLIRFGKEGKLSVVKKLADFELPYVSLGSSEVENCKVGLRKWYMAPSLDSVLMDCRVAVDLLYMQAIQDIEKGWAKPTQAQRQKLEAFQKEDSQTKFLELAREVRHYGYLQLDPCTCDYPESGSGAVLSVGNNEISCCITLPDSQTQDIVFQMSRVKCWQVTFLGTLLDTDGPQRTLNQNLELRFQYSEDSCWQWFVIYTKQAFLLSSCLKKMISEKMVKLAAENTEMQIEVPEQSKSKKYHIQQSQQKDYSSFLSRKSKIKIAKDDCVFGNIKEEDL

SEQ ID NO: 82568 - protein, 341 aa, Homo sapiens
  Payload ID: 16427
  Gene Symbol: SNX31
  Gene Name: sorting nexin 31
  Uniprot ID: Q8N9S9
  ENSP ID: ENSP00000405024
MLGNTENWNTFDIATKKAYLDIFLPNEQSIRIEIITSDTAERVLEVVSHKIGLCRELLGYFGLFLIRFGKEGKLSVVKKLADFELPYVSLGSSEVENCKVGLRKWYMAPSLDSVLMDCRVAVDLLYMQAIQDIEKGWAKPTQAQRQKLEAFQKEDSQTKFLELAREVRHYGYLQLDPCTCDYPESGSGAVLSVGNNEISCCITLPDSQTQDIVFQMSRVKCWQVTFLGTLLDTDGPQRTLNQNLELRFQYSEDSCWQWFVIYTKQAFLLSSCLKKMISEKMVKLAAENTEMQIEVPEQSKSKKYHIQQSQQKDYSSFLSRKSKIKIAKDDCVFGNIKEEDL

SEQ ID NO: 82569 - protein, 124 aa, Homo sapiens
  Payload ID: 16427
  Gene Symbol: SNX31
  Gene Name: sorting nexin 31
  ENSP ID: ENSP00000428210
MTTAMADERRDQLEQYLQNVTMDPNVLRSDVFVEFLKLAQLNTFDIATKKAYLDIFLPNEQSIRIEIITSDTAERVLEVVSHKIGLCRELLGYFGLFLIRFGKEGKLSVVKKLADFELPYVSLG

SEQ ID NO: 82570 - protein, 100 aa, Homo sapiens
  Payload ID: 16427
  Gene Symbol: SNX31
  Gene Name: sorting nexin 31
  ENSP ID: ENSP00000428262
MESTFVTQAGMQWGDLGLLQPLPPRFKGFSCLSLPSSPLHSSPLDLHQLYSVHLDGFLFCRVRYSQLHGWNEQLRRVFGNCLPPFPPKYYLAMTTAMADE

SEQ ID NO: 82571 - protein, 137 aa, Homo sapiens
  Payload ID: 16427
  Gene Symbol: SNX31
  Gene Name: sorting nexin 31
  ENSP ID: ENSP00000428855
MESTFVTQAGMQWGDLGLLQPLPPRFKGFSCLSLPSSPLHSSPLDLHQLRRVFGNCLPPFPPKYYLAMTTAMADERRDQLEQYLQNVTMDPNVLRSDVFVEFLKLAQLNTFDIATKKAYLDIFLPNEQSIRIEIITS

SEQ ID NO: 82572 - protein, 48 aa, Homo sapiens
  Payload ID: 16427
  Gene Symbol: SNX31
  Gene Name: sorting nexin 31
  ENSP ID: ENSP00000429110
  MOD_RES (1)..(1): Any amino acid
XMISEKMVKLAAENTEMQKDYSSFLSRKSKIKIAKDDCVFGNIKEEDL

SEQ ID NO: 82573 - protein, 403 aa, Homo sapiens
  Payload ID: 16428
  Gene Symbol: SNX32
  Gene Name: sorting nexin 32
  Uniprot ID: Q86XE0
  ENSP ID: ENSP00000310620
METYAEVGKEGKPSCASVDLQGDSSLQVEISDAVSERDKVKFTVQTKSCLPHFAQTEFSVVRQHEEFIWLHDAYVENEEYAGLIIPPAPPRPDFEASREKLQKLGEGDSSVTREEFAKMKQELEAEYLAIFKKTVAMHEVFLQRLAAHPTLRRDHNFFVFLEYGQDLSVRGKNRKELLGGFLRNIVKSADEALITGMSGLKEVDDFFEHERTFLLEYHTRIRDACLRADRVMRAHKCLADDYIPISAALSSLGTQEVNQLRTSFLKLAELFERLRKLEGRVASDEDLKLSDMLRYYMRDSQAAKDLLYRRLRALADYENANKALDKARTRNREVRPAESHQQLCCQRFERLSDSAKQELMDFKSRRVSSFRKNLIELAELELKHAKASTLILRNTLVALKGEP

SEQ ID NO: 82574 - protein, 574 aa, Homo sapiens
  Payload ID: 16429
  Gene Symbol: SNX33
  Gene Name: sorting nexin 33
  Uniprot ID: Q8WV41
  ENSP ID: ENSP00000311427
MALKGRALYDFHSENKEEISIQQDEDLVIFSETSLDGWLQGQNSRGETGLFPASYVEIVRSGISTNHADYSSSPAGSPGAQVSLYNSPSVASPARSGGGSGFLSNQGSFEEDDDDDWDDWDDGCTVVEEPRAGGLGTNGHPPLNLSYPGAYPSQHMAFRPKPPLERQDSLASAKRGSVVGRNLNRFSCFVRSGVEAFILGDVPMMAKIAETYSIEMGPRGPQWKANPHPFACSVEDPTKQTKFKGIKSYISYKLTPTHAASPVYRRYKHFDWLYNRLLHKFTVISVPHLPEKQATGRFEEDFIEKRKRRLILWMDHMTSHPVLSQYEGFQHFLSCLDDKQWKMGKRRAEKDEMVGASFLLTFQIPTEHQDLQDVEDRVDTFKAFSKKMDDSVLQLSTVASELVRKHVGGFRKEFQKLGSAFQAISHSFQMDPPFCSEALNSAISHTGRTYEAIGEMFAEQPKNDLFQMLDTLSLYQGLLSNFPDIIHLQKGAFAKVKESQRMSDEGRMVQDEADGIRRRCRVVGFALQAEMNHFHQRRELDFKHMMQNYLRQQILFYQRVGQQLEKTLRMYDNL

SEQ ID NO: 82575 - protein, 283 aa, Homo sapiens
  Payload ID: 16429
  Gene Symbol: SNX33
  Gene Name: sorting nexin 33
  ENSP ID: ENSP00000455436
  MOD_RES (1)..(1): Any amino acid
XRGPQWKANPHPFACSVEDPTKQTKFKGIKSYISYKLTPTHAASPVYRRYKHFDWLYNRLLHKFTVISVPHLPEKQATGRFEEDFIEKRKRRLILWMDHMTSHPVLSQYEGFQHFLSCLDDKQWKMGKRRAEKDEMVGASFLLTFQIPTEHQDLQDVEDRVDTFKAFSKKMDDSVLQLSTVASELGLLSNFPDIIHLQKGAFAKVKESQRMSDEGRMVQDEADGIRRRCRVVGFALQAEMNHFHQRRELDFKHMMQNYLRQQILFYQRVGQQLEKTLRMYDNL

SEQ ID NO: 82576 - protein, 450 aa, Homo sapiens
  Payload ID: 16430
  Gene Symbol: SNX4
  Gene Name: sorting nexin 4
  Uniprot ID: O95219
  ENSP ID: ENSP00000251775
MEQAPPDPERQLQPAPLEPLGSPDAGLGAAVGKEAEGAGEESSGVDTMTHNNFWLKKIEISVSEAEKRTGRNAMNMQETYTAYLIETRSVEHTDGQSVLTDSLWRRYSEFELLRSYLLVYYPHIVVPPLPEKRAEFVWHKLSADNMDPDFVERRRIGLENFLLRIASHPILCRDKIFYLFLTQEGNWKETVNETGFQLKADSRLKALNATFRVKNPDKRFTDLKHYSDELQSVISHLLRVRARVADRLYGVYKVHGNYGRVFSEWSAIEKEMGDGLQSAGHHMDVYASSIDDILEDEEHYADQLKEYLFYAEALRAVCRKHELMQYDLEMAAQDLASKKQQCEELVTGTVRTFSLKGMTTKLFGQETPEQREARIKVLEEQINEGEQQLKSKNLEGREFVKNAWADIERFKEQKNRDLKEALISYAVMQISMCKKGIQVWTNAKECFSKM

SEQ ID NO: 82577 - protein, 155 aa, Homo sapiens
  Payload ID: 16430
  Gene Symbol: SNX4
  Gene Name: sorting nexin 4
  ENSP ID: ENSP00000420175
MTHNNFWLKKIEISVSEAEKRTGRNAMNMQETYTAYLIETRSVEHTDGQSVLTDSLWRRYSEFELLRSYLLVYYPHIVVPPLPEKRAEFVWHKLSADNMDPDFVERRRIGLENFLLRIASHPILCRDKIFYLFLTQEGNWKETVNETGFQLKEIY

SEQ ID NO: 82578 - protein, 49 aa, Homo sapiens
  Payload ID: 16430
  Gene Symbol: SNX4
  Gene Name: sorting nexin 4
  ENSP ID: ENSP00000420526
MEQAPPDPERQLQPAPLEPLGSPDAGLGAAVGKEAEGAGEESSGVDTVS

SEQ ID NO: 82579 - protein, 404 aa, Homo sapiens
  Payload ID: 16431
  Gene Symbol: SNX5
  Gene Name: sorting nexin 5
  Uniprot ID: Q9Y5X3
  ENSP ID: ENSP00000366988
MAAVPELLQQQEEDRSKLRSVSVDLNVDPSLQIDIPDALSERDKVKFTVHTKTTLPTFQSPEFSVTRQHEDFVWLHDTLIETTDYAGLIIPPAPTKPDFDGPREKMQKLGEGEGSMTKEEFAKMKQELEAEYLAVFKKTVSSHEVFLQRLSSHPVLSKDRNFHVFLEYDQDLSVRRKNTKEMFGGFFKSVVKSADEVLFTGVKEVDDFFEQEKNFLINYYNRIKDSCVKADKMTRSHKNVADDYIHTAACLHSLALEEPTVIKKYLLKVAELFEKLRKVEGRVSSDEDLKLTELLRYYMLNIEAAKDLLYRRTKALIDYENSNKALDKARLKSKDVKLAEAHQQECCQKFEQLSESAKEELINFKRKRVAAFRKNLIEMSELEIKHARNNVSLLQSCIDLFKNN

SEQ ID NO: 82580 - protein, 404 aa, Homo sapiens; identical to SEQ ID NO: 82579
  Payload ID: 16431
  Gene Symbol: SNX5
  Gene Name: sorting nexin 5
  Uniprot ID: Q9Y5X3
  ENSP ID: ENSP00000366998

SEQ ID NO: 82581 - protein, 269 aa, Homo sapiens
  Payload ID: 16431
  Gene Symbol: SNX5
  Gene Name: sorting nexin 5
  ENSP ID: ENSP00000404448
MAAVPELLQQQEEDRSKLRSVSVDLNVDPSLQIDIPDALSERDKVKFTVHTKIPPAPTKPDFDGPREKMQKLGEGEGSMTKEEFAKMKQELEAEYLAVFKKTVSSHEVFLQRLSSHPVLSKDRNFHVFLEYDQDLSVRRKNTKEMFGGFFKSVVKSADEVLFTGVKEVDDFFEQEKNFLINYYNRIKDSCVKADKMTRSHKNVADDYIHTAACLHSLALEEPTVIKKYLLKVAELFEKLRKVEGRVSSDEDLKLTELLRYYMLNIEAAK

SEQ ID NO: 82582 - protein, 230 aa, Homo sapiens
  Payload ID: 16431
  Gene Symbol: SNX5
  Gene Name: sorting nexin 5
  ENSP ID: ENSP00000406731
MAAVPELLQQQEEDRSKTTLPTFQSPEFSVTRQHEDFVWLHDTLIETTDYAGLIIPPAPTKPDFDGPREKMQKLGEGEGSMTKEEFAKMKQELEAEYLAVFKKTVSSHEVFLQRLSSHPVLSKDRNFHVFLEYDQDLSVRRKNTKEMFGGFFKSVVKSADEVLFTGVKEVDDFFEQEKNFLINYYNRIKDSCVKADKMTRSHKNVADDYIHTAACLHSLALEEPTVIKKY

SEQ ID NO: 82583 - protein, 126 aa, Homo sapiens
  Payload ID: 16431
  Gene Symbol: SNX5
  Gene Name: sorting nexin 5
  Uniprot ID: Q9Y5X3
  ENSP ID: ENSP00000475510
MAAVPELLQQQEEDRSKVRSSQPQTPGRAALRAPGSLHSFPCASIGRGCSPPSPAREAPVRPGRPLSLVFTEGCPGESLWMSRILLGQNQRRGTLAPAQAPVPSGLGEMISGDPGMFFLKLSSASW

SEQ ID NO: 82584 - protein, 31 aa, Homo sapiens
  Payload ID: 16431
  Gene Symbol: SNX5
  Gene Name: sorting nexin 5
  ENSP ID: ENSP00000475606
MAAVPELLQQQEEDRSKAVAARRHPQRGKHP

SEQ ID NO: 82585 - protein, 31 aa, Homo sapiens; identical to SEQ ID NO: 82584
  Payload ID: 16431
  Gene Symbol: SNX5
  Gene Name: sorting nexin 5
  ENSP ID: ENSP00000475983

SEQ ID NO: 82586 - protein, 55 aa, Homo sapiens
  Payload ID: 16431
  Gene Symbol: SNX5
  Gene Name: sorting nexin 5
  ENSP ID: ENSP00000476097
MAAVPELLQQQEEDRSKNQRRGTLAPAQAPVPSGLGEMISGDPGMFFLKLSSASW

SEQ ID NO: 82587 - protein, 170 aa, Homo sapiens
  Payload ID: 16431
  Gene Symbol: SNX5
  Gene Name: sorting nexin 5
  ENSP ID: ENSP00000479021
  MOD_RES (1)..(1): Any amino acid
XKSADEVLFTGVKEVDDFFEQEKNFLINYYNRIKDSCVKADKMTRSHKNVADDYIHTAACLHSLALEEPTVIKKYLLKVAELFEKLRKVEGRVSSDEDLKLTELLRYYMLNIEAAKDLLYRRTKALIDYENSNKALDKARLKSKDVKLAEAHQQECCQKFEQLSESAKEG

SEQ ID NO: 82588 - protein, 418 aa, Homo sapiens
  Payload ID: 16432
  Gene Symbol: SNX6
  Gene Name: sorting nexin 6
  ENSP ID: ENSP00000355217
MRACAGPRLGAAMMEGLDDGPDFLSEEDRGLKAINVDLQSDAALQVDISDALSERDKVKFTVHTKSSLPNFKQNEFSVVRQHEEFIWLHDSFVENEDYAGYIIPPAPPRPDFDASREKLQKLGEGEGSMTKEEFTKMKQELEAEYLAIFKKTVAMHEVFLCRVAAHPILRRDLNFHVFLEYNQDLSVRGKNKKEKLEDFFKNMVKSADGVIVSGVKDVDDFFEHERTFLLEYHNRVKDASAKSDRMTRSHKSAADDYNRIGSSLYALGTQDSTDICKFFLKVSELFDKTRKIEARVSADEDLKLSDLLKYYLRESQAAKDLLYRRSRSLVDYENANKALDKARAKNKDVLQAETSQQLCCQKFEKISESAKQELIDFKTRRVAAFRKNLVELAELELKHAKGNLQLLQNCLAVLNGDT

SEQ ID NO: 82589 - protein, 290 aa, Homo sapiens
  Payload ID: 16432
  Gene Symbol: SNX6
  Gene Name: sorting nexin 6
  Uniprot ID: Q9UNH7
  ENSP ID: ENSP00000379779
MTKEEFTKMKQELEAEYLAIFKKTVAMHEVFLCRVAAHPILRRDLNFHVFLEYNQDLSVRGKNKKEKLEDFFKNMVKSADGVIVSGVKDVDDFFEHERTFLLEYHNRVKDASAKSDRMTRSHKSAADDYNRIGSSLYALGTQDSTDICKFFLKVSELFDKTRKIEARVSADEDLKLSDLLKYYLRESQAAKDLLYRRSRSLVDYENANKALDKARAKNKDVLQAETSQQLCCQKFEKISESAKQELIDFKTRRVAAFRKNLVELAELELKHAKGNLQLLQNCLAVLNGDT

SEQ ID NO: 82590 - protein, 132 aa, Homo sapiens
  Payload ID: 16432
  Gene Symbol: SNX6
  Gene Name: sorting nexin 6
  ENSP ID: ENSP00000450863
MRACAGPRLGAAMMEGLDDGPDFLSEEDRGLKAINVDLQSDAALQVDISDALSERDKVKFTVHTKIPPAPPRPDFDASREKLQKLGEGEGSMTKEEFTKMKQELEAGWITENLGFILLLPPSSASFFFVFTE

SEQ ID NO: 82591 - protein, 150 aa, Homo sapiens
  Payload ID: 16432
  Gene Symbol: SNX6
  Gene Name: sorting nexin 6
  ENSP ID: ENSP00000451415
  MOD_RES (1)..(1): Any amino acid
XRLGAAMMEGLDDGPDFLSEEDRGLKAINVDLQSDAALQVDISDALSERDKVKFTVHTKSSLPNFKQNEFSVVRQHEEFIWLHDSFVENEDYAGYIIPPAPPRPDFDASREKLQKLGEGEGSMTKEEFTKMKQELEADQTSPIIGPAGLL

SEQ ID NO: 82592 - protein, 169 aa, Homo sapiens
  Payload ID: 16432
  Gene Symbol: SNX6
  Gene Name: sorting nexin 6
  ENSP ID: ENSP00000452082
MRACAGPRLGAAMMEGLDDGPDFLSEEDRGLKAINVDLQSDAALQVDISDALSERDKVKFTVHTKSSLPNFKQNEFSVVRQHEEFIWLHDSFVENEDYAGYIIPPAPPRPDFDASREKLQKLGEGEGSMTKEEFTKMKQELEAGWITENLGFILLLPPSSASFFFVFTE

SEQ ID NO: 82593 - protein, 32 aa, Homo sapiens
  Payload ID: 16432
  Gene Symbol: SNX6
  Gene Name: sorting nexin 6
  ENSP ID: ENSP00000452231
MRACAGPRLGAAMMAWTTARTSSQKRTADLKQ

SEQ ID NO: 82594 - protein, 132 aa, Homo sapiens
  Payload ID: 16432
  Gene Symbol: SNX6
  Gene Name: sorting nexin 6
  ENSP ID: ENSP00000452520
MERPHPPSTLWGHENPFSDLPSGTLNFHPVWTSRTCSRPPFCLSQIVQLKAINVDLQSDAALQVDISDALSERDKVKFTVHTKSSLPNFKQNEFSVVRQHEEFIWLHDSFVENEDYAGYIIPPAPPRPDFDA

SEQ ID NO: 82595 - protein, 239 aa, Homo sapiens
  Payload ID: 16432
  Gene Symbol: SNX6
  Gene Name: sorting nexin 6
  ENSP ID: ENSP00000452577
MRACAGPRLGAAMMEGLDDGPDFLSEEDRGLKAINVDLQSDAALQVDISDALSERDKVKFTVHTKIPPAPPRPDFDASREKLQKLGEGEGSMTKEEFTKMKQELEAEYLAIFKKTVAMHEVFLCRVAAHPILRRDLNFHVFLEYNQDLSVRGKNKKEKLEDFFKNMVKSADGVIVSGVKDVDDFFEHERTFLLEYHNRVKDASAKSDRMTRSHKSAADDYNRIGSSLYALGTQDSTDIC

SEQ ID NO: 82596 - protein, 451 aa, Homo sapiens
  Payload ID: 16433
  Gene Symbol: SNX7
  Gene Name: sorting nexin 7
  Uniprot ID: Q9UNH6
  ENSP ID: ENSP00000304429
MEGERRASQAPSSGLPAGGANGESPGGGAPFPGSSGSSALLQAEVLDLDEDEDDLEVFSKDASLMDMNSFSPMMPTSPLSMINQIKFEDEPDLKDLFITVDEPESHVTTIETFITYRIITKTSRGEFDSSEFEVRRRYQDFLWLKGKLEEAHPTLIIPPLPEKFIVKGMVERFNDDFIETRRKALHKFLNRIADHPTLTFNEDFKIFLTAQAWELSSHKKQGPGLLSRMGQTVRAVASSMRGVKNRPEEFMEMNNFIELFSQKINLIDKISQRIYKEEREYFDEMKEYGPIHILWSASEEDLVDTLKDVASCIDRCCKATEKRMSGLSEALLPVVHEYVLYSEMLMGVMKRRDQIQAELDSKVEVLTYKKADTDLLPEEIGKLEDKVECANNALKADWERWKQNMQNDIKLAFTDMAEENIHYYEQCLATWESFLTSQTNLHLEEASEDKP

SEQ ID NO: 82597 - protein, 108 aa, Homo sapiens
  Payload ID: 16433
  Gene Symbol: SNX7
  Gene Name: sorting nexin 7
  ENSP ID: ENSP00000388266
MDMNSFSPMMPTSPLSMINQIKFEDEPDLKDLFITVDEPESHVTTIETFITYRIITKTSRGEFDSSEFEVRRRYQDFLWLKGKLEEAHPTLIIPPLPEKFIVKGMVER

SEQ ID NO: 82598 - protein, 396 aa, Homo sapiens
  Payload ID: 16433
  Gene Symbol: SNX7
  Gene Name: sorting nexin 7
  ENSP ID: ENSP00000434731
MEGERRASQAPSSGLPAGGANGESPGGGAPFPGSSGSSALLQAEVLDLDEDEDDLEVFSKDASLMDMNSFSPMMPTSPLSMINQIKFEDEPDLKDLFITVDEPESHVTTIETFITYRIITKTSRGEFDSSEFEVRRRYQDFLWLKGKLEEAHPTLIIPELSSHKKQGPGLLSRMGQTVRAVASSMRGVKNRPEEFMEMNNFIELFSQKINLIDKISQRIYKEEREYFDEMKEYGPIHILWSASEEDLVDTLKDVASCIDRCCKATEKRMSGLSEALLPVVHEYVLYSEMLMGVMKRRDQIQAELDSKVEVLTYKKADTDLLPEEIGKLEDKVECANNALKADWERWKQNMQNDIKLAFTDMAEENIHYYEQCLATWESFLTSQTNLHLEEASEDKP

SEQ ID NO: 82599 - protein, 36 aa, Homo sapiens
  Payload ID: 16433
  Gene Symbol: SNX7
  Gene Name: sorting nexin 7
  ENSP ID: ENSP00000435172
MSLQFLKLLLREDLSSDHNAVFITKKPVHFNVTWRY

SEQ ID NO: 82600 - protein, 465 aa, Homo sapiens
  Payload ID: 16434
  Gene Symbol: SNX8
  Gene Name: sorting nexin 8
  Uniprot ID: Q9Y5X2
  ENSP ID: ENSP00000222990
MTGRAMDPLPAAAVGAAAEAEADEEADPPASDLPTPQAIEPQAIVQQVPAPSRMQMPQGNPLLLSHTLQELLARDTVQVELIPEKKGLFLKHVEYEVSSQRFKSSVYRRYNDFVVFQEMLLHKFPYRMVPALPPKRMLGADREFIEARRRALKRFVNLVARHPLFSEDVVLKLFLSFSGSDVQNKLKESAQCVGDEFLNCKLATRAKDFLPADIQAQFAISRELIRNIYNSFHKLRDRAERIASRAIDNAADLLIFGKELSAIGSDTTPLPSWAALNSSTWGSLKQALKGLSVEFALLADKAAQQGKQEENDVVEKLNLFLDLLQSYKDLCERHEKGVLHKHQRALHKYSLMKRQMMSATAQNREPESVEQLESRIVEQENAIQTMELRNYFSLYCLHQETQLIHVYLPLTSHILRAFVNSQIQGHKEMSKVWNDLRPKLSCLFAGPHSTLTPPCSPPEDGLCPH

SEQ ID NO: 82601 - protein, 224 aa, Homo sapiens
  Payload ID: 16434
  Gene Symbol: SNX8
  Gene Name: sorting nexin 8
  ENSP ID: ENSP00000392437
MHPGLPSTLTCSCSLMSDLPTPQAIEPQAIVQQVPAPSRMQMPQGNPLLLSHTLQELLARDTVQVELIPEKKGLFLKHVEYEVSSQRFKSSVYRRYNDFVVFQEMLLHKFPYRMVPALPPKRMLGADREFIEARRRALKRFVNLVARHPLFSEDVVLKLFLSFSGSDVQNKLKESAQCVGDEFLNCKLATRAKDFLPADIQAQFAISRELIRNIYNSFHKLRDR

SEQ ID NO: 82602 - protein, 42 aa, Homo sapiens
  Payload ID: 16434
  Gene Symbol: SNX8
  Gene Name: sorting nexin 8
  ENSP ID: ENSP00000399127
MQMPQGNPLLLSHTLQELLARDTVQVELIPEKKGLFLKHVEY

SEQ ID NO: 82603 - protein, 85 aa, Homo sapiens
  Payload ID: 16434
  Gene Symbol: SNX8
  Gene Name: sorting nexin 8
  ENSP ID: ENSP00000403608
MQMPQGNPLLLSHTLQELLARDTVQVELIPEKKGLFLKHVEYEVSSQRFKSSVYRRYNDFVVFQEMLLHKFPYRMVPALPPKRML

SEQ ID NO: 82604 - protein, 160 aa, Homo sapiens
  Payload ID: 16434
  Gene Symbol: SNX8
  Gene Name: sorting nexin 8
  ENSP ID: ENSP00000406212
MQMPQGNPLLLSHTLQELLARDTVQVELIPEKKGLFLKHVEYEVSSQRFKSSVYRRYNDFVVFQEMLLHKFPYRMVPALPPKRMLGADREFIEARRRALKRFVNLVARHPLFSEDVVLKLFLSFSGSDVQNKLKESAQCVGDEFLNCKLATRAKDFLPAD

SEQ ID NO: 82605 - protein, 176 aa, Homo sapiens
  Payload ID: 16434
  Gene Symbol: SNX8
  Gene Name: sorting nexin 8
  ENSP ID: ENSP00000406954
MQMPQGNPLLLSHTLQELLARDTVQVELIPEKKGLFLKHVEYEVSSQRFKSSVYRRYNDFVVFQEMLLHKFPYRMVPALPPKRMLGADREFIEARRRALKRFVNLVARHPLFSEDVVLKLFLSFSGSDVQNKLKESAQCVGDEFLNCKLATRAKDFLPADIQAQFAISRELIRNIY

SEQ ID NO: 82606 - protein, 595 aa, Homo sapiens
  Payload ID: 16435
  Gene Symbol: SNX9
  Gene Name: sorting nexin 9
  Uniprot ID: Q9Y5X1
  ENSP ID: ENSP00000376024
MATKARVMYDFAAEPGNNELTVNEGEIITITNPDVGGGWLEGRNIKGERGLVPTDYVEILPSDGKDQFSCGNSVADQAFLDSLSASTAQASSSAASNNHQVGSGNDPWSAWSASKSGNWESSEGWGAQPEGAGAQRNTNTPNNWDTAFGHPQAYQGPATGDDDDWDEDWDGPKSSSYFKDSESADAGGAQRGNSRASSSSMKIPLNKFPGFAKPGTEQYLLAKQLAKPKEKIPIIVGDYGPMWVYPTSTFDCVVADPRKGSKMYGLKSYIEYQLTPTNTNRSVNHRYKHFDWLYERLLVKFGSAIPIPSLPDKQVTGRFEEEFIKMRMERLQAWMTRMCRHPVISESEVFQQFLNFRDEKEWKTGKRKAERDELAGVMIFSTMEPEAPDLDLVEIEQKCEAVGKFTKAMDDGVKELLTVGQEHWKRCTGPLPKEYQKIGKALQSLATVFSSSGYQGETDLNDAITEAGKTYEEIASLVAEQPKKDLHFLMECNHEYKGFLGCFPDIIGTHKGAIEKVKESDKLVATSKITLQDKQNMVKRVSIMSYALQAEMNHFHSNRIYDYNSVIRLYLEQQVQFYETIAEKLRQALSRFPVM

SEQ ID NO: 82607 - protein, 63 aa, Homo sapiens
  Payload ID: 16435
  Gene Symbol: SNX9
  Gene Name: sorting nexin 9
  ENSP ID: ENSP00000479382
MYDFAAEPGNNELTVNEGEIITITNPDVGGGWLEGRNIKGERGLVPTDYVEILPSDGKDQFSC

SEQ ID NO: 82608 - protein, 594 aa, Homo sapiens
  Payload ID: 16435
  Gene Symbol: SNX9
  Gene Name: sorting nexin 9
  ENSP ID: ENSP00000482087
STKARVMYDFAAEPGNNELTVNEGEIITITNPDVGGGWLEGRNIKGERGLVPTDYVEILPSDGKDQFSCGNSVADQAFLDSLSASTAQASSSAASNNHQVGSGNDPWSAWSASKSGNWESSEGWGAQPEGAGAQRNTNTPNNWDTAFGHPQAYQGPATGDDDDWDEDWDGPKSSSYFKDSESADAGGAQRGNSRASSSSMKIPLNKFPGFAKPGTEQYLLAKQLAKPKEKIPIIVGDYGPMWVYPTSTFDCVVADPRKGSKMYGLKSYIEYQLTPTNTNRSVNHRYKHFDWLYERLLVKFGSAIPIPSLPDKQVTGRFEEEFIKMRMERLQAWMTRMCRHPVISESEVFQQFLNFRDEKEWKTGKRKAERDELAGVMIFSTMEPEAPDLDLVEIEQKCEAVGKFTKAMDDGVKELLTVGQEHWKRCTGPLPKEYQKIGKALQSLATVFSSSGYQGETDLNDAITEAGKTYEEIASLVAEQPKKDLHFLMECNHEYKGFLGCFPDIIGTHKGAIEKVKESDKLVATSKITLQDKQNMVKRVSIMSYALQAEMNHFHSNRIYDYNSVIRLYLEQQVQFYETIAEKLRQALSRFPVM

SEQ ID NO: 82609 - protein, 84 aa, Homo sapiens
  Payload ID: 16435
  Gene Symbol: SNX9
  Gene Name: sorting nexin 9
  ENSP ID: ENSP00000482920
MYDFAAEPGNNELTVNEGEIITITNPDVGGGWLEGRNIKGERGLVPTDYVEILPSDGKDQFSCGNSVADQAFLDSLSASTAQAS

SEQ ID NO: 82610 - protein, 199 aa, Homo sapiens
  Payload ID: 16436
  Gene Symbol: SNX21
  Gene Name: sorting nexin family member 21
  Uniprot ID: Q969T3
  ENSP ID: ENSP00000344586
MHRGTQEGAMASRLLHRLRHALAGDGPGEAAASPEAEQFPESSELEDDDAEGLSSRLSGTLSFTSAEDDEDDEDEDDEEAGPDQLPLGDGTSGEDAERSPPPDGQWGSQLLARQLQDFWKKSRNTLAPQRLLFEVTSANVVKDPPSKYVLYTLAVIGPGPPDCQPAQISRRYSDFERLHRNLQRQFRGPMAAISFPQSH

SEQ ID NO: 82611 - protein, 149 aa, Homo sapiens
  Payload ID: 16436
  Gene Symbol: SNX21
  Gene Name: sorting nexin family member 21
  ENSP ID: ENSP00000361619
MASRLLHRLRHALAGDGPGEAAASPEAEQFPESSELEDDDAEGLSSRLSGTLSFTSAEDDEDDEDEDDEEAGPDQLPLGDGTSGEDAERSPPPDGQWGSQLLARQLQDFWKKSRNTLAPQRLLFEVTSANVVKDPPSKYVTNLSSTPSP

SEQ ID NO: 82612 - protein, 364 aa, Homo sapiens
  Payload ID: 16436
  Gene Symbol: SNX21
  Gene Name: sorting nexin family member 21
  ENSP ID: ENSP00000361620
MASRLLHRLRHALAGDGPGEAAASPEAEQFPESSELEDDDAEGLSSRLSGTLSFTSAEDDEDDEDEDDEEAGPDQLPLGDGTSGEDAERSPPPDGQWGSQLLARQLQDFWKKSRNTLAPQRLLFEVTSANVVKDPPSKYVLYTLAVIGPGPPDCQPAQISRRYSDFERLHRNLQRQFRGPMAAISFPRKRLRRNFTAETIARRSRAFEQFLGHLQAVPELRHAPDLQDFFVLPELRRAQSLTCTGLYREALALWANAWQLQAQLGTPSGPDRPLLTLAGLAVCHQELEDPGEARACCEKALQLLGDKSLHPLLAPFLEAHVRLSWRLGLDKRQSEARLQALQEAGLTPTPPPSLKELLIKEVLD

SEQ ID NO: 82613 - protein, 373 aa, Homo sapiens
  Payload ID: 16436
  Gene Symbol: SNX21
  Gene Name: sorting nexin family member 21
  Uniprot ID: Q969T3
  ENSP ID: ENSP00000418593
MHRGTQEGAMASRLLHRLRHALAGDGPGEAAASPEAEQFPESSELEDDDAEGLSSRLSGTLSFTSAEDDEDDEDEDDEEAGPDQLPLGDGTSGEDAERSPPPDGQWGSQLLARQLQDFWKKSRNTLAPQRLLFEVTSANVVKDPPSKYVLYTLAVIGPGPPDCQPAQISRRYSDFERLHRNLQRQFRGPMAAISFPRKRLRRNFTAETIARRSRAFEQFLGHLQAVPELRHAPDLQDFFVLPELRRAQSLTCTGLYREALALWANAWQLQAQLGTPSGPDRPLLTLAGLAVCHQELEDPGEARACCEKALQLLGDKSLHPLLAPFLEAHVRLSWRLGLDKRQSEARLQALQEAGLTPTPPPSLKELLIKEVLD

SEQ ID NO: 82614 - protein, 158 aa, Homo sapiens
  Payload ID: 16436
  Gene Symbol: SNX21
  Gene Name: sorting nexin family member 21
  Uniprot ID: Q969T3
  ENSP ID: ENSP00000420169
MHRGTQEGAMASRLLHRLRHALAGDGPGEAAASPEAEQFPESSELEDDDAEGLSSRLSGTLSFTSAEDDEDDEDEDDEEAGPDQLPLGDGTSGEDAERSPPPDGQWGSQLLARQLQDFWKKSRNTLAPQRLLFEVTSANVVKDPPSKYVTNLSSTPSP

SEQ ID NO: 82615 - protein, 165 aa, Homo sapiens
  Payload ID: 16436
  Gene Symbol: SNX21
  Gene Name: sorting nexin family member 21
  ENSP ID: ENSP00000478395
MHRGTQEGAMASRLLHRLRHALAGDGPGEAAASPEAEQFPESSELEDDDAEGLSSRLSGTLSFTSAEDDEDDEDEDDEEAGPDQLPLGDGTSGEDAERSPPPDGQWGSQLLARQLQDFWKKSRNTLAPQRLLFEVTSANVVKDPPSKYVRQGLAMLPRLVSNSWP

SEQ ID NO: 82616 - protein, 435 aa, Homo sapiens
  Payload ID: 16437
  Gene Symbol: SNX27
  Gene Name: sorting nexin family member 27
  ENSP ID: ENSP00000357831
MGLSFSLFPLRNHVNVEGATHKQVVDLIRAGEKELILTVLSVPPHEADNLDPSDDSLGQSFYDYTEKQAVPISVPRYKHVEQNGEKFVVYNVYMAGRQLCSKRYREFAILHQNLKREFANFTFPRLPGKWPFSLSEQQLDARRRGLEEYLEKVCSIRVIGESDIMQEFLSESDENYNGVSDVELRVALPDGTTVTVRVKKNSTTDQVYQAIAAKVGMDSTTVNYFALFEVISHSFVRKLAPNEFPHKLYIQNYTSAVPGTCLTIRKWLFTTEEEILLNDNDLAVTYFFHQAVDDVKKGYIKAEEKSYQLQKLYEQRKMVMYLNMLRTCEGYNEIIFPHCACDSRRKGHVITAISITHFKLHACTEEGQLENQVIAFEWDEMQRWDTDEEGMAFCFEYARGEKKPRWVKIFTPYFNYMHECFERVFCELKWRKEEY

SEQ ID NO: 82617 - protein, 65 aa, Homo sapiens
  Payload ID: 16437
  Gene Symbol: SNX27
  Gene Name: sorting nexin family member 27
  ENSP ID: ENSP00000357834
MADEDGEGIHPSAPHRNGGGGGGGGSGLHCAGNGGGGGGGPRVVRIVKSESGYGFNVRGQEPREC

SEQ ID NO: 82618 - protein, 528 aa, Homo sapiens
  Payload ID: 16437
  Gene Symbol: SNX27
  Gene Name: sorting nexin family member 27
  Uniprot ID: Q96L92
  ENSP ID: ENSP00000357836
MADEDGEGIHPSAPHRNGGGGGGGGSGLHCAGNGGGGGGGPRVVRIVKSESGYGFNVRGQVSEGGQLRSINGELYAPLQHVSAVLPGGAADRAGVRKGDRILEVNHVNVEGATHKQVVDLIRAGEKELILTVLSVPPHEADNLDPSDDSLGQSFYDYTEKQAVPISVPRYKHVEQNGEKFVVYNVYMAGRQLCSKRYREFAILHQNLKREFANFTFPRLPGKWPFSLSEQQLDARRRGLEEYLEKVCSIRVIGESDIMQEFLSESDENYNGVSDVELRVALPDGTTVTVRVKKNSTTDQVYQAIAAKVGMDSTTVNYFALFEVISHSFVRKLAPNEFPHKLYIQNYTSAVPGTCLTIRKWLFTTEEEILLNDNDLAVTYFFHQAVDDVKKGYIKAEEKSYQLQKLYEQRKMVMYLNMLRTCEGYNEIIFPHCACDSRRKGHVITAISITHFKLHACTEEGQLENQVIAFEWDEMQRWDTDEEGMAFCFEYARGEKKPRWVKIFTPYFNYMHECFERVFCELKWRKEEY

SEQ ID NO: 82619 - protein, 541 aa, Homo sapiens
  Payload ID: 16437
  Gene Symbol: SNX27
  Gene Name: sorting nexin family member 27
  Uniprot ID: Q96L92
  ENSP ID: ENSP00000400333
MADEDGEGIHPSAPHRNGGGGGGGGSGLHCAGNGGGGGGGPRVVRIVKSESGYGFNVRGQVSEGGQLRSINGELYAPLQHVSAVLPGGAADRAGVRKGDRILEVNHVNVEGATHKQVVDLIRAGEKELILTVLSVPPHEADNLDPSDDSLGQSFYDYTEKQAVPISVPRYKHVEQNGEKFVVYNVYMAGRQLCSKRYREFAILHQNLKREFANFTFPRLPGKWPFSLSEQQLDARRRGLEEYLEKVCSIRVIGESDIMQEFLSESDENYNGVSDVELRVALPDGTTVTVRVKKNSTTDQVYQAIAAKVGMDSTTVNYFALFEVISHSFVRKLAPNEFPHKLYIQNYTSAVPGTCLTIRKWLFTTEEEILLNDNDLAVTYFFHQAVDDVKKGYIKAEEKSYQLQKLYEQRKMVMYLNMLRTCEGYNEIIFPHCACDSRRKGHVITAISITHFKLHACTEEGQLENQVIAFEWDEMQRWDTDEEGMAFCFEYARGEKKPRWVKIFTPYFNYMHECFERVFCELKWRKENIFQMARSQQRDVAT

SEQ ID NO: 82620 - protein, 437 aa, Homo sapiens
  Payload ID: 16438
  Gene Symbol: SNX30
  Gene Name: sorting nexin family member 30
  Uniprot ID: Q5VWJ9
  ENSP ID: ENSP00000363349
MAGGPPKALPSTGPHSLRDMPHPLAGSSSEEAVGGDSTPSPDLLMARSFGDKDLILPNGGTPAGTSSPASSSSLLNRLQLDDDIDGETRDLFVIVDDPKKHVCTMETYITYRITTKSTRVEFDLPEYSVRRRYQDFDWLRSKLEESQPTHLIPPLPEKFVVKGVVDRFSEEFVETRRKALDKFLKRITDHPVLSFNEHFNIFLTAKDLNAYKKQGIALLTRMGESVKHVTGGYKLRTRPLEFAAIGDYLDTFALKLGTIDRIAQRIIKEEIEYLVELREYGPVYSTWSALEGELAEPLEGVSACIGNCSTALEELTDDMTEDFLPVLREYILYSDSMKSVLKKRDQVQAEYEAKLEAVALRKEDRPKVPADVEKCQDRMECFNADLKADMERWQNNKRQDFRQLLMGMADKNIQYYEKCLMAWESIIPLLQEKQEAK

SEQ ID NO: 82621 - protein, 124 aa, Homo sapiens
  Payload ID: 16438
  Gene Symbol: SNX30
  Gene Name: sorting nexin family member 30
  ENSP ID: ENSP00000390454
  MOD_RES (1)..(1): Any amino acid
XSACIGNCSTALEELTDDMTEDFLPVLREYILYSDSMKSVLKKRDQVQAEYEAKLEAVALRKEDRPKVPADVEKCQDRMECFNADLKADMERWQNNKRQDFRQLLMGMADKNIQYYEKSIADLK

SEQ ID NO: 82622 - protein, 549 aa, Homo sapiens
  Payload ID: 16439
  Gene Symbol: SOWAHA
  Gene Name: sosondowah ankyrin repeat domain family member A
  Uniprot ID: Q2M3V2
  ENSP ID: ENSP00000367965
MALAAAAAAAAAGVSQAAVLGFLQEHGGKVRNSELLSRFKPLLDAGDPRGRAARRDRFKQFVNNVAVVKELDGVKFVVLRKKPRPPEPEPAPFGPPGAAAQPSKPTSTVLPRSASAPGAPPLVRVPRPVEPPGDLGLPTEPQDTPGGPASEPAQPPGERSADPPLPALELAQATERPSADAAPPPRAPSEAASPCSDPPDAEPGPGAAKGPPQQKPCMLPVRCVPAPATLRLRAEEPGLRRQLSEEPSPRSSPLLLRRLSVEESGLGLGLGPGRSPHLRRLSRAGPRLLSPDAEELPAAPPPSAVPLEPSEHEWLVRTAGGRWTHQLHGLLLRDRGLAAKRDFMSGFTALHWAAKSGDGEMALQLVEVARRSGAPVDVNARSHGGYTPLHLAALHGHEDAAVLLVVRLGAQVHVRDHSGRRAYQYLRPGSSYALRRLLGDPGLRGTTEPDATGGGSGSLAARRPVQVAATILSSTTSAFLGVLADDLMLQDLARGLKKSSSFSKFLSASPMAPRKKTKIRGGLPAFSEISRRPTPGPLAGLVPSLPPTT

SEQ ID NO: 82623 - protein, 793 aa, Homo sapiens
  Payload ID: 16440
  Gene Symbol: SOWAHB
  Gene Name: sosondowah ankyrin repeat domain family member B
  Uniprot ID: A6NEL2
  ENSP ID: ENSP00000334879
MARELSQEALLDFLCQAGGRVTNAALLSHFKSFLRDPDASPSQHQHRRELFKGFVNSVAAVRQDPDGTKYVVLKRRYRDLLGEEGLQRPREPPAAAPSAGGAAPCSPRGARRGEPPQQQPRRRRREKEPEEEPAGAAARAADAACNGLPGSDSRRAPGKGGGSKGSPGQRPPVPAAAAAGAQARASCAAAKTQGRCCWECLQNNLAVLPGELGALPHSATAEEKPARALPAQDDRGASREREEGALAEPAPVPAVAHSPPATVEAATSRASPPALLPGPAPRGDRPELLTPSSLHYSTLQQQQQRTREWVARHPQVPEARDQGPIRAWSVLPDNFLQLPLEPGSTEPNSEPPDPCLSSHSLFPVVPDESWESWAGNPSLTVFRSIRCQLSLQDLDDFVDQESDGSEESSSGPKDSPGASEEGLQVVLGTPDRGKLRNPAGGLSVSRKEGSPSRSPQGLRNRGDGHISQQVPAGANGLAGHPLKPLPWPVPKLRRSLRRSSLAGRAKLSSSDEEYLDEGLLKRSRRPPRSRKPSKAGTAPSPRVDAGLSLKLAEVKAVVAERGWRHSLWVPSGEGSAALAPHRTSEHKSSLVPLDAREHEWIVKLASGSWIQVWTLFWEDPQLALHKDFLTGYTALHWIAKHGDLRALQDLVSGAKKAGIVLDVNVRSSCGYTPLHLAAIHGHQGVIKLLVQRLASRVNVRDSSGKKPWQYLTSNTSGEIWQLLGAPRGKPIFPVYPLVGSSSPTRKAKSKEISRSVTRKTSFAALLKSQHNKWKLANQYEKFHSPREREEYSD

SEQ ID NO: 82624 - protein, 525 aa, Homo sapiens
  Payload ID: 16441
  Gene Symbol: SOWAHC
  Gene Name: sosondowah ankyrin repeat domain family member C
  Uniprot ID: Q53LP3
  ENSP ID: ENSP00000365830
MEGPAEWGPEAALGPEAVLRFLAERGGRALHAELVQHFRGALGGEPEQRARARAHFKELVNAVATVRVDPADGAKYVHLKKRFCEGPSEPSGDPPRIQVTAEPEAPDGPAGPEARDRLPDAAAPESLPGQGRELGEGEPPAPAHWPPLSAGARRKNSRRDVQPLPRTPAPGPSEDLELPPHGCEEADRGSSLVGATAQRPARQNLRDLVMGSSPQLKRSVCPGGSSPGSSSGGGRGRGGGDSDSASVASSSAEEESSGGGSVTLDPLEHAWMLSASDGKWDSLEGLLTCEPGLLVKRDFITGFTCLHWAAKHGRQELLAMLVNFANKHQLPVNIDARTSGGYTALHLAAMHGHVEVVKLLVGAYDADVDIRDYSGKKASQYLSRSIAEEIKNLVGALDEGDGESAAGSGGGRWRLSKVLPSHLITYKLSHALEDGGDHHHHHHSAEGWVGGKAKDPGRKASGSSSGRIKPRLNKIRFRTQIVHTTPSFRDPEQPLEGRGEEGVGEERPVKGHSPFTLRPKSNVFG

SEQ ID NO: 82625 - protein, 315 aa, Homo sapiens
  Payload ID: 16442
  Gene Symbol: SOWAHD
  Gene Name: sosondowah ankyrin repeat domain family member D
  Uniprot ID: A6NJG2
  ENSP ID: ENSP00000340975
MAQLGGAANRAPTASLAPTSQSLRCAPQPRPSRADTGSLGRYWGKAAAAASREHPFPGTLMHSAAGSGRRRGALRELLGLQRAAPAGWLSEERAEELGGPSGPGSSRLCLEPREHAWILAAAEGRYEVLRELLEAEPELLLRGDPITGYSVLHWLAKHGRHEELILVHDFALRRGLRLDVSAPGSGGLTPLHLAALQGHDMVIKVLVGALGADATRRDHSGHRACHYLRPDAPWRLRELSGAEEWEMESGSGCTNLNNNSSGTTAWRAASAVGATAVETSRRVAASRTKAKDTAGSRVAQMHSLFRHLFPSFQDR

SEQ ID NO: 82626 - protein, 785 aa, Homo sapiens
  Payload ID: 16443
  Gene Symbol: SP1
  Gene Name: Sp1 transcription factor
  Uniprot ID: P08047
  ENSP ID: ENSP00000329357
MSDQDHSMDEMTAVVKIEKGVGGNNGGNGNGGGAFSQARSSSTGSSSSTGGGGQESQPSPLALLAATCSRIESPNENSNNSQGPSQSGGTGELDLTATQLSQGANGWQIISSSSGATPTSKEQSGSSTNGSNGSESSKNRTVSGGQYVVAAAPNLQNQQVLTGLPGVMPNIQYQVIPQFQTVDGQQLQFAATGAQVQQDGSGQIQIIPGANQQIITNRGSGGNIIAAMPNLLQQAVPLQGLANNVLSGQTQYVTNVPVALNGNITLLPVNSVSAATLTPSSQAVTISSSGSQESGSQPVTSGTTISSASLVSSQASSSSFFTNANSYSTTTTTSNMGIMNFTTSGSSGTNSQGQTPQRVSGLQGSDALNIQQNQTSGGSLQAGQQKEGEQNQQTQQQQILIQPQLVQGGQALQALQAAPLSGQTFTTQAISQETLQNLQLQAVPNSGPIIIRTPTVGPNGQVSWQTLQLQNLQVQNPQAQTITLAPMQGVSLGQTSSSNTTLTPIASAASIPAGTVTVNAAQLSSMPGLQTINLSALGTSGIQVHPIQGLPLAIANAPGDHGAQLGLHGAGGDGIHDDTAGGEEGENSPDAQPQAGRRTRREACTCPYCKDSEGRGSGDPGKKKQHICHIQGCGKVYGKTSHLRAHLRWHTGERPFMCTWSYCGKRFTRSDELQRHKRTHTGEKKFACPECPKRFMRSDHLSKHIKTHQNKKGGPGVALSVGTLPLDSGAGSEGSGTATPSALITTNMVAMEAICPEGIARLANSGINVMQVADLQSINISGNGF

SEQ ID NO: 82627 - protein, 778 aa, Homo sapiens
  Payload ID: 16443
  Gene Symbol: SP1
  Gene Name: Sp1 transcription factor
  Uniprot ID: P08047
  ENSP ID: ENSP00000404263
MDEMTAVVKIEKGVGGNNGGNGNGGGAFSQARSSSTGSSSSTGGGGQESQPSPLALLAATCSRIESPNENSNNSQGPSQSGGTGELDLTATQLSQGANGWQIISSSSGATPTSKEQSGSSTNGSNGSESSKNRTVSGGQYVVAAAPNLQNQQVLTGLPGVMPNIQYQVIPQFQTVDGQQLQFAATGAQVQQDGSGQIQIIPGANQQIITNRGSGGNIIAAMPNLLQQAVPLQGLANNVLSGQTQYVTNVPVALNGNITLLPVNSVSAATLTPSSQAVTISSSGSQESGSQPVTSGTTISSASLVSSQASSSSFFTNANSYSTTTTTSNMGIMNFTTSGSSGTNSQGQTPQRVSGLQGSDALNIQQNQTSGGSLQAGQQKEGEQNQQTQQQQILIQPQLVQGGQALQALQAAPLSGQTFTTQAISQETLQNLQLQAVPNSGPIIIRTPTVGPNGQVSWQTLQLQNLQVQNPQAQTITLAPMQGVSLGQTSSSNTTLTPIASAASIPAGTVTVNAAQLSSMPGLQTINLSALGTSGIQVHPIQGLPLAIANAPGDHGAQLGLHGAGGDGIHDDTAGGEEGENSPDAQPQAGRRTRREACTCPYCKDSEGRGSGDPGKKKQHICHIQGCGKVYGKTSHLRAHLRWHTGERPFMCTWSYCGKRFTRSDELQRHKRTHTGEKKFACPECPKRFMRSDHLSKHIKTHQNKKGGPGVALSVGTLPLDSGAGSEGSGTATPSALITTNMVAMEAICPEGIARLANSGINVMQVADLQSINISGNGF

SEQ ID NO: 82628 - protein, 162 aa, Homo sapiens
  Payload ID: 16443
  Gene Symbol: SP1
  Gene Name: Sp1 transcription factor
  ENSP ID: ENSP00000457804
MSDQDHSMDEMTAVVKIEKGVGGNNGGNGNGGGAFSQARSSSTGSSSSTGGGGQGANGWQIISSSSGATPTSKEQSGSSTNGSNGSESSKNRTVSGGQYVVAAAPNLQNQQVLTGLPGVMPNIQYQVIPQFQTVDGQQLQFAATGAQVQQDGSGQIQIIPGA

SEQ ID NO: 82629 - protein, 230 aa, Homo sapiens
  Payload ID: 16443
  Gene Symbol: SP1
  Gene Name: Sp1 transcription factor
  ENSP ID: ENSP00000458133
MDEMTAVVKIEKGVGGNNGGNGNGGGAFSQARSSSTGSSSSTGGGGQESQPSPLALLAATCSRIESPNENSNNSQGPSQSGGTGELDLTATQLSQGANGWQIISSSSGATPTSKEQSGSSTNGSNGSESSKNRTVSGGQYVVAAAPNLQNQQVLTGLPGVMPNIQYQVIPQFQTVDGQQLQFAATGAQVQQDGSGQIQIIPGANQQIITNRGSGGNIIAAMPNLLQQAVP

SEQ ID NO: 82630 - protein, 879 aa, Homo sapiens
  Payload ID: 16444
  Gene Symbol: SP100
  Gene Name: SP100 nuclear antigen
  Uniprot ID: P23497
  ENSP ID: ENSP00000264052
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGSQPQEPENKKCSCVMCFPKGVPRSQEARTESSQASDMMDTMDVENNSTLEKHSGKRRKKRRHRSKVNGLQRGRKKDRPRKHLTLNNKVQKKRWQQRGRKANTRPLKRRRKRGPRIPKDENINFKQSELPVTCGEVKGTLYKERFKQGTSKKCIQSEDKKWFTPREFEIEGDRGASKNWKLSIRCGGYTLKVLMENKFLPEPPSTRKKRILESHNNTLVDPCEEHKKKNPDASVKFSEFLKKCSETWKTIFAKEKGKFEDMAKADKAHYEREMKTYIPPKGEKKKKFKDPNAPKRPPLAFFLFCSEYRPKIKGEHPGLSIDDVVKKLAGMWNNTAAADKQFYEKKAAKLKEKYKKDIAAYRAKGKPNSAKKRVVKAEKSKKKKEEEEDEEDEQEEENEEDDDK

SEQ ID NO: 82631 - protein, 885 aa, Homo sapiens
  Payload ID: 16444
  Gene Symbol: SP100
  Gene Name: SP100 nuclear antigen
  Uniprot ID: P23497
  ENSP ID: ENSP00000343023
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGSQPQEPENKKCSCVMCFPKGVPRSQEARTESSQASDMMDTMDVENNSTLEKHSGKRRKKRRHRSKVNGLQRGRKKDRPRKHLTLNNKVQKKRWQQRGRKANTRPLKRRRKRGPRIPKDENINFKQSELPVTCGEVKGTLYKERFKQGTSKKCIQSEDKKWFTPREFEIEGDRGASKNWKLSIRCGGYTLKVLMENKFLPEPPSTRKKRILESHNNTLVDPCPENSNICEVCNKWGRLFCCDTCPRSFHEHCHIPSVEANKNPWSCIFCRIKTIQERCPESQSGHQESEVLMRQMLPEEQLKCEFLLLKVYCDSKSCFFASEPYYNREGSQGPQKPMWLNKVKTSLNEQMYTRVEGFVQDMRLIFHNHKEFYREDKFTRLGIQVQDIFEKNFRNIFAIQETSKNIIMFI

SEQ ID NO: 82632 - protein, 480 aa, Homo sapiens
  Payload ID: 16444
  Gene Symbol: SP100
  Gene Name: SP100 nuclear antigen
  Uniprot ID: P23497
  ENSP ID: ENSP00000386404
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGKED

SEQ ID NO: 82633 - protein, 688 aa, Homo sapiens
  Payload ID: 16444
  Gene Symbol: SP100
  Gene Name: SP100 nuclear antigen
  Uniprot ID: P23497
  ENSP ID: ENSP00000386427
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGSQPQEPENKKCSCVMCFPKGVPRSQEARTESSQASDMMDTMDVENNSTLEKHSGKRRKKRRHRSKVNGLQRGRKKDRPRKHLTLNNKVQKKRWQQRGRKANTRPLKRRRKRGPRIPKDENINFKQSELPVTCGEVKGTLYKERFKQGTSKKCIQSEDKKWFTPREFEIEGDRGASKNWKLSIRCGGYTLKVLMENKFLPEPPSTRKKVMIK

SEQ ID NO: 82634 - protein, 445 aa, Homo sapiens
  Payload ID: 16444
  Gene Symbol: SP100
  Gene Name: SP100 nuclear antigen
  Uniprot ID: P23497
  ENSP ID: ENSP00000386998
MMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGKED

SEQ ID NO: 82635 - protein, 455 aa, Homo sapiens
  Payload ID: 16444
  Gene Symbol: SP100
  Gene Name: SP100 nuclear antigen
  ENSP ID: ENSP00000387311
MAGGGGDLSTRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGKED

SEQ ID NO: 82636 - protein, 192 aa, Homo sapiens
  Payload ID: 16444
  Gene Symbol: SP100
  Gene Name: SP100 nuclear antigen
  ENSP ID: ENSP00000391616
MAGGGGDLSTRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGCLGGFLPPTPLNHTCCWFLLP

SEQ ID NO: 82637 - protein, 259 aa, Homo sapiens
  Payload ID: 16444
  Gene Symbol: SP100
  Gene Name: SP100 nuclear antigen
  ENSP ID: ENSP00000393679
  MOD_RES (1)..(1): Any amino acid
XTLYKERFKQGTSKKCIQSEDKKWFTPREFEIEGDRGASKNWKLSIRCGGYTLKVLMERILESHNNTLVDPCPENSNICEVCNKWGRLFCCDTCPRSFHEHCHIPSVEANKNPWSCIFCRIKTIQERCPESQSGHQESEVLMRQMLPEEQLKCEFLLLKVYCDSKSCFFASEPYYNREGSQGPQKPMWLNKVKTSLNEQMYTRVEGFVQDMRLIFHNHKEFYREDKFTRLGIQVQDIFEKNFRNIFAIQETSKNIIMFI

SEQ ID NO: 82638 - protein, 452 aa, Homo sapiens
  Payload ID: 16444
  Gene Symbol: SP100
  Gene Name: SP100 nuclear antigen
  Uniprot ID: P23497
  ENSP ID: ENSP00000399389
MAGGGGDLSTRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHAPMTSRSTSTWRIPSRKRRFSSSDFSDLSNGEELQETCSSSLRRGSGKED

SEQ ID NO: 82639 - protein, 126 aa, Homo sapiens
  Payload ID: 16444
  Gene Symbol: SP100
  Gene Name: SP100 nuclear antigen
  ENSP ID: ENSP00000400277
  MOD_RES (1)..(1): Any amino acid
XISSEDSEGSTDVDEPLEVFISAPRSEPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGK

SEQ ID NO: 82640 - protein, 193 aa, Homo sapiens
  Payload ID: 16444
  Gene Symbol: SP100
  Gene Name: SP100 nuclear antigen
  ENSP ID: ENSP00000416563
DVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGVPRSQEARTESSQASDMMDTMDVENNSTLEKHSGKRRKKRRHRSKVNGLQR

SEQ ID NO: 82641 - protein, 713 aa, Homo sapiens
  Payload ID: 16445
  Gene Symbol: SP110
  Gene Name: SP110 nuclear body protein
  Uniprot ID: Q9HB58
  ENSP ID: ENSP00000258381
MFTMTRAMEEALFQHFMHQKLGIAYAIHKPFPFFEGLLDNSIITKRMYMESLEACRNLIPVSRVVHNILTQLERTFNLSLLVTLFSQINLREYPNLVTIYRSFKRVGASYEWQSRDTPILLEAPTGLAEGSSLHTPLALPPPQPPQPSCSPCAPRVSEPGTSSQQSDEILSESPSPSDPVLPLPALIQEGRSTSVTNDKLTSKMNAEEDSEEMPSLLTSTVQVASDNLIPQIRDKEDPQEMPHSPLGSMPEIRDNSPEPNDPEEPQEVSSTPSDKKGKKRKRCIWSTPKRRHKKKSLPGGTASSRHGIQKKLKRVDQVPQKKDDSTCNSTVETRAQKARTECARKSRSEEIIDGTSEMNEGKRSQKTPSTPRRVTQGAASPGHGIQEKLQVVDKVTQRKDDSTWNSEVMMRVQKARTKCARKSRLKEKKKEKDICSSSKRRFQKNIHRRGKPKSDTVDFHCSKLPVTCGEAKGILYKKKMKHGSSVKCIRNEDGTWLTPNEFEVEGKGRNAKNWKRNIRCEGMTLGELLKRKNSDECEVCCQGGQLLCCGTCPRVFHEDCHIPPVEAKRMLWSCTFCRMKRSSGSQQCHHVSKTLERQMQPQDQLKCEFLLLKAYCHPQSSFFTGIPFNIRDYGEPFQEAMWLDLVKERLITEMYTVAWFVRDMRLMFRNHKTFYKASDFGQVGLDLEAEFEKDLKDVLGFHEANDGGFWTLP

SEQ ID NO: 82642 - protein, 549 aa, Homo sapiens
  Payload ID: 16445
  Gene Symbol: SP110
  Gene Name: SP110 nuclear body protein
  Uniprot ID: Q9HB58
  ENSP ID: ENSP00000258382
MFTMTRAMEEALFQHFMHQKLGIAYAIHKPFPFFEGLLDNSIITKRMYMESLEACRNLIPVSRVVHNILTQLERTFNLSLLVTLFSQINLREYPNLVTIYRSFKRVGASYEWQSRDTPILLEAPTGLAEGSSLHTPLALPPPQPPQPSCSPCAPRVSEPGTSSQQSDEILSESPSPSDPVLPLPALIQEGRSTSVTNDKLTSKMNAEEDSEEMPSLLTSTVQVASDNLIPQIRDKEDPQEMPHSPLGSMPEIRDNSPEPNDPEEPQEVSSTPSDKKGKKRKRCIWSTPKRRHKKKSLPGGTASSRHGIQKKLKRVDQVPQKKDDSTCNSTVETRAQKARTECARKSRSEEIIDGTSEMNEGKRSQKTPSTPRRVTQGAASPGHGIQEKLQVVDKVTQRKDDSTWNSEVMMRVQKARTKCARKSRLKEKKKEKDICSSSKRRFQKNIHRRGKPKSDTVDFHCSKLPVTCGEAKGILYKKKMKHGSSVKCIRNEDGTWLTPNEFEVEGKGRNAKNWKRNIRCEGMTLGELLKSGLLLCPPRINLKRELNSK

SEQ ID NO: 82643 - protein, 689 aa, Homo sapiens
  Payload ID: 16445
  Gene Symbol: SP110
  Gene Name: SP110 nuclear body protein
  Uniprot ID: Q9HB58
  ENSP ID: ENSP00000351488
MFTMTRAMEEALFQHFMHQKLGIAYAIHKPFPFFEGLLDNSIITKRMYMESLEACRNLIPVSRVVHNILTQLERTFNLSLLVTLFSQINLREYPNLVTIYRSFKRVGASYEWQSRDTPILLEAPTGLAEGSSLHTPLALPPPQPPQPSCSPCAPRVSEPGTSSQQSDEILSESPSPSDPVLPLPALIQEGRSTSVTNDKLTSKMNAEEDSEEMPSLLTSTVQVASDNLIPQIRDKEDPQEMPHSPLGSMPEIRDNSPEPNDPEEPQEVSSTPSDKKGKKRKRCIWSTPKRRHKKKSLPGGTASSRHGIQKKLKRVDQVPQKKDDSTCNSTVETRAQKARTECARKSRSEEIIDGTSEMNEGKRSQKTPSTPRRVTQGAASPGHGIQEKLQVVDKVTQRKDDSTWNSEVMMRVQKARTKCARKSRLKEKKKEKDICSSSKRRFQKNIHRRGKPKSDTVDFHCSKLPVTCGEAKGILYKKKMKHGSSVKCIRNEDGTWLTPNEFEVEGKGRNAKNWKRNIRCEGMTLGELLKRKNSDECEVCCQGGQLLCCGTCPRVFHEDCHIPPVEAKRMLWSCTFCRMKRSSGSQQCHHVSKTLERQMQPQDQLIRDYGEPFQEAMWLDLVKERLITEMYTVAWFVRDMRLMFRNHKTFYKASDFGQVGLDLEAEFEKDLKDVLGFHEANDGGFWTLP

SEQ ID NO: 82644 - protein, 547 aa, Homo sapiens
  Payload ID: 16445
  Gene Symbol: SP110
  Gene Name: SP110 nuclear body protein
  ENSP ID: ENSP00000375902
MFTMTRAMEEALFQHFMHQKLGIAYAIHKPFPFFEGLLDNSIITKRMYMESLEACRNLIPVSRVVHNILTQLERTFNLSLLVTLFSQINLREYPNLVTIYRSFKRVGASYEWQSRDTPILLEAPTGLAEGSSLHTPLALPPPQPPQPSCSPCAPRVSEPGTSSQQSDEILSESPSPSDPVLPLPALIQEGRSTSVTNDKLTSKMNAEEDSEEMPSLLTSTVQVASDNLIPQIRDKEDPQEMPHSPLGSMPEIRDNSPEPNDPEEPQEVSSTPSDKKGKKRKRCIWSTPKRRHKKKSLPGASSRHGIQKKLKRVDQVPQKKDDSTCNSTVETRAQKARTECARKSRSEEIIDGTSEMNEGKRSQKTPSTPRRVTQGAASPGHGIQEKLQVVDKVTQRKDDSTWNSEVMMRVQKARTKCARKSRLKEKKKEKDICSSSKRRFQKNIHRRGKPKSDTVDFHCSKLPVTCGEAKGILYKKKMKHGSSVKCIRNEDGTWLTPNEFEVEGKGRNAKNWKRNIRCEGMTLGELLKSGLLLCPPRINLKRELNSK

SEQ ID NO: 82645 - protein, 221 aa, Homo sapiens
  Payload ID: 16445
  Gene Symbol: SP110
  Gene Name: SP110 nuclear body protein
  ENSP ID: ENSP00000387172
MFTMTRAMEEALFQHFMHQKLGIAYAIHKPFPFFEGLLDNSIITKRMYMESLEACRNLIPVSRVVHNILTQLERTFNLSLLVTLFSQINLREYPNLVTIYRSFKRVGASYEWQSRDTPILLEAPTGLAEGSSLHTPLALPPPQPPQPSCSPCAPRVSEPGTSSQQSDEILSESPSPSDPVLPLPALIQEGRSTSVTNDKLTSKMNAEEDSEEMPSLLTSTV

SEQ ID NO: 82646 - protein, 160 aa, Homo sapiens
  Payload ID: 16445
  Gene Symbol: SP110
  Gene Name: SP110 nuclear body protein
  ENSP ID: ENSP00000393992
MYMESLEACRNLIPVSRVVHNILTQLERTFNLSLLVTLFSQINLREYPNLVTIYRSFKRVGASYEWQSRDTPILLEAPTGLAEGSSLHTPLALPPPQPPQPSCSPCAPRVSEPGTSSQQSDEILSESPSPSDPVLPLPALIQEGRSTSVTNDKLTSKMNA

SEQ ID NO: 82647 - protein, 101 aa, Homo sapiens
  Payload ID: 16445
  Gene Symbol: SP110
  Gene Name: SP110 nuclear body protein
  ENSP ID: ENSP00000399978
MFTMTRAMEEALFQHFMHQKLGIAYAIHKPFPFFEGLLDNSIITKRMYMESLEACRNLIPVSRVVHNILTQLERTFNLSLLVTLFSQINLREYPNLVTIYR

SEQ ID NO: 82648 - protein, 807 aa, Homo sapiens
  Payload ID: 16446
  Gene Symbol: SP140
  Gene Name: SP140 nuclear body protein
  Uniprot ID: Q13342
  ENSP ID: ENSP00000342096
MAQQGQQGQMASGDSNLNFRMVAEIQNVEGQNLQEQVCPEPIFRFFRENKVEIASAITRPFPFLMGLRDRSFISEQMYEHFQEAFRNLVPVTRVMYCVLSELEKTFGWSHLEALFSRINLMAYPDLNEIYRSFQNVCYEHSPLQMNNVNDLEDRPRLLPYGKQENSNACHEMDDIAVPQEALSSSPRCEPGFSSESCEQLALPKAGGGDAEDAPSLLPGGGVLESNGMIDAARTYSTAPGEKQGEEEGRNSPRKRNQDKEKYQESPEGRDKETFDLKTPQVTNEGEPEKGLCLLPGEGEEGSDDCSEMCDGEEPQEASSSLARCGSEGSDDCSEMCDGEERQEASSSLARRGSVSSELENHPMNEEGESEELASSLLYDNVPGAEQSAYENEKCSCVMCFSEEVPGSPEARTESDQACGTMDTVDIANNSTLGKPKRKRRKKRGHGWSRMRMRRQENSQQNDNSKADGQVVSSEKKANVNLKDLSKIRGRKRGKPGTRFTQSDRAAQKRVRSRASRKHKDETVDFKAPLLPVTCGGVKGILHKKKLQQGILVKCIQTEDGKWFTPTEFEIKGGHARSKNWRLSVRCGGWPLRWLMENGFLPDPPRIRYRKKKRILKSQNNSSVDPCMRNLDECEVCRDGGELFCCDTCSRVFHEDCHIPPVEAERTPWNCIFCRMKESPGSQQCCQESEVLERQMCPEEQLKCEFLLLKVYCCSESSFFAKIPYYYYIREACQGLKEPMWLDKIKKRLNEHGYPQVEGFVQDMRLIFQNHRASYKYKDFGQMGFRLEAEFEKNFKEVFAIQETNGNN

SEQ ID NO: 82649 - protein, 172 aa, Homo sapiens
  Payload ID: 16446
  Gene Symbol: SP140
  Gene Name: SP140 nuclear body protein
  Uniprot ID: Q13342
  ENSP ID: ENSP00000362749
MAQQGQQGQMASGDSNLNFRMVAEIQNVEGQNLQEQVCPEPIFRFFRENKVEIASAITRPFPFLMGLRDRSFISEQMYEHFQEAFRNLVPVTRVMYCVLSELEKTFGWSHLEALFSRINLMAYPDLNEIYRSFQNENLSSSAVLCQLVSPNKDWRSHEESLAHTGTLRRSCM

SEQ ID NO: 82650 - protein, 867 aa, Homo sapiens
  Payload ID: 16446
  Gene Symbol: SP140
  Gene Name: SP140 nuclear body protein
  Uniprot ID: Q13342
  ENSP ID: ENSP00000375899
MAQQGQQGQMASGDSNLNFRMVAEIQNVEGQNLQEQVCPEPIFRFFRENKVEIASAITRPFPFLMGLRDRSFISEQMYEHFQEAFRNLVPVTRVMYCVLSELEKTFGWSHLEALFSRINLMAYPDLNEIYRSFQNVCYEHSPLQMNNVNDLEDRPRLLPYGKQENSNACHEMDDIAVPQEALSSSPRCEPGFSSESCEQLALPKAGGGDAEDAPSLLPGGGVSCKLAIQIDEGESEEMPKLLPYDTEVLESNGMIDAARTYSTAPGEKQGEEEGRNSPRKRNQDKEKYQESPEGRDKETFDLKTPQVTNEGEPEKGLCLLPGEGEEGSDDCSEMCDGEEPQEASSSLARCGSVSCLSAETFDLKTPQVTNEGEPEKELSLLPGEGEEGSDDCSEMCDGEERQEASSSLARRGSVSSELENHPMNEEGESEELASSLLYDNVPGAEQSAYENEKCSCVMCFSEEVPGSPEARTESDQACGTMDTVDIANNSTLGKPKRKRRKKRGHGWSRMRMRRQENSQQNDNSKADGQVVSSEKKANVNLKDLSKIRGRKRGKPGTRFTQSDRAAQKRVRSRASRKHKDETVDFKAPLLPVTCGGVKGILHKKKLQQGILVKCIQTEDGKWFTPTEFEIKGGHARSKNWRLSVRCGGWPLRWLMENGFLPDPPRIRYRKKKRILKSQNNSSVDPCMRNLDECEVCRDGGELFCCDTCSRVFHEDCHIPPVEAERTPWNCIFCRMKESPGSQQCCQESEVLERQMCPEEQLKCEFLLLKVYCCSESSFFAKIPYYYYIREACQGLKEPMWLDKIKKRLNEHGYPQVEGFVQDMRLIFQNHRASYKYKDFGQMGFRLEAEFEKNFKEVFAIQETNGNN

SEQ ID NO: 82651 - protein, 753 aa, Homo sapiens
  Payload ID: 16446
  Gene Symbol: SP140
  Gene Name: SP140 nuclear body protein
  Uniprot ID: Q13342
  ENSP ID: ENSP00000393618
MAQQGQQGQMASGDSNLNFRMVAEIQNVEGQNLQEQVCPEPIFRFFRENKVEIASAITRPFPFLMGLRDRSFISEQMYEHFQEAFRNLVPVTRVMYCVLSELEKTFGWSHLEALFSRINLMAYPDLNEIYRSFQNVCYEHSPLQMNNVNDLEDRPRLLPYGKQENSNACHEMDDIAVPQEALSSSPRCEPGFSSESCEQLALPKAGGGDAEDAPSLLPVSCKLAIQIDEGESEEMPKLLPYDTEETFDLKTPQVTNEGEPEKGLCLLPGEGEEGSDDCSEMCDGEERQEASSSLARRGSVSSELENHPMNEEGESEELASSLLYDNVPGAEQSAYENEKCSCVMCFSEEVPGSPEARTESDQACGTMDTVDIANNSTLGKPKRKRRKKRGHGWSRMRMRRQENSQQNDNSKADGQVVSSEKKANVNLKDLSKIRGRKRGKPGTRFTQSDRAAQKRVRSRASRKHKDETVDFKAPLLPVTCGGVKGILHKKKLQQGILVKCIQTEDGKWFTPTEFEIKGGHARSKNWRLSVRCGGWPLRWLMENGFLPDPPRIRYRKKKRILKSQNNSSVDPCMRNLDECEVCRDGGELFCCDTCSRVFHEDCHIPPVEAERTPWNCIFCRMKESPGSQQCCQESEVLERQMCPEEQLKCEFLLLKVYCCSESSFFAKIPYYYYIREACQGLKEPMWLDKIKKRLNEHGYPQVEGFVQDMRLIFQNHRASYKYKDFGQMGFRLEAEFEKNFKEVFAIQETNGNN

SEQ ID NO: 82652 - protein, 840 aa, Homo sapiens
  Payload ID: 16446
  Gene Symbol: SP140
  Gene Name: SP140 nuclear body protein
  Uniprot ID: Q13342
  ENSP ID: ENSP00000398210
MAQQGQQGQMASGDSNLNFRMVAEIQNVEGQNLQEQVCPEPIFRFFRENKVEIASAITRPFPFLMGLRDRSFISEQMYEHFQEAFRNLVPVTRVMYCVLSELEKTFGWSHLEALFSRINLMAYPDLNEIYRSFQNVCYEHSPLQMNNVNDLEDRPRLLPYGKQENSNACHEMDDIAVPQEALSSSPRCEPGFSSESCEQLALPKAGGGDAEDAPSLLPGGGVSCKLAIQIDEGESEEMPKLLPYDTEVLESNGMIDAARTYSTAPGEKQGEEEGRNSPRKRNQDKEKYQESPEGRDKETFDLKTPQVTNEGEPEKGLCLLPGEGEEGSDDCSEMCDGEEPQEASSSLARCGSVSCLSAETFDLKTPQVTNEGEPEKELSLLPGEGEVSSELENHPMNEEGESEELASSLLYDNVPGAEQSAYENEKCSCVMCFSEEVPGSPEARTESDQACGTMDTVDIANNSTLGKPKRKRRKKRGHGWSRMRMRRQENSQQNDNSKADGQVVSSEKKANVNLKDLSKIRGRKRGKPGTRFTQSDRAAQKRVRSRASRKHKDETVDFKAPLLPVTCGGVKGILHKKKLQQGILVKCIQTEDGKWFTPTEFEIKGGHARSKNWRLSVRCGGWPLRWLMENGFLPDPPRIRYRKKKRILKSQNNSSVDPCMRNLDECEVCRDGGELFCCDTCSRVFHEDCHIPPVEAERTPWNCIFCRMKESPGSQQCCQESEVLERQMCPEEQLKCEFLLLKVYCCSESSFFAKIPYYYYIREACQGLKEPMWLDKIKKRLNEHGYPQVEGFVQDMRLIFQNHRASYKYKDFGQMGFRLEAEFEKNFKEVFAIQETNGNN

SEQ ID NO: 82653 - protein, 29 aa, Homo sapiens
  Payload ID: 16446
  Gene Symbol: SP140
  Gene Name: SP140 nuclear body protein
  ENSP ID: ENSP00000475284
MAQQGQQGQMASGDSNLNFRFPQMLWSVV

SEQ ID NO: 82654 - protein, 555 aa, Homo sapiens
  Payload ID: 16447
  Gene Symbol: SP140L
  Gene Name: SP140 nuclear body protein-like
  ENSP ID: ENSP00000243810
MAGGGSDLSTRLFTEDQDVDEGLVYDTVFKHFKRHKLEISNAIKKTFPFLEGLRDRELITNKMFEDSEDSCRNLVPVQRVVYNVLSELEKTFNLSVLEALFSEVNMQEYPDLIHIYKSFKNAIQDKLSFQESDRKEREERPDIKLSLKQGEVPESPEARKESDQACGKMDTVDIANNSTLGKPKRKRRKKKGHGWSRMGTRTQKNNQQNDNSKADGQLVSSEKKANMNLKDLSKIRGRKRGKPGTHFTQSDRAPQKRVRSRASRKHKDETVDFQAPLLPVTCGGVKGILHKEKLEQGTLAKCIQTEDGKWFTPMEFEIKGGYARSKNWRLSVRCGGWPLRRLMEEGSLPNPPRIYYRNKKRILKSQNNSSVDPCMRNLDECEVCRDGGELFCCDTCSRVFHEDCHIPPVESEKTPWNCIFCRMKESPGSQQCCQESEVLERQMCPEEQLKCEFLLLKVYCCSESSFFAKIPYYYYIREACQGLKEPMWLDKIKKRLNEHGYPQVEGFVQDMRLIFQNHRASYKYKDFGQMGLRLEAEFEKDFKEVFAIQETNGNS

SEQ ID NO: 82655 - protein, 520 aa, Homo sapiens
  Payload ID: 16447
  Gene Symbol: SP140L
  Gene Name: SP140 nuclear body protein-like
  ENSP ID: ENSP00000379811
MAGGGSDLSTRLFTEDQDVDEGLVYDTVFKHFKRHKLEISNAIKKTFPFLEGLRDRELITNKMFEDSEDSCRNLVPVQRVVYNVLSELEKTFNLSVLEALFSEVNMQEYPDLIHIYKSFKNAIQDKLSFQESDRKEREERPDIKLSLKQGEVPESPEARKESDQACGKMDTVDIANNSTLGKPKRKRRKKKGHGWSRMGTRTQKNNQQNDNSKADGQLVSSEKKANMNLKDLSKIRGRKRGKPGTHFTQSDRAPQKRVRSRGTLAKCIQTEDGKWFTPMEFEIKGGYARSKNWRLSVRCGGWPLRRLMEEGSLPNPPRIYYRNKKRILKSQNNSSVDPCMRNLDECEVCRDGGELFCCDTCSRVFHEDCHIPPVESEKTPWNCIFCRMKESPGSQQCCQESEVLERQMCPEEQLKCEFLLLKVYCCSESSFFAKIPYYYYIREACQGLKEPMWLDKIKKRLNEHGYPQVEGFVQDMRLIFQNHRASYKYKDFGQMGLRLEAEFEKDFKEVFAIQETNGNS

SEQ ID NO: 82656 - protein, 438 aa, Homo sapiens
  Payload ID: 16447
  Gene Symbol: SP140L
  Gene Name: SP140 nuclear body protein-like
  Uniprot ID: Q9H930
  ENSP ID: ENSP00000395195
MAGGGSDLSTRGLNGGVSQVANEMNHLPAHSQSLQRLFTEDQDVDEGLVYDTVFKHFKRHKLEISNAIKKTFPFLEGLRDRELITNKMFEDSEDSCRNLVPVQRVVYNVLSELEKTFNLSVLEALFSEVNMQEYPDLIHIYKSFKNAIQDKLSFQESDRKEREERPDIKLSLKQGEVPESPEARKESDQACGKMDTVDIANNSTLGKPKRKRRKKKGHGWSRMGTRTQKNNQQNDNSKADGQLVSSEKKANMNLKDLSKIRGRKRGKPGTHFTQSDRAPQKRVRSRASRKHKDETVDFQAPLLPVTCGGVKGILHKEKLEQGTLAKCIQTEDGKWFTPMEFEIKGGYARSKNWRLSVRCGGWPLRRLMEEGSLPNPPRIYYRNKKRILKSQNNSSVDPCMRNLDECEVCRDGGELFCCDTCSRVFHEDCHIPPVESEK

SEQ ID NO: 82657 - protein, 129 aa, Homo sapiens
  Payload ID: 16447
  Gene Symbol: SP140L
  Gene Name: SP140 nuclear body protein-like
  Uniprot ID: Q9H930
  ENSP ID: ENSP00000395223
MFEDSEDSCRNLVPVQRVVYNVLSELEKTFNLSVLEALFSEVNMQEYPDLIHIYKSFKNAIQDKLSFQESDRKEREERPDIKLSLKQGEVPESPEARKESDQACGKMDTVDIANNSTLGKPKRKRSKNK

SEQ ID NO: 82658 - protein, 580 aa, Homo sapiens
  Payload ID: 16447
  Gene Symbol: SP140L
  Gene Name: SP140 nuclear body protein-like
  Uniprot ID: Q9H930
  ENSP ID: ENSP00000397911
MAGGGSDLSTRGLNGGVSQVANEMNHLPAHSQSLQRLFTEDQDVDEGLVYDTVFKHFKRHKLEISNAIKKTFPFLEGLRDRELITNKMFEDSEDSCRNLVPVQRVVYNVLSELEKTFNLSVLEALFSEVNMQEYPDLIHIYKSFKNAIQDKLSFQESDRKEREERPDIKLSLKQGEVPESPEARKESDQACGKMDTVDIANNSTLGKPKRKRRKKKGHGWSRMGTRTQKNNQQNDNSKADGQLVSSEKKANMNLKDLSKIRGRKRGKPGTHFTQSDRAPQKRVRSRASRKHKDETVDFQAPLLPVTCGGVKGILHKEKLEQGTLAKCIQTEDGKWFTPMEFEIKGGYARSKNWRLSVRCGGWPLRRLMEEGSLPNPPRIYYRNKKRILKSQNNSSVDPCMRNLDECEVCRDGGELFCCDTCSRVFHEDCHIPPVESEKTPWNCIFCRMKESPGSQQCCQESEVLERQMCPEEQLKCEFLLLKVYCCSESSFFAKIPYYYYIREACQGLKEPMWLDKIKKRLNEHGYPQVEGFVQDMRLIFQNHRASYKYKDFGQMGLRLEAEFEKDFKEVFAIQETNGNS

SEQ ID NO: 82659 - protein, 613 aa, Homo sapiens
  Payload ID: 16448
  Gene Symbol: SP2
  Gene Name: Sp2 transcription factor
  Uniprot ID: Q02086
  ENSP ID: ENSP00000365931
MSDPQTSMAATAAVSPSDYLQPAASTTQDSQPSPLALLAATCSKIGPPAVEAAVTPPAPPQPTPRKLVPIKPAPLPLSPGKNSFGILSSKGNILQIQGSQLSASYPGGQLVFAIQNPTMINKGTRSNANIQYQAVPQIQASNSQTIQVQPNLTNQIQIIPGTNQAIITPSPSSHKPVPIKPAPIQKSSTTTTPVQSGANVVKLTGGGGNVTLTLPVNNLVNASDTGAPTQLLTESPPTPLSKTNKKARKKSLPASQPPVAVAEQVETVLIETTADNIIQAGNNLLIVQSPGGGQPAVVQQVQVVPPKAEQQQVVQIPQQALRVVQAASATLPTVPQKPSQNFQIQAAEPTPTQVYIRTPSGEVQTVLVQDSPPATAAATSNTTCSSPASRAPHLSGTSKKHSAAILRKERPLPKIAPAGSIISLNAAQLAAAAQAMQTININGVQVQGVPVTITNTGGQQQLTVQNVSGNNLTISGLSPTQIQLQMEQALAGETQPGEKRRRMACTCPNCKDGEKRSGEQGKKKHVCHIPDCGKTFRKTSLLRAHVRLHTGERPFVCNWFFCGKRFTRSDELQRHARTHTGDKRFECAQCQKRFMRSDHLTKHYKTHLVTKNL

SEQ ID NO: 82660 - protein, 249 aa, Homo sapiens
  Payload ID: 16448
  Gene Symbol: SP2
  Gene Name: Sp2 transcription factor
  ENSP ID: ENSP00000484898
MAATAAVSPSDYLQPAASTTQDSQPSPLALLAATCSKIGPPAVEAAVTPPAPPQPTPRKLVPIKPAPLPLSPGKNSFGILSSKGNILQIQGSQLSASYPGGQLVFAIQNPTMINKGTRSNANIQYQAVPQIQASNSQTIQVQPNLTNQIQIIPGTNQAIITPSPSSHKPVPIKPAPIQKSSTTTTPVQSGANVVKLTGGGGNVTLTLPVNNLVNASDTGAPTQLLTASCQTGMLNSTRMFLFLAFINVL

SEQ ID NO: 82661 - protein, 781 aa, Homo sapiens
  Payload ID: 16449
  Gene Symbol: SP3
  Gene Name: Sp3 transcription factor
  Uniprot ID: Q02447
  ENSP ID: ENSP00000310301
MTAPEKPVKQEEMAALDVDSGGGGGGGGGHGEYLQQQQQHGNGAVAAAAAAQDTQPSPLALLAATCSKIGPPSPGDDEEEAAAAAGAPAAAGATGDLASAQLGGAPNRWEVLSATPTTIKDEAGNLVQIPSAATSSGQYVLPLQNLQNQQIFSVAPGSDSSNGTVSSVQYQVIPQIQSADGQQVQIGFTGSSDNGGINQESSQIQIIPGSNQTLLASGTPSANIQNLIPQTGQVQVQGVAIGGSSFPGQTQVVANVPLGLPGNITFVPINSVDLDSLGLSGSSQTMTAGINADGHLINTGQAMDSSDNSERTGERVSPDINETNTDTDLFVPTSSSSQLPVTIDSTGILQQNTNSLTTSSGQVHSSDLQGNYIQSPVSEETQAQNIQVSTAQPVVQHLQLQESQQPTSQAQIVQGITPQTIHGVQASGQNISQQALQNLQLQLNPGTFLIQAQTVTPSGQVTWQTFQVQGVQNLQNLQIQNTAAQQITLTPVQTLTLGQVAAGGAFTSTPVSLSTGQLPNLQTVTVNSIDSAGIQLHPGENADSPADIRIKEEEPDPEEWQLSGDSTLNTNDLTHLRVQVVDEEGDQQHQEGKRLRRVACTCPNCKEGGGRGTNLGKKKQHICHIPGCGKVYGKTSHLRAHLRWHSGERPFVCNWMYCGKRFTRSDELQRHRRTHTGEKKFVCPECSKRFMRSDHLAKHIKTHQNKKGIHSSSTVLASVEAARDDTLITAGGTTLILANIQQGSVSGIGTVNTSATSNQDILTNTEIPLQLVTVSGNETME

SEQ ID NO: 82662 - protein, 713 aa, Homo sapiens
  Payload ID: 16449
  Gene Symbol: SP3
  Gene Name: Sp3 transcription factor
  ENSP ID: ENSP00000406140
IGPPSPGDDEEEAAAAAGAPAAAGATGDLASAQLGGAPNRWEVLSATPTTIKDEAGNLVQIPSAATSSGQYVLPLQNLQNQQIFSVAPGSDSSNGTVSSVQYQVIPQIQSADGQQVQIGFTGSSDNGGINQESSQIQIIPGSNQTLLASGTPSANIQNLIPQTGQVQVQGVAIGGSSFPGQTQVVANVPLGLPGNITFVPINSVDLDSLGLSGSSQTMTAGINADGHLINTGQAMDSSDNSERTGERVSPDINETNTDTDLFVPTSSSSQLPVTIDSTGILQQNTNSLTTSSGQVHSSDLQGNYIQSPVSEETQAQNIQVSTAQPVVQHLQLQESQQPTSQAQIVQGITPQTIHGVQASGQNISQQALQNLQLQLNPGTFLIQAQTVTPSGQVTWQTFQVQGVQNLQNLQIQNTAAQQITLTPVQTLTLGQVAAGGAFTSTPVSLSTGQLPNLQTVTVNSIDSAGIQLHPGENADSPADIRIKEEEPDPEEWQLSGDSTLNTNDLTHLRVQVVDEEGDQQHQEGKRLRRVACTCPNCKEGGGRGTNLGKKKQHICHIPGCGKVYGKTSHLRAHLRWHSGERPFVCNWMYCGKRFTRSDELQRHRRTHTGEKKFVCPECSKRFMRSDHLAKHIKTHQNKKGIHSSSTVLASVEAARDDTLITAGGTTLILANIQQGSVSGIGTVNTSATSNQDILTNTEIPLQLVTVSGNETME

SEQ ID NO: 82663 - protein, 738 aa, Homo sapiens
  Payload ID: 16449
  Gene Symbol: SP3
  Gene Name: Sp3 transcription factor
  ENSP ID: ENSP00000413665
  MOD_RES (1)..(1): Any amino acid
XPEKPVKQEEMAALDVDSGGGGGGGGGHGEYLQQQQQHGNGAVAAAAAAQTGDLASAQLGGAPNRWEVLSATPTTIKDEAGNLVQIPSAATSSGQYVLPLQNLQNQQIFSVAPGSDSSNGTVSSVQYQVIPQIQSADGQQVQIGFTGSSDNGGINQESSQIQIIPGSNQTLLASGTPSANIQNLIPQTGQVQVQGVAIGGSSFPGQTQVVANVPLGLPGNITFVPINSVDLDSLGLSGSSQTMTAGINADGHLINTGQAMDSSDNSERTGERVSPDINETNTDTDLFVPTSSSSQLPVTIDSTGILQQNTNSLTTSSGQVHSSDLQGNYIQSPVSEETQAQNIQVSTAQPVVQHLQLQESQQPTSQAQIVQGITPQTIHGVQASGQNISQQALQNLQLQLNPGTFLIQAQTVTPSGQVTWQTFQVQGVQNLQNLQIQNTAAQQITLTPVQTLTLGQVAAGGAFTSTPVSLSTGQLPNLQTVTVNSIDSAGIQLHPGENADSPADIRIKEEEPDPEEWQLSGDSTLNTNDLTHLRVQVVDEEGDQQHQEGKRLRRVACTCPNCKEGGGRGTNLGKKKQHICHIPGCGKVYGKTSHLRAHLRWHSGERPFVCNWMYCGKRFTRSDELQRHRRTHTGEKKFVCPECSKRFMRSDHLAKHIKTHQNKKGIHSSSTVLASVEAARDDTLITAGGTTLILANIQQGSVSGIGTVNTSATSNQDILTNTEIPLQLVTVSGNETME

SEQ ID NO: 82664 - protein, 784 aa, Homo sapiens
  Payload ID: 16450
  Gene Symbol: SP4
  Gene Name: Sp4 transcription factor
  Uniprot ID: Q02446
  ENSP ID: ENSP00000222584
MSDQKKEEEEEAAAAAAMATEGGKTSEPENNNKKPKTSGSQDSQPSPLALLAATCSKIGTPGENQATGQQQIIIDPSQGLVQLQNQPQQLELVTTQLAGNAWQLVASTPPASKENNVSQPASSSSSSSSSNNGSASPTKTKSGNSSTPGQFQVIQVQNPSGSVQYQVIPQLQTVEGQQIQINPTSSSSLQDLQGQIQLISAGNNQAILTAANRTASGNILAQNLANQTVPVQIRPGVSIPLQLQTLPGTQAQVVTTLPINIGGVTLALPVINNVAAGGGTGQVGQPAATADSGTSNGNQLVSTPTNTTTSASTMPESPSSSTTCTTTASTSLTSSDTLVSSADTGQYASTSASSSERTIEESQTPAATESEAQSSSQLQPNGMQNAQDQSNSLQQVQIVGQPILQQIQIQQPQQQIIQAIPPQSFQLQSGQTIQTIQQQPLQNVQLQAVNPTQVLIRAPTLTPSGQISWQTVQVQNIQSLSNLQVQNAGLSQQLTITPVSSSGGTTLAQIAPVAVAGAPITLNTAQLASVPNLQTVSVANLGAAGVQVQGVPVTITSVAGQQQGQDGVKVQQATIAPVTVAVGGIANATIGAVSPDQLTQVHLQQGQQTSDQEVQPGKRLRRVACSCPNCREGEGRGSNEPGKKKQHICHIEGCGKVYGKTSHLRAHLRWHTGERPFICNWMFCGKRFTRSDELQRHRRTHTGEKRFECPECSKRFMRSDHLSKHVKTHQNKKGGGTALAIVTSGELDSSVTEVLGSPRIVTVAAISQDSNPATPNVSTNMEEF

SEQ ID NO: 82665 - protein, 49 aa, Homo sapiens
  Payload ID: 16450
  Gene Symbol: SP4
  Gene Name: Sp4 transcription factor
  ENSP ID: ENSP00000390817
MSDQKKEEEEEAAAAAAMATEGGKTSEPENNNKKPKTSGSQVSSKDKME

SEQ ID NO: 82666 - protein, 56 aa, Homo sapiens
  Payload ID: 16450
  Gene Symbol: SP4
  Gene Name: Sp4 transcription factor
  ENSP ID: ENSP00000393623
MSGQQQGQDGVKVQQATIAPVTVAVGGIANATIGAVSPDQLTQVHLQQGQQTSDQE

SEQ ID NO: 82667 - protein, 398 aa, Homo sapiens
  Payload ID: 16451
  Gene Symbol: SP5
  Gene Name: Sp5 transcription factor
  Uniprot ID: Q6BEB4
  ENSP ID: ENSP00000364430
MAAVAVLRNDSLQAFLQDRTPSASPDLGKHSPLALLAATCSRIGQPGAAAPPDFLQVPYDPALGSPSRLFHPWTADMPAHSPGALPPPHPSLGLTPQKTHLQPSFGAAHELPLTPPADPSYPYEFSPVKMLPSSMAALPASCAPAYVPYAAQAALPPGYSNLLPPPPPPPPPPTCRQLSPNPAPDDLPWWSIPQAGAGPGASGVPGSGLSGACAGAPHAPRFPASAAAAAAAAAALQRGLVLGPSDFAQYQSQIAALLQTKAPLAATARRCRRCRCPNCQAAGGAPEAEPGKKKQHVCHVPGCGKVYGKTSHLKAHLRWHTGERPFVCNWLFCGKSFTRSDELQRHLRTHTGEKRFACPECGKRFMRSDHLAKHVKTHQNKKLKVAEAGVKREDARDL

SEQ ID NO: 82668 - protein, 376 aa, Homo sapiens
  Payload ID: 16452
  Gene Symbol: SP6
  Gene Name: Sp6 transcription factor
  Uniprot ID: Q3SY56
  ENSP ID: ENSP00000340799
MLTAVCGSLGSQHTEAPHASPPRLDLQPLQTYQGHTSPEAGDYPSPLQPGELQSLPLGPEVDFSQGYELPGASSRVTCEDLESDSPLAPGPFSKLLQPDMSHHYESWFRPTHPGAEDGSWWDLHPGTSWMDLPHTQGALTSPGHPGALQAGLGGYVGDHQLCAPPPHPHAHHLLPAAGGQHLLGPPDGAKALEVAAPESQGLDSSLDGAARPKGSRRSVPRSSGQTVCRCPNCLEAERLGAPCGPDGGKKKHLHNCHIPGCGKAYAKTSHLKAHLRWHSGDRPFVCNWLFCGKRFTRSDELQRHLQTHTGTKKFPCAVCSRVFMRSDHLAKHMKTHEGAKEEAAGAASGEGKAGGAVEPPGGKGKREAEGSVAPSN

SEQ ID NO: 82669 - protein, 376 aa, Homo sapiens; identical to SEQ ID NO: 82668
  Payload ID: 16452
  Gene Symbol: SP6
  Gene Name: Sp6 transcription factor
  Uniprot ID: Q3SY56
  ENSP ID: ENSP00000438209

SEQ ID NO: 82670 - protein, 431 aa, Homo sapiens
  Payload ID: 16453
  Gene Symbol: SP7
  Gene Name: Sp7 transcription factor
  Uniprot ID: Q8TDD2
  ENSP ID: ENSP00000302812
MASSLLEEEVHYGSSPLAMLTAACSKFGGSSPLRDSTTLGKAGTKKPYSVGSDLSASKTMGDAYPAPFTSTNGLLSPAGSPPAPTSGYANDYPPFSHSFPGPTGTQDPGLLVPKGHSSSDCLPSVYTSLDMTHPYGSWYKAGIHAGISPGPGNTPTPWWDMHPGGNWLGGGQGQGDGLQGTLPTGPAQPPLNPQLPTYPSDFAPLNPAPYPAPHLLQPGPQHVLPQDVYKPKAVGNSGQLEGSGGAKPPRGASTGGSGGYGGSGAGRSSCDCPNCQELERLGAAAAGLRKKPIHSCHIPGCGKVYGKASHLKAHLRWHTGERPFVCNWLFCGKRFTRSDELERHVRTHTREKKFTCLLCSKRFTRSDHLSKHQRTHGEPGPGPPPSGPKELGEGRSTGEEEASQTPRPSASPATPEKAPGGSPEQSNLLEI

SEQ ID NO: 82671 - protein, 413 aa, Homo sapiens
  Payload ID: 16453
  Gene Symbol: SP7
  Gene Name: Sp7 transcription factor
  Uniprot ID: Q8TDD2
  ENSP ID: ENSP00000441367
MLTAACSKFGGSSPLRDSTTLGKAGTKKPYSVGSDLSASKTMGDAYPAPFTSTNGLLSPAGSPPAPTSGYANDYPPFSHSFPGPTGTQDPGLLVPKGHSSSDCLPSVYTSLDMTHPYGSWYKAGIHAGISPGPGNTPTPWWDMHPGGNWLGGGQGQGDGLQGTLPTGPAQPPLNPQLPTYPSDFAPLNPAPYPAPHLLQPGPQHVLPQDVYKPKAVGNSGQLEGSGGAKPPRGASTGGSGGYGGSGAGRSSCDCPNCQELERLGAAAAGLRKKPIHSCHIPGCGKVYGKASHLKAHLRWHTGERPFVCNWLFCGKRFTRSDELERHVRTHTREKKFTCLLCSKRFTRSDHLSKHQRTHGEPGPGPPPSGPKELGEGRSTGEEEASQTPRPSASPATPEKAPGGSPEQSNLLEI

SEQ ID NO: 82672 - protein, 431 aa, Homo sapiens; identical to SEQ ID NO: 82670
  Payload ID: 16453
  Gene Symbol: SP7
  Gene Name: Sp7 transcription factor
  Uniprot ID: Q8TDD2
  ENSP ID: ENSP00000443827

SEQ ID NO: 82673 - protein, 269 aa, Homo sapiens
  Payload ID: 16453
  Gene Symbol: SP7
  Gene Name: Sp7 transcription factor
  ENSP ID: ENSP00000449355
MLTAACSKFGGSSPLRDSTTLGKAGTKKPYSVGSDLSASKTMGDAYPAPFTSTNGLLSPAGSPPAPTSGYANDYPPFSHSFPGPTGTQDPGLLVPKGHSSSDCLPSVYTSLDMTHPYGSWYKAGIHAGISPGPGNTPTPWWDMHPGGNWLGGGQGQGDGLQGTLPTGPAQPPLNPQLPTYPSDFAPLNPAPYPAPHLLQPGPQHVLPQDVYKPKAVGNSGQLEGSGGAKPPRGASTGGSGGYGGSGAGRSSCDCPNCQELERLGAAAAG

SEQ ID NO: 82674 - protein, 490 aa, Homo sapiens
  Payload ID: 16454
  Gene Symbol: SP8
  Gene Name: Sp8 transcription factor
  Uniprot ID: Q8IXZ3
  ENSP ID: ENSP00000354482
MLAATCNKIGSPSPSPSSLSDSSSSFGKGFHPWKRSSSSSSASCNVVGSSLSSFGVSGASRNGGSSSAAAAAAAAAAAAAALVSDSFSCGGSPGSSAFSLTSSSAAAAAAAAAAAASSSPFANDYSVFQAPGVSGGSGGGGGGGGGGSSAHSQDGSHQPVFISKVHTSVDGLQGIYPRVGMAHPYESWFKPSHPGLGAAGEVGSAGASSWWDVGAGWIDVQNPNSAAALPGSLHPAAGGLQTSLHSPLGGYNSDYSGLSHSAFSSGASSHLLSPAGQHLMDGFKPVLPGSYPDSAPSPLAGAGGSMLSAGPSAPLGGSPRSSARRYSGRATCDCPNCQEAERLGPAGASLRRKGLHSCHIPGCGKVYGKTSHLKAHLRWHTGERPFVCNWLFCGKRFTRSDELQRHLRTHTGEKRFACPVCNKRFMRSDHLSKHVKTHSGGGGGGGSAGSGSGGKKGSDTDSEHSAAGSPPCHSPELLQPPEPGHRNGLE

SEQ ID NO: 82675 - protein, 508 aa, Homo sapiens
  Payload ID: 16454
  Gene Symbol: SP8
  Gene Name: Sp8 transcription factor
  Uniprot ID: Q8IXZ3
  ENSP ID: ENSP00000408792
MATSLLGEEPRLGSTPLAMLAATCNKIGSPSPSPSSLSDSSSSFGKGFHPWKRSSSSSSASCNVVGSSLSSFGVSGASRNGGSSSAAAAAAAAAAAAAALVSDSFSCGGSPGSSAFSLTSSSAAAAAAAAAAAASSSPFANDYSVFQAPGVSGGSGGGGGGGGGGSSAHSQDGSHQPVFISKVHTSVDGLQGIYPRVGMAHPYESWFKPSHPGLGAAGEVGSAGASSWWDVGAGWIDVQNPNSAAALPGSLHPAAGGLQTSLHSPLGGYNSDYSGLSHSAFSSGASSHLLSPAGQHLMDGFKPVLPGSYPDSAPSPLAGAGGSMLSAGPSAPLGGSPRSSARRYSGRATCDCPNCQEAERLGPAGASLRRKGLHSCHIPGCGKVYGKTSHLKAHLRWHTGERPFVCNWLFCGKRFTRSDELQRHLRTHTGEKRFACPVCNKRFMRSDHLSKHVKTHSGGGGGGGSAGSGSGGKKGSDTDSEHSAAGSPPCHSPELLQPPEPGHRNGLE

SEQ ID NO: 82676 - protein, 466 aa, Homo sapiens [sequence omitted]

SEQ ID NO: 82677 - protein, 484 aa, Homo sapiens
  Payload ID: 16455
  Gene Symbol: SP9
  Gene Name: Sp9 transcription factor
  Uniprot ID: P0CG40
  ENSP ID: ENSP00000378418
MATSILGEEPRFGTTPLAMLAATCNKIGNTSPLTTLPESSAFAKGGFHPWKRSSSSCNLGSSLSGFAVATGGRGSGGLAGGSGAANSAFCLASTSPTSSAFSSDYGGLFSNSAAAAAAAAGVSPQEAGGQSAFISKVHTTAADGLYPRVGMAHPYESWYKSGFHSTLAAGEVTNGAASSWWDVHSSPGSWLEVQNPAGGLQSSLHSGAPQASLHSQLGTYNPDFSSLTHSAFSSTGLGSSAAAASHLLSTSQHLLAQDGFKPVLPSYSDSSAAVAAAAASAMISGAAAAAAGGSSARSARRYSGRATCDCPNCQEAERLGPAGASLRRKGLHSCHIPGCGKVYGKTSHLKAHLRWHTGERPFVCNWLFCGKRFTRSDELQRHLRTHTGEKRFACPVCNKRFMRSDHLSKHIKTHNGGGGGKKGSDSDTDASNLETPRSESPDLILHDSGVSAARAAAAAAAAAAAAAAAASAGGKEAASGPNDS

SEQ ID NO: 82678 - protein, 1324 aa, Homo sapiens
  Payload ID: 16456
  Gene Symbol: SALL1
  Gene Name: spalt-like transcription factor 1
  Uniprot ID: Q9NSC2
  ENSP ID: ENSP00000251020
MSRRKQAKPQHFQSDPEVASLPRRDGDTEKGQPSRPTKSKDAHVCGRCCAEFFELSDLLLHKKNCTKNQLVLIVNENPASPPETFSPSPPPDNPDEQMNDTVNKTDQVDCSDLSEHNGLDREESMEVEAPVANKSGSGTSSGSHSSTAPSSSSSSSSSSGGGGSSSTGTSAITTSLPQLGDLTTLGNFSVINSNVIIENLQSTKVAVAQFSQEARCGGASGGKLAVPALMEQLLALQQQQIHQLQLIEQIRHQILLLASQNADLPTSSSPSQGTLRTSANPLSTLSSHLSQQLAAAAGLAQSLASQSASISGVKQLPPIQLPQSSSGNTIIPSNSGSSPNMNILAAAVTTPSSEKVASSAGASHVSNPAVSSSSSPAFAISSLLSPASNPLLPQQASANSVFPSPLPNIGTTAEDLNSLSALAQQRKSKPPNVTAFEAKSTSDEAFFKHKCRFCAKVFGSDSALQIHLRSHTGERPFKCNICGNRFSTKGNLKVHFQRHKEKYPHIQMNPYPVPEHLDNIPTSTGIPYGMSIPPEKPVTSWLDTKPVLPTLTTSVGLPLPPTLPSLIPFIKTEEPAPIPISHSATSPPGSVKSDSGGPESATRNLGGLPEEAEGSTLPPSGGKSEESGMVTNSVPTASSSVLSSPAADCGPAGSATTFTNPLLPLMSEQFKAKFPFGGLLDSAQASETSKLQQLVENIDKKATDPNECIICHRVLSCQSALKMHYRTHTGERPFKCKICGRAFTTKGNLKTHYSVHRAMPPLRVQHSCPICQKKFTNAVVLQQHIRMHMGGQIPNTPVPDSYSESMESDTGSFDEKNFDDLDNFSDENMEDCPEGSIPDTPKSADASQDSLSSSPLPLEMSSIAALENQMKMINAGLAEQLQASLKSVENGSIEGDVLTNDSSSVGGDMESQSAGSPAISESTSSMQALSPSNSTQEFHKSPSIEEKPQRAVPSEFANGLSPTPVNGGALDLTSSHAEKIIKEDSLGILFPFRDRGKFKNTACDICGKTFACQSALDIHYRSHTKERPFICTVCNRGFSTKGNLKQHMLTHQMRDLPSQLFEPSSNLGPNQNSAVIPANSLSSLIKTEVNGFVHVSPQDSKDTPTSHVPSGPLSSSATSPVLLPALPRRTPKQHYCNTCGKTFSSSSALQIHERTHTGEKPFACTICGRAFTTKGNLKVHMGTHMWNSTPARRGRRLSVDGPMTFLGGNPVKFPEMFQKDLAARSGSGDPSSFWNQYAAALSNGLAMKANEISVIQNGGIPPIPGSLGSGNSSPVSGLTGNLERLQNSEPNAPLAGLEKMASSENGTNFRFTRFVEDSKEIVTS

SEQ ID NO: 82679 - protein, 1227 aa, Homo sapiens
  Payload ID: 16456
  Gene Symbol: SALL1
  Gene Name: spalt-like transcription factor 1
  Uniprot ID: Q9NSC2
  ENSP ID: ENSP00000407914
MNDTVNKTDQVDCSDLSEHNGLDREESMEVEAPVANKSGSGTSSGSHSSTAPSSSSSSSSSSGGGGSSSTGTSAITTSLPQLGDLTTLGNFSVINSNVIIENLQSTKVAVAQFSQEARCGGASGGKLAVPALMEQLLALQQQQIHQLQLIEQIRHQILLLASQNADLPTSSSPSQGTLRTSANPLSTLSSHLSQQLAAAAGLAQSLASQSASISGVKQLPPIQLPQSSSGNTIIPSNSGSSPNMNILAAAVTTPSSEKVASSAGASHVSNPAVSSSSSPAFAISSLLSPASNPLLPQQASANSVFPSPLPNIGTTAEDLNSLSALAQQRKSKPPNVTAFEAKSTSDEAFFKHKCRFCAKVFGSDSALQIHLRSHTGERPFKCNICGNRFSTKGNLKVHFQRHKEKYPHIQMNPYPVPEHLDNIPTSTGIPYGMSIPPEKPVTSWLDTKPVLPTLTTSVGLPLPPTLPSLIPFIKTEEPAPIPISHSATSPPGSVKSDSGGPESATRNLGGLPEEAEGSTLPPSGGKSEESGMVTNSVPTASSSVLSSPAADCGPAGSATTFTNPLLPLMSEQFKAKFPFGGLLDSAQASETSKLQQLVENIDKKATDPNECIICHRVLSCQSALKMHYRTHTGERPFKCKICGRAFTTKGNLKTHYSVHRAMPPLRVQHSCPICQKKFTNAVVLQQHIRMHMGGQIPNTPVPDSYSESMESDTGSFDEKNFDDLDNFSDENMEDCPEGSIPDTPKSADASQDSLSSSPLPLEMSSIAALENQMKMINAGLAEQLQASLKSVENGSIEGDVLTNDSSSVGGDMESQSAGSPAISESTSSMQALSPSNSTQEFHKSPSIEEKPQRAVPSEFANGLSPTPVNGGALDLTSSHAEKIIKEDSLGILFPFRDRGKFKNTACDICGKTFACQSALDIHYRSHTKERPFICTVCNRGFSTKGNLKQHMLTHQMRDLPSQLFEPSSNLGPNQNSAVIPANSLSSLIKTEVNGFVHVSPQDSKDTPTSHVPSGPLSSSATSPVLLPALPRRTPKQHYCNTCGKTFSSSSALQIHERTHTGEKPFACTICGRAFTTKGNLKVHMGTHMWNSTPARRGRRLSVDGPMTFLGGNPVKFPEMFQKDLAARSGSGDPSSFWNQYAAALSNGLAMKANEISVIQNGGIPPIPGSLGSGNSSPVSGLTGNLERLQNSEPNAPLAGLEKMASSENGTNFRFTRFVEDSKEIVTS

SEQ ID NO: 82680 - protein, 34 aa, Homo sapiens
  Payload ID: 16456
  Gene Symbol: SALL1
  Gene Name: spalt-like transcription factor 1
  ENSP ID: ENSP00000455582
MSRRKQAKPQHFQSDPEVASLPRRDGTHGHSHVE

SEQ ID NO: 82681 - protein, 1154 aa, Homo sapiens
  Payload ID: 16456
  Gene Symbol: SALL1
  Gene Name: spalt-like transcription factor 1
  ENSP ID: ENSP00000456777
MNDTVNKTDQVDCSDLSEHNGLDREESMEVEAPVANKSGSGTSSGSHSSTAPSSSSSSSSSSGGGGSSSTGTSAITTSLPQLGDLTTLGNFSVINSNVIIENLQSTKVAVAQFSQEARCGGASGGKLAVPALMEQLLALQQQQIHQLQLIEQIRHQILLLASQNADLPTSSSPSQGTLRTSANPLSTLSSHLSQQLAAAAGLAQSLASQSASISGVKQLPPIQLPQSSSGNTIIPSNSGSSPNMNILAAAVTTPSSEKVASSAGASHVSNPAVSSSSSPAFAISSLLSPASNPLLPQQASANSVFPSPLPNIGTTAEDLNSLSALAQQRKSKPPNVTAFEAKSTSDEAFFKHKCRFCAKVFGSDSALQIHLRSHTGERPFKCNICGNRFSTKGNLKVHFQRHKEKYPHIQMNPYPVPEHLDNIPTSTGIPYGMSIPPEKPVTSWLDTKPVLPTLTTSVGLPLPPTLPSLIPFIKTEEPAPIPISHSATSPPGSVKSDSGGPESATRNLGGLPEEAEGSTLPPSGGKSEESGMVTNSVPTASSSVLSSPAADCGPAGSATTFTNPLLPLMSEQFKAKFPFGGLLDSAQASETSKLQQLVENIDKKATDPNECIICHRVLSCQSALKMHYRTHTGERPFKCKICGRAFTTKGNLKTHYSVHRAMPPLRVQHSCPICQKKFTNAVVLQQHIRMHMGGQIPNTPVPDSYSESMESDTGSFDEKNFDDLDNFSDENMEDCPEGSIPDTPKSADASQDSLSSSPLPLEMSSIAALENQMKMINAGLAEQLQASLKSVENGSIEGDVLTNDSSSVGGDMESQSAGSPAISESTSSMQALSPSNSTQEFHKSPSIEEKPQRAVPSEFANGLSPTPVNGGALDLTSSHAEKIIKEDSLGILFPFRDRGKFKNTACDICGKTFACQSALDIHYRSHTKERPFICTVCNRGFSTKGNLKQHMLTHQMRDLPSQLFEPSSNLGPNQNSAVIPANSLSSLIKTEVNGFVHVSPQDSKDTPTSHVPSGPLSSSATSPVLLPALPRRTPKQHYCNTCGKTFSSSSALQIHERTHTGEKPFACTICGRAFTTKGNLKVHMGTHMWNSTPARRGRRLSVDGPMTFLGGNPVKFPEMFQKDLAARSGSGDPSSFWNQYAAALSNGLAMKANE

SEQ ID NO: 82682 - protein, 906 aa, Homo sapiens
  Payload ID: 16457
  Gene Symbol: SALL2
  Gene Name: spalt-like transcription factor 2
  ENSP ID: ENSP00000396773
MAHESERSSRLGVPCGEPAELGGDASEEDHPQVCAKCCAQFTDPTEFLAHQNACSTDPPVMVIIGGQENPNNSSASSEPRPEGHNNPQVMDTEHSNPPDSGSSVPTDPTWGPERRGEESSGHFLVAATGAETPKQAFFHLYHPLGSQHPFSAGGVGRSHKPTPAPSPALPGSTDQLIASPHLAFPSTTGLLAAQCLGAARGLEATASPGLLKPKNGSGELSYGEVMGPLEKPGGRHKCRFCAKVFGSDSALQIHLRSHTGERPYKCNVCGNRFTTRGNLKVHFHRHREKYPHVQMNPHPVPEHLDYVITSSGLPYGMSVPPEKAEEEAATPGGGVERKPLVASTTALSATESLTLLSTSAGTATAPGLPAFNKFVLMKAVEPKNKADENTPPGSEGSAISGVAESSTATRMQLSKLVTSLPSWALLTNHFKSTGSFPFPYVLEPLGASPSETSKLQQLVEKIDRQGAVAVTSAASGAPTTSAPAPSSSASSGPNQCVICLRVLSCPRALRLHYGQHGGERPFKCKVCGRAFSTRGNLRAHFVGHKASPAARAQNSCPICQKKFTNAVTLQQHVRMHLGGQIPNGGTALPEGGGAAQENGSEQSTVSGARSFPQQQSQQPSPEEELSEEEEEEDEEEEEDVTDEDSLAGRGSESGGEKAISVRGDSEEASGAEEEVGTVAAAATAGKEMDSNEKTTQQSSLPPPPPPDSLDQPQPMEQGSSGVLGGKEEGGKPERSSSPASALTPEGEATSVTLVEELSLQEAMRKEPGESSSRKACEVCGQAFPSQAALEEHQKTHPKEGPLFTCVFCRQGFLERATLKKHMLLAHHQNQYVAFLSNGLPMKPWNSSSTSTTTPSLAPPVLFGLGTVAGKVPPTMGSREAKEKTAPLLFQPPAPKAVPEKPIIDKK

SEQ ID NO: 82683 - protein, 191 aa, Homo sapiens
  Payload ID: 16457
  Gene Symbol: SALL2
  Gene Name: spalt-like transcription factor 2
  ENSP ID: ENSP00000438493
MAHESERSSRLGVPCGEPAELGGDASEEDHPQVCAKCCAQFTDPTEFLAHQNACSTDPPVMVIIGGQENPNNSSASSEPRPEGHNNPQVMDTEHSNPPDSGSSVPTDPTWGPERRGEESSGHFLVAATGTAAGGGGGLILASPKLGATPLPPESTPAPPPPPPPPPPPGVGSGHLNIPLILEELRVLQQRQ

SEQ ID NO: 82684 - protein, 99 aa, Homo sapiens
  Payload ID: 16457
  Gene Symbol: SALL2
  Gene Name: spalt-like transcription factor 2
  ENSP ID: ENSP00000439654
MVIIGGQENPNNSSASSEPRPEGHNNPQVMDTEHSNPPDSGSSVPTDPTWGPERRGEESSGHFLVAATGTAAGGGGGLILASPKLGATPLPPESTPAPP

SEQ ID NO: 82685 - protein, 902 aa, Homo sapiens
  Payload ID: 16457
  Gene Symbol: SALL2
  Gene Name: spalt-like transcription factor 2
  ENSP ID: ENSP00000440054
  MOD_RES (1)..(1): Any amino acid
XKPQQLISDCEGPSASENGDASEEDHPQVCAKCCAQFTDPTEFLAHQNACSTDPPVMVIIGGQENPNNSSASSEPRPEGHNNPQVMDTEHSNPPDSGSSVPTDPTWGPERRGEESSGHFLVAATGAETPKQAFFHLYHPLGSQHPFSAGGVGRSHKPTPAPSPALPGSTDQLIASPHLAFPSTTGLLAAQCLGAARGLEATASPGLLKPKNGSGELSYGEVMGPLEKPGGRHKCRFCAKVFGSDSALQIHLRSHTGERPYKCNVCGNRFTTRGNLKVHFHRHREKYPHVQMNPHPVPEHLDYVITSSGLPYGMSVPPEKAEEEAATPGGGVERKPLVASTTALSATESLTLLSTSAGTATAPGLPAFNKFVLMKAVEPKNKADENTPPGSEGSAISGVAESSTATRMQLSKLVTSLPSWALLTNHFKSTGSFPFPYVLEPLGASPSETSKLQQLVEKIDRQGAVAVTSAASGAPTTSAPAPSSSASSGPNQCVICLRVLSCPRALRLHYGQHGGERPFKCKVCGRAFSTRGNLRAHFVGHKASPAARAQNSCPICQKKFTNAVTLQQHVRMHLGGQIPNGGTALPEGGGAAQENGSEQSTVSGARSFPQQQSQQPSPEEELSEEEEEEDEEEEEDVTDEDSLAGRGSESGGEKAISVRGDSEEASGAEEEVGTVAAAATAGKEMDSNEKTTQQSSLPPPPPPDSLDQPQPMEQGSSGVLGGKEEGGKPERSSSPASALTPEGEATSVTLVEELSLQEAMRKEPGESSSRKACEVCGQAFPSQAALEEHQKTHPKEGPLFTCVFCRQGFLERATLKKHMLLAHHQNQYVAFLSNGLPMKPWNSSSTSTTTPSLAPPVLFGLGTVAGKVPPTMGSREAKEKTAPLLFQPPAPKAVPEKPIIDKK

SEQ ID NO: 82686 - protein, 200 aa, Homo sapiens
  Payload ID: 16457
  Gene Symbol: SALL2
  Gene Name: spalt-like transcription factor 2
  ENSP ID: ENSP00000483202
MSRRKQRKPQQLISDCEGPSASENGDASEEDHPQVCAKCCAQFTDPTEFLAHQNACSTDPPVMVIIGGQENPNNSSASSEPRPEGHNNPQVMDTEHSNPPDSGSSVPTDPTWGPERRGEESSGHFLVAATEPVCGIPVKWPAHEALEFQLHLHYHSKPGPTSAVWPRNCGWEGASNNGIQGSQGEDSPPPISASCTQGSA

SEQ ID NO: 82687 - protein, 1007 aa, Homo sapiens
  Payload ID: 16457
  Gene Symbol: SALL2
  Gene Name: spalt-like transcription factor 2
  Uniprot ID: Q9Y467
  ENSP ID: ENSP00000483562
MSRRKQRKPQQLISDCEGPSASENGDASEEDHPQVCAKCCAQFTDPTEFLAHQNACSTDPPVMVIIGGQENPNNSSASSEPRPEGHNNPQVMDTEHSNPPDSGSSVPTDPTWGPERRGEESSGHFLVAATGTAAGGGGGLILASPKLGATPLPPESTPAPPPPPPPPPPPGVGSGHLNIPLILEELRVLQQRQIHQMQMTEQICRQVLLLGSLGQTVGAPASPSELPGTGTASSTKPLLPLFSPIKPVQTSKTLASSSSSSSSSSGAETPKQAFFHLYHPLGSQHPFSAGGVGRSHKPTPAPSPALPGSTDQLIASPHLAFPSTTGLLAAQCLGAARGLEATASPGLLKPKNGSGELSYGEVMGPLEKPGGRHKCRFCAKVFGSDSALQIHLRSHTGERPYKCNVCGNRFTTRGNLKVHFHRHREKYPHVQMNPHPVPEHLDYVITSSGLPYGMSVPPEKAEEEAATPGGGVERKPLVASTTALSATESLTLLSTSAGTATAPGLPAFNKFVLMKAVEPKNKADENTPPGSEGSAISGVAESSTATRMQLSKLVTSLPSWALLTNHFKSTGSFPFPYVLEPLGASPSETSKLQQLVEKIDRQGAVAVTSAASGAPTTSAPAPSSSASSGPNQCVICLRVLSCPRALRLHYGQHGGERPFKCKVCGRAFSTRGNLRAHFVGHKASPAARAQNSCPICQKKFTNAVTLQQHVRMHLGGQIPNGGTALPEGGGAAQENGSEQSTVSGARSFPQQQSQQPSPEEELSEEEEEEDEEEEEDVTDEDSLAGRGSESGGEKAISVRGDSEEASGAEEEVGTVAAAATAGKEMDSNEKTTQQSSLPPPPPPDSLDQPQPMEQGSSGVLGGKEEGGKPERSSSPASALTPEGEATSVTLVEELSLQEAMRKEPGESSSRKACEVCGQAFPSQAALEEHQKTHPKEGPLFTCVFCRQGFLERATLKKHMLLAHHQVQPFAPHGPQNIAALSLVPGCSPSITSTGLSPFPRKDDPTIP

SEQ ID NO: 82688 - protein, 198 aa, Homo sapiens
  Payload ID: 16457
  Gene Symbol: SALL2
  Gene Name: spalt-like transcription factor 2
  ENSP ID: ENSP00000484460
MAHESERSSRLGVPCGEPAELGGDASEEDHPQVCAKCCAQFTDPTEFLAHQNACSTDPPVMVIIGGQENPNNSSASSEPRPEGHNNPQVMDTEHSNPPDSGSSVPTDPTWGPERRGEESSGHFLVAATEPVCGIPVKWPAHEALEFQLHLHYHSKPGPTSAVWPRNCGWEGASNNGIQGSQGEDSPPPISASCTQGSA

SEQ ID NO: 82689 - protein, 1095 aa, Homo sapiens
  Payload ID: 16458
  Gene Symbol: SALL3
  Gene Name: spalt-like transcription factor 3
  Uniprot ID: Q9BXA9
  ENSP ID: ENSP00000439975
MDAEPAGDTRAPRPPPAAPAPPTPAYGAPSTNVTLEALLSTKVAVAQFSQGARAAGGSGAGGGVAAAAVPLILEQLMALQQQQIHQLQLIEQIRSQVALMQRPPPRPSLSPAAAPSAPGPAPSQLPGLAALPLSAGAPAAAIAGSGPAAPAAFEGAQPLSRPESGASTPGGPAEPSAPAAPSAAPAPAAPAPAPAPQSAASSQPQSASTPPALAPGSLLGAAPGLPSPLLPQTSASGVIFPNPLVSIAATANALDPLSALMKHRKGKPPNVSVFEPKASAEDPFFKHKCRFCAKVFGSDSALQIHLRSHTGERPFKCNICGNRFSTKGNLKVHFQRHKEKYPHIQMNPYPVPEYLDNVPTCSGIPYGMSLPPEKPVTTWLDSKPVLPTVPTSVGLQLPPTVPGAHGYADSPSATPASRSPQRPSPASSECASLSPGLNHVESGVSATAESPQSLLGGPPLTKAEPVSLPCTNARAGDAPVGAQASAAPTSVDGAPTSLGSPGLPAVSEQFKAQFPFGGLLDSMQTSETSKLQQLVENIDKKMTDPNQCVICHRVLSCQSALKMHYRTHTGERPFKCKICGRAFTTKGNLKTHFGVHRAKPPLRVQHSCPICQKKFTNAVVLQQHIRMHMGGQIPNTPLPEGFQDAMDSELAYDDKNAETLSSYDDDMDENSMEDDAELKDAATDPAKPLLSYAGSCPPSPPSVISSIAALENQMKMIDSVMSCQQLTGLKSVENGSGESDRLSNDSSSAVGDLESRSAGSPALSESSSSQALSPAPSNGESFRSKSPGLGAPEEPQEIPLKTERPDSPAAAPGSGGAPGRAGIKEEAPFSLLFLSRERGPSQSTPSLISSAAPTMIKMEVNGHGKAMALGEGPPLPAGVQVPAGPQTVMGPGLAPMLAPPPRRTPKQHNCQSCGKTFSSASALQIHERTHTGEKPFGCTICGRAFTTKGNLKVHMGTHMWNNAPARRGRRLSVENPMALLGGDALKFSEMFQKDLAARAMNVDPSFWNQYAAAITNGLAMKNNEISVIQNGGIPQLPVSLGGSALPPLGSMASGMDKARTGSSPPIVSLDKASSETAASRPFTRFIEDNKEIGIN

SEQ ID NO: 82690 - protein, 1300 aa, Homo sapiens
  Payload ID: 16458
  Gene Symbol: SALL3
  Gene Name: spalt-like transcription factor 3
  Uniprot ID: Q9BXA9
  ENSP ID: ENSP00000441823
MSRRKQAKPQHLKSDEELLPPDGAPEHAAPGEGAEDADSGPESRSGGEETSVCEKCCAEFFKWADFLEHQRSCTKLPPVLIVHEDAPAPPPEDFPEPSPASSPSERAESEAAEEAGAEGAEGEARPVEKEAEPMDAEPAGDTRAPRPPPAAPAPPTPAYGAPSTNVTLEALLSTKVAVAQFSQGARAAGGSGAGGGVAAAAVPLILEQLMALQQQQIHQLQLIEQIRSQVALMQRPPPRPSLSPAAAPSAPGPAPSQLPGLAALPLSAGAPAAAIAGSGPAAPAAFEGAQPLSRPESGASTPGGPAEPSAPAAPSAAPAPAAPAPAPAPQSAASSQPQSASTPPALAPGSLLGAAPGLPSPLLPQTSASGVIFPNPLVSIAATANALDPLSALMKHRKGKPPNVSVFEPKASAEDPFFKHKCRFCAKVFGSDSALQIHLRSHTGERPFKCNICGNRFSTKGNLKVHFQRHKEKYPHIQMNPYPVPEYLDNVPTCSGIPYGMSLPPEKPVTTWLDSKPVLPTVPTSVGLQLPPTVPGAHGYADSPSATPASRSPQRPSPASSECASLSPGLNHVESGVSATAESPQSLLGGPPLTKAEPVSLPCTNARAGDAPVGAQASAAPTSVDGAPTSLGSPGLPAVSEQFKAQFPFGGLLDSMQTSETSKLQQLVENIDKKMTDPNQCVICHRVLSCQSALKMHYRTHTGERPFKCKICGRAFTTKGNLKTHFGVHRAKPPLRVQHSCPICQKKFTNAVVLQQHIRMHMGGQIPNTPLPEGFQDAMDSELAYDDKNAETLSSYDDDMDENSMEDDAELKDAATDPAKPLLSYAGSCPPSPPSVISSIAALENQMKMIDSVMSCQQLTGLKSVENGSGESDRLSNDSSSAVGDLESRSAGSPALSESSSSQALSPAPSNGESFRSKSPGLGAPEEPQEIPLKTERPDSPAAAPGSGGAPGRAGIKEEAPFSLLFLSRERGKCPSTVCGVCGKPFACKSALEIHYRSHTKERPFVCALCRRGCSTMGNLKQHLLTHRLKELPSQLFDPNFALGPSQSTPSLISSAAPTMIKMEVNGHGKAMALGEGPPLPAGVQVPAGPQTVMGPGLAPMLAPPPRRTPKQHNCQSCGKTFSSASALQIHERTHTGEKPFGCTICGRAFTTKGNLKVHMGTHMWNNAPARRGRRLSVENPMALLGGDALKFSEMFQKDLAARAMNVDPSFWNQYAAAITNGLAMKNNEISVIQNGGIPQLPVSLGGSALPPLGSMASGMDKARTGSSPPIVSLDKASSETAASRPFTRFIEDNKEIGIN

SEQ ID NO: 82691 - protein, 1228 aa, Homo sapiens
  Payload ID: 16458
  Gene Symbol: SALL3
  Gene Name: spalt-like transcription factor 3
  Uniprot ID: Q9BXA9
  ENSP ID: ENSP00000458360
MSRRKQAKPQHLKSDEELLPPDGAPEHAAPGEGAEDADSGPESRSGGEETSVCEKCCAEFFKWADFLEHQRSCTKLPPVLIVHEDAPAPPPEDFPEPSPASSPSERAESEAAEEAGAEGAEGEARPVEKEAEPMDAEPAGDTRAPRPPPAAPAPPTPAYGAPSTNVTLEALLSTKVAVAQFSQGARAAGGSGAGGGVAAAAVPLILEQLMALQQQQIHQLQLIEQIRSQVALMQRPPPRPSLSPAAAPSAPGPAPSQLPGLAALPLSAGAPAAAIAGSGPAAPAAFEGAQPLSRPESGASTPGGPAEPSAPAAPSAAPAPAAPAPAPAPQSAASSQPQSASTPPALAPGSLLGAAPGLPSPLLPQTSASGVIFPNPLVSIAATANALDPLSALMKHRKGKPPNVSVFEPKASAEDPFFKHKCRFCAKVFGSDSALQIHLRSHTGERPFKCNICGNRFSTKGNLKVHFQRHKEKYPHIQMNPYPVPEYLDNVPTCSGIPYGMSLPPEKPVTTWLDSKPVLPTVPTSVGLQLPPTVPGAHGYADSPSATPASRSPQRPSPASSECASLSPGLNHVESGVSATAESPQSLLGGPPLTKAEPVSLPCTNARAGDAPVGAQASAAPTSVDGAPTSLGSPGLPAVSEQFKAQFPFGGLLDSMQTSETSKLQQLVENIDKKMTDPNQCVICHRVLSCQSALKMHYRTHTGERPFKCKICGRAFTTKGNLKTHFGVHRAKPPLRVQHSCPICQKKFTNAVVLQQHIRMHMGGQIPNTPLPEGFQDAMDSELAYDDKNAETLSSYDDDMDENSMEDDAELKDAATDPAKPLLSYAGSCPPSPPSVISSIAALENQMKMIDSVMSCQQLTGLKSVENGSGESDRLSNDSSSAVGDLESRSAGSPALSESSSSQALSPAPSNGESFRSKSPGLGAPEEPQEIPLKTERPDSPAAAPGSGGAPGRAGIKEEAPFSLLFLSRERGPSQSTPSLISSAAPTMIKMEVNGHGKAMALGEGPPLPAGVQVPAGPQTVMGPGLAPMLAPPPRRTPKQHNCQSCGKTFSSASALQIHERTHTGEKPFGCTICGRAFTTKGNLKVHMGTHMWNNAPARRGRRLSVENPMALLGGDALKFSEMFQKDLAARAMNVDPSFWNQYAAAITNGLAMKNNEISVIQNGGIPQLPVSLGGSALPPLGSMASGMDKARTGSSPPIVSLDKASSETAASRPFTRFIEDNKEIGIN

SEQ ID NO: 82692 - protein, 1224 aa, Homo sapiens
  Payload ID: 16458
  Gene Symbol: SALL3
  Gene Name: spalt-like transcription factor 3
  ENSP ID: ENSP00000460356
  MOD_RES (1)..(1): Any amino acid
XQAKPQHLKSDEELLPPDGAPEHAAPGEGAEDADSGPESRSGGEETSVCEKCCAEFFKWADFLEHQRSCTKLPPVLIVHEDAPAPPPEDFPEPSPASSPSERAESEAAEEAGAEGAEGEARPVEKEAEPMDAEPAGDTRAPRPPPAAPAPPTPAYGAPSTNVTLEALLSTKVAVAQFSQGARAAGGSGAGGGVAAAAVPLILEQLMALQQQQIHQLQLIEQIRSQVALMQRPPPRPSLSPAAAPSAPGPAPSQLPGLAALPLSAGAPAAAIAGSGPAAPAAFEGAQPLSRPESGASTPGGPAEPSAPAAPSAAPAPAAPAPAPAPQSAASSQPQSASTPPALAPGSLLGAAPGLPSPLLPQTSASGVIFPNPLVSIAATANALDPLSALMKHRKGKPPNVSVFEPKASAEDPFFKHKCRFCAKVFGSDSALQIHLRSHTGERPFKCNICGNRFSTKGNLKVHFQRHKEKYPHIQMNPYPVPEYLDNVPTCSGIPYGMSLPPEKPVTTWLDSKPVLPTVPTSVGLQLPPAVPGAHGYADSPSATPASRSPQRPSPASSECASLSPGLNHVESGVSATAESPQSLLGGPPVTKAEPVSLPCTNARAGDAPVGAQASAAPTSVDGAPTSLGSPGLPAVSEQFKAQFPFGGLLDSMQTSETSKLQQLVENIDKKMTDPNQCVICHRVLSCQSALKMHYRTHTGERPFKCKICGRAFTTKGNLKTHFGVHRAKPPLRVQHSCPICQKKFTNAVVLQQHIRMHMGGQIPNTPLPEGFQDAMDSELAYDDKNAETLSSYDDDMDENSMEDDAELKDAATDPAKPLLSYAGSCPPSPPSVISSIAALENQMKMIDSVMSCQQLTGLKSVENGSGESDRLSNDSSSAVGDLESRSAGSPALSESSSSQALSPAPSNGESFRSKSPGLGAPEEPQEIPLKTERPDSPAAAPGSGGAPGRAGIKEEAPFSLLFLSRERGPSQSTPSLISSAAPTMIKMEVNGHGKAMALGEGPPLPAGVQVPAGPQTVMGPGLAPMLAPPPRRTPKQHNCQSCGKTFSSASALQIHERTHTGEKPFGCTICGRAFTTKGNLKVHMGTHMWNNAPARRGRRLSVENPMALLGGDALKFSEMFQKDLAARAMNVDPSFWNQYAAAITNGLAMKNNEISVIQNGGIPQLPVSLGGSALPPLGSMASGMDKARTGSSPPIVSLDKASSETAASRPFTRFIEDNKEIGIN

SEQ ID NO: 82693 - protein, 150 aa, Homo sapiens
  Payload ID: 16458
  Gene Symbol: SALL3
  Gene Name: spalt-like transcription factor 3
  ENSP ID: ENSP00000460555
  MOD_RES (1)..(1): Any amino acid
XRPDSPAAAPGSGGAPGRAGIKEEAPFSLLFLSRERGPSQSTPSLISSAAPTMIKMEVNGHGKAMALGEGPPLPAGVQVPAGPQTVMGPGLAPMLAPPPRRTPKQHNCQSCGKTFSSASALQIHERTHTGEKPFGCTICGRAFTTKGNLK

SEQ ID NO: 82694 - protein, 1300 aa, Homo sapiens
  Payload ID: 16458
  Gene Symbol: SALL3
  Gene Name: spalt-like transcription factor 3
  ENSP ID: ENSP00000461114
MSRRKQAKPQHLKSDEELLPPDGAPEHAAPGEGAEDADSGPESRSGGEETSVCEKCCAEFFKWADFLEHQRSCTKLPPVLIVHEDAPAPPPEDFPEPSPASSPSERAESEAAEEAGAEGAEGEARPVEKEAEPMDAEPAGDTRAPRPPPAAPAPPTPAYGAPSTNVTLEALLSTKVAVAQFSQGARAAGGSGAGGGVAAAAVPLILEQLMALQQQQIHQLQLIEQIRSQVALMQRPPPRPSLSPAAAPSAPGPAPSQLPGLAALPLSAGAPAAAIAGSGPAAPAAFEGAQPLSRPESGASTPGGPAEPSAPAAPSAAPAPAAPAPAPAPQSAASSQPQSASTPPALAPGSLLGAAPGLPSPLLPQTSASGVIFPNPLVSIAATANALDPLSALMKHRKGKPPNVSVFEPKASAEDPFFKHKCRFCAKVFGSDSALQIHLRSHTGERPFKCNICGNRFSTKGNLKVHFQRHKEKYPHIQMNPYPVPEYLDNVPTCSGIPYGMSLPPEKPVTTWLDSKPVLPTVPTSVGLQLPPAVPGAHGYADSPSATPASRSPQRPSPASSECASLSPGLNHVESGVSATAESPQSLLGGPPVTKAEPVSLPCTNARAGDAPVGAQASAAPTSVDGAPTSLGSPGLPAVSEQFKAQFPFGGLLDSMQTSETSKLQQLVENIDKKMTDPNQCVICHRVLSCQSALKMHYRTHTGERPFKCKICGRAFTTKGNLKTHFGVHRAKPPLRVQHSCPICQKKFTNAVVLQQHIRMHMGGQIPNTPLPEGFQDAMDSELAYDDKNAETLSSYDDDMDENSMEDDAELKDAATDPAKPLLSYAGSCPPSPPSVISSIAALENQMKMIDSVMSCQQLTGLKSVENGSGESDRLSNDSSSAVGDLESRSAGSPALSESSSSQALSPAPSNGESFRSKSPGLGAPEEPQEIPLKTERPDSPAAAPGSGGAPGRAGIKEEAPFSLLFLSRERGKCPSTVCGVCGKPFACKSALEIHYRSHTKERPFVCALCRRGCSTMGNLKQHLLTHRLKELPSQLFDPNFALGPSQSTPSLISSAAPTMIKMEVNGHGKAMALGEGPPLPAGVQVPAGPQTVMGPGLAPMLAPPPRRTPKQHNCQSCGKTFSSASALQIHERTHTGEKPFGCTICGRAFTTKGNLKVHMGTHMWNNAPARRGRRLSVENPMALLGGDALKFSEMFQKDLAARAMNVDPSFWNQYAAAITNGLAMKNNEISVIQNGGIPQLPVSLGGSALPPLGSMASGMDKARTGSSPPIVSLDKASSETAASRPFTRFIEDNKEIGIN

SEQ ID NO: 82695 - protein, 150 aa, Homo sapiens; identical to SEQ ID NO: 82693
  Payload ID: 16458
  Gene Symbol: SALL3
  Gene Name: spalt-like transcription factor 3
  ENSP ID: ENSP00000461451
  MOD_RES (1)..(1): Any amino acid

SEQ ID NO: 82696 - protein, 1300 aa, Homo sapiens; identical to SEQ ID NO: 82690
  Payload ID: 16458
  Gene Symbol: SALL3
  Gene Name: spalt-like transcription factor 3
  Uniprot ID: Q9BXA9
  ENSP ID: ENSP00000478953

SEQ ID NO: 82697 - protein, 960 aa, Homo sapiens
  Payload ID: 16458
  Gene Symbol: SALL3
  Gene Name: spalt-like transcription factor 3
  ENSP ID: ENSP00000481352
MSRRKQAKPQHLKSDEELLPPDGAPEHAAPGEGAEDADSGPESRSGGEETSVCEKCCAEFFKWADFLEHQRSCTKLPPVLIVHEDAPPGLPSPLLPQTSASGVIFPNPLVSIAATANALDPLSALMKHRKGKPPNVSVFEPKASAEDPFFKHKCRFCAKVFGSDSALQIHLRSHTGERPFKCNICGNRFSTKGNLKVHFQRHKEKYPHIQMNPYPVPEYLDNVPTCSGIPYGMSLPPEKPVTTWLDSKPVLPTVPTSVGLQLPPTVPGAHGYADSPSATPASRSPQRPSPASSECASLSPGLNHVESGVSATAESPQSLLGGPPLTKAEPVSLPCTNARAGDAPVGAQASAAPTSVDGAPTSLGSPGLPAVSEQFKAQFPFGGLLDSMQTSETSKLQQLVENIDKKMTDPNQCVICHRVLSCQSALKMHYRTHTGERPFKCKICGRAFTTKGNLKTHFGVHRAKPPLRVQHSCPICQKKFTNAVVLQQHIRMHMGGQIPNTPLPEGFQDAMDSELAYDDKNAETLSSYDDDMDENSMEDDAELKDAATDPAKPLLSYAGSCPPSPPSVISSIAALENQMKMIDSVMSCQQLTGLKSVENGSGESDRLSNDSSSAVGDLESRSAGSPALSESSSSQALSPAPSNGESFRSKSPGLGAPEEPQEIPLKTERPDSPAAAPGSGGAPGRAGIKEEAPFSLLFLSRERGPSQSTPSLISSAAPTMIKMEVNGHGKAMALGEGPPLPAGVQVPAGPQTVMGPGLAPMLAPPPRRTPKQHNCQSCGKTFSSASALQIHERTHTGEKPFGCTICGRAFTTKGNLKVHMGTHMWNNAPARRGRRLSVENPMALLGGDALKFSEMFQKDLAARAMNVDPSFWNQYAAAITNGLAMKNNEISVIQNGGIPQLPVSLGGSALPPLGSMASGMDKARTGSSPPIVSLDKASSETAASRPFTRFIEDNKEIGIN

SEQ ID NO: 82698 - protein, 960 aa, Homo sapiens; identical to SEQ ID NO: 82697
  Payload ID: 16458
  Gene Symbol: SALL3
  Gene Name: spalt-like transcription factor 3
  ENSP ID: ENSP00000482958

SEQ ID NO: 82699 - protein, 959 aa, Homo sapiens
  Payload ID: 16458
  Gene Symbol: SALL3
  Gene Name: spalt-like transcription factor 3
  ENSP ID: ENSP00000483370
MSRRKQAKPQHLKSDEELLPPDGAPEHAAPGEGAEDADSGPESRSGGEETSVCEKCCAEFFKWADFLEHQRSCTKLPPVLIVHEDAPGLPSPLLPQTSASGVIFPNPLVSIAATANALDPLSALMKHRKGKPPNVSVFEPKASAEDPFFKHKCRFCAKVFGSDSALQIHLRSHTGERPFKCNICGNRFSTKGNLKVHFQRHKEKYPHIQMNPYPVPEYLDNVPTCSGIPYGMSLPPEKPVTTWLDSKPVLPTVPTSVGLQLPPAVPGAHGYADSPSATPASRSPQRPSPASSECASLSPGLNHVESGVSATAESPQSLLGGPPVTKAEPVSLPCTNARAGDAPVGAQASAAPTSVDGAPTSLGSPGLPAVSEQFKAQFPFGGLLDSMQTSETSKLQQLVENIDKKMTDPNQCVICHRVLSCQSALKMHYRTHTGERPFKCKICGRAFTTKGNLKTHFGVHRAKPPLRVQHSCPICQKKFTNAVVLQQHIRMHMGGQIPNTPLPEGFQDAMDSELAYDDKNAETLSSYDDDMDENSMEDDAELKDAATDPAKPLLSYAGSCPPSPPSVISSIAALENQMKMIDSVMSCQQLTGLKSVENGSGESDRLSNDSSSAVGDLESRSAGSPALSESSSSQALSPAPSNGESFRSKSPGLGAPEEPQEIPLKTERPDSPAAAPGSGGAPGRAGIKEEAPFSLLFLSRERGPSQSTPSLISSAAPTMIKMEVNGHGKAMALGEGPPLPAGVQVPAGPQTVMGPGLAPMLAPPPRRTPKQHNCQSCGKTFSSASALQIHERTHTGEKPFGCTICGRAFTTKGNLKVHMGTHMWNNAPARRGRRLSVENPMALLGGDALKFSEMFQKDLAARAMNVDPSFWNQYAAAITNGLAMKNNEISVIQNGGIPQLPVSLGGSALPPLGSMASGMDKARTGSSPPIVSLDKASSETAASRPFTRFIEDNKEIGIN

SEQ ID NO: 82700 - protein, 150 aa, Homo sapiens; identical to SEQ ID NO: 82693
  Payload ID: 16458
  Gene Symbol: SALL3
  Gene Name: spalt-like transcription factor 3
  ENSP ID: ENSP00000487734
  MOD_RES (1)..(1): Any amino acid

SEQ ID NO: 82701 - protein, 1228 aa, Homo sapiens; identical to SEQ ID NO: 82691
  Payload ID: 16458
  Gene Symbol: SALL3
  Gene Name: spalt-like transcription factor 3
  Uniprot ID: Q9BXA9
  ENSP ID: ENSP00000488140

SEQ ID NO: 82702 - protein, 1095 aa, Homo sapiens; identical to SEQ ID NO: 82689
  Payload ID: 16458
  Gene Symbol: SALL3
  Gene Name: spalt-like transcription factor 3
  Uniprot ID: Q9BXA9
  ENSP ID: ENSP00000488722

SEQ ID NO: 82703 - protein, 1053 aa, Homo sapiens
  Payload ID: 16459
  Gene Symbol: SALL4
  Gene Name: spalt-like transcription factor 4
  Uniprot ID: Q9UJQ4
  ENSP ID: ENSP00000217086
MSRRKQAKPQHINSEEDQGEQQPQQQTPEFADAAPAAPAAGELGAPVNHPGNDEVASEDEATVKRLRREETHVCEKCCAEFFSISEFLEHKKNCTKNPPVLIMNDSEGPVPSEDFSGAVLSHQPTSPGSKDCHRENGGSSEDMKEKPDAESVVYLKTETALPPTPQDISYLAKGKVANTNVTLQALRGTKVAVNQRSADALPAPVPGANSIPWVLEQILCLQQQQLQQIQLTEQIRIQVNMWASHALHSSGAGADTLKTLGSHMSQQVSAAVALLSQKAGSQGLSLDALKQAKLPHANIPSATSSLSPGLAPFTLKPDGTRVLPNVMSRLPSALLPQAPGSVLFQSPFSTVALDTSKKGKGKPPNISAVDVKPKDEAALYKHKCKYCSKVFGTDSSLQIHLRSHTGERPFVCSVCGHRFTTKGNLKVHFHRHPQVKANPQLFAEFQDKVAAGNGIPYALSVPDPIDEPSLSLDSKPVLVTTSVGLPQNLSSGTNPKDLTGGSLPGDLQPGPSPESEGGPTLPGVGPNYNSPRAGGFQGSGTPEPGSETLKLQQLVENIDKATTDPNECLICHRVLSCQSSLKMHYRTHTGERPFQCKICGRAFSTKGNLKTHLGVHRTNTSIKTQHSCPICQKKFTNAVMLQQHIRMHMGGQIPNTPLPENPCDFTGSEPMTVGENGSTGAICHDDVIESIDVEEVSSQEAPSSSSKVPTPLPSIHSASPTLGFAMMASLDAPGKVGPAPFNLQRQGSRENGSVESDGLTNDSSSLMGDQEYQSRSPDILETTSFQALSPANSQAESIKSKSPDAGSKAESSENSRTEMEGRSSLPSTFIRAPPTYVKVEVPGTFVGPSTLSPGMTPLLAAQPRRQAKQHGCTRCGKNFSSASALQIHERTHTGEKPFVCNICGRAFTTKGNLKVHYMTHGANNNSARRGRKLAIENTMALLGTDGKRVSEIFPKEILAPSVNVDPVVWNQYTSMLNGGLAVKTNEISVIQSGGVPTLPVSLGATSVVNNATVSKMDGSQSGISADVEKPSATDGVPKHQFPHFLEENKIAVS

SEQ ID NO: 82704 - protein, 276 aa, Homo sapiens
  Payload ID: 16459
  Gene Symbol: SALL4
  Gene Name: spalt-like transcription factor 4
  ENSP ID: ENSP00000360594
MSRRKQAKPQHINSEEDQGEQQPQQQTPEFADAAPAAPAAGELGRSSLPSTFIRAPPTYVKVEVPGTFVGPSTLSPGMTPLLAAQPRRQAKQHGCTRCGKNFSSASALQIHERTHTGEKPFVCNICGRAFTTKGNLKVHYMTHGANNNSARRGRKLAIENTMALLGTDGKRVSEIFPKEILAPSVNVDPVVWNQYTSMLNGGLAVKTNEISVIQSGGVPTLPVSLGATSVVNNATVSKMDGSQSGISADVEKPSATDGVPKHQFPHFLEENKIAVS

SEQ ID NO: 82705 - protein, 616 aa, Homo sapiens
  Payload ID: 16459
  Gene Symbol: SALL4
  Gene Name: spalt-like transcription factor 4
  Uniprot ID: Q9UJQ4
  ENSP ID: ENSP00000379319
MSRRKQAKPQHINSEEDQGEQQPQQQTPEFADAAPAAPAAGELGAPVNHPGNDEVASEDEATVKRLRREETHVCEKCCAEFFSISEFLEHKKNCTKNPPVLIMNDSEGPVPSEDFSGAVLSHQPTSPGSKDCHRENGGSSEDMKEKPDAESVVYLKTETALPPTPQDISYLAKGKVANTNVTLQALRGTKVAVNQRSADALPAPVPGANSIPWVLEQILCLQQQQLQQIQLTEQIRIQVNMWASHALHSSGAGADTLKTLGSHMSQQVSAAVALLSQKAGSQGLSLDALKQAKLPHANIPSATSSLSPGLAPFTLKPDGTRVLPNVMSRLPSALLPQAPGSVLFQSPFSTVALDTSKKGKGKPPNISAVDVKPKDEAALYKHKCRSSLPSTFIRAPPTYVKVEVPGTFVGPSTLSPGMTPLLAAQPRRQAKQHGCTRCGKNFSSASALQIHERTHTGEKPFVCNICGRAFTTKGNLKVHYMTHGANNNSARRGRKLAIENTMALLGTDGKRVSEIFPKEILAPSVNVDPVVWNQYTSMLNGGLAVKTNEISVIQSGGVPTLPVSLGATSVVNNATVSKMDGSQSGISADVEKPSATDGVPKHQFPHFLEENKIAVS

SEQ ID NO: 82706 - protein, 97 aa, Homo sapiens
  Payload ID: 16460
  Gene Symbol: SPANXA2
  Gene Name: SPANX family, member A2
  Uniprot ID: Q9NS26
  ENSP ID: ENSP00000359549
MDKQSSAGGVKRSVPCDSNEANEMMPETPTGDSDPQPAPKKMKTSESSTILVVRYRRNFKRTSPEELLNDHARENRINPLQMEEEEFMEIMVEIPAK

SEQ ID NO: 82707 - protein, 103 aa, Homo sapiens
  Payload ID: 16461
  Gene Symbol: SPANXB1
  Gene Name: SPANX family, member B1
  Uniprot ID: Q9NS25
  ENSP ID: ENSP00000405202
MGQQSSVRRLKRSVPCESNEANEANEANKTMPETPTGDSDPQPAPKKMKTSESSTILVVRYRRNVKRTSPEELLNDHARENRINPDQMEEEEFIEITTERPKK

SEQ ID NO: 82708 - protein, 97 aa, Homo sapiens
  Payload ID: 16462
  Gene Symbol: SPANXC
  Gene Name: SPANX family, member C
  Uniprot ID: Q9NY87
  ENSP ID: ENSP00000351884
MDKQSSAGGVKRSVPCDSNEANEMMPETSSGYSDPQPAPKKLKTSESSTILVVRYRRNVKRTSPEELVNDHARENRINPLQMEEEEFMEIMVEIPAK

SEQ ID NO: 82709 - protein, 97 aa, Homo sapiens
  Payload ID: 16463
  Gene Symbol: SPANXD
  Gene Name: SPANX family, member D
  Uniprot ID: Q9BXN6
  ENSP ID: ENSP00000359546
MDKQSSAGGVKRSVPCDSNEANEMMPETSSGYSDPQPAPKKLKTSESSTILVVRYRRNFKRTSPEELVNDHARKNRINPLQMEEEEFMEIMVEIPAK

SEQ ID NO: 82710 - protein, 72 aa, Homo sapiens
  Payload ID: 16464
  Gene Symbol: SPANXN1
  Gene Name: SPANX family, member N1
  Uniprot ID: Q5VSR9
  ENSP ID: ENSP00000359524
MEQPTSSINGEKRKSPCESNNENDEMQETPNRDLAPEPSLKKMKTSEYSTVLAFCYRKAKKIHSNQLENDQS

SEQ ID NO: 82711 - protein, 180 aa, Homo sapiens
  Payload ID: 16465
  Gene Symbol: SPANXN2
  Gene Name: SPANX family, member N2
  Uniprot ID: Q5MJ10
  ENSP ID: ENSP00000470584
MEQPTSSTNGEKRKSPCESNNKKNDEMQEAPNRVLAPKQSLQKTKTIEYLTIIVYYYRKHTKINSNQLEKDQSRENSINPVQEEEDEGLDSAEGSSQEDEDLDSSEGSSQEDEDLDSSEGSSQEDEDLDSSEGSSQEDEDLDSSEGSSQEDEDLDPPEGSSQEDEDLDSSEGSSQEGGED

SEQ ID NO: 82712 - protein, 141 aa, Homo sapiens
  Payload ID: 16466
  Gene Symbol: SPANXN3
  Gene Name: SPANX family, member N3
  Uniprot ID: Q5MJ09
  ENSP ID: ENSP00000359534
MEQPTSSTNGEKTKSPCESNNKKNDEMQEVPNRVLAPEQSLKNTKTSEYPIIFVYYLRKGKKINSNQLENEQSQENSINPIQKEEDEGVDLSEGSSNEDEDLGPCEGPSKEDKDLDSSEGSSQEDEDLGLSEGSSQDSGED

SEQ ID NO: 82713 - protein, 156 aa, Homo sapiens
  Payload ID: 16467
  Gene Symbol: SPANXN4
  Gene Name: SPANX family, member N4
  ENSP ID: ENSP00000359535
MEEPTSSTNENKMKSPCESNKRKVDKKKNLHRASAPEQSLKETEKAKYPTLVFYCRKNKKRNSNQLENNQPTESSTDPIKEKGDLDISAGSPQDGEEEKDLVFLGARACLEEHIRRSVLYVGDSDTLSKMKTSESPPSGHIPQSGVFCNSPNAVSN

SEQ ID NO: 82714 - protein, 99 aa, Homo sapiens
  Payload ID: 16467
  Gene Symbol: SPANXN4
  Gene Name: SPANX family, member N4
  Uniprot ID: Q5MJ08
  ENSP ID: ENSP00000405210
MEEPTSSTNENKMKSPCESNKRKVDKKKKNLHRASAPEQSLKETEKAKYPTLVFYCRKNKKRNSNQLENNQPTESSTDPIKEKGDLDISAGSPQDGGQN

SEQ ID NO: 82715 - protein, 72 aa, Homo sapiens
  Payload ID: 16468
  Gene Symbol: SPANXN5
  Gene Name: SPANX family, member N5
  Uniprot ID: Q5MJ07
  ENSP ID: ENSP00000364661
MEKPTSSTNGEKRKSPCDSNSKNDEMQETPNRDLVLEPSLKKMKTSEYSTVLVLCYRKTKKIHSNQLENDQS

SEQ ID NO: 82716 - protein, 435 aa, Homo sapiens
  Payload ID: 16469
  Gene Symbol: SMOC1
  Gene Name: SPARC related modular calcium binding 1
  Uniprot ID: Q9H4F8
  ENSP ID: ENSP00000355110
MLPARCARLLTPHLLLVLVQLSPARGHRTTGPRFLISDRDPQCNLHCSRTQPKPICASDGRSYESMCEYQRAKCRDPTLGVVHRGRCKDAGQSKCRLERAQALEQAKKPQEAVFVPECGEDGSFTQVQCHTYTGYCWCVTPDGKPISGSSVQNKTPVCSGSVTDKPLSQGNSGRKDDGSKPTPTMETQPVFDGDEITAPTLWIKHLVIKDSKLNNTNIRNSEKVYSCDQERQSALEEAQQNPREGIVIPECAPGGLYKPVQCHQSTGYCWCVLVDTGRPLPGTSTRYVMPSCESDARAKTTEADDPFKDRELPGCPEGKKMEFITSLLDALTTDMVQAINSAAPTGGGRFSEPDPSHTLEERVVHWYFSQLDSNSSNDINKREMKPFKRYVKKKAKPKKCARRFTDYCDLNKDKVISLPELKGCLGVSKEVGRLV

SEQ ID NO: 82717 - protein, 434 aa, Homo sapiens
  Payload ID: 16469
  Gene Symbol: SMOC1
  Gene Name: SPARC related modular calcium binding 1
  Uniprot ID: Q9H4F8
  ENSP ID: ENSP00000370680
MLPARCARLLTPHLLLVLVQLSPARGHRTTGPRFLISDRDPQCNLHCSRTQPKPICASDGRSYESMCEYQRAKCRDPTLGVVHRGRCKDAGQSKCRLERAQALEQAKKPQEAVFVPECGEDGSFTQVQCHTYTGYCWCVTPDGKPISGSSVQNKTPVCSGSVTDKPLSQGNSGRKDDGSKPTPTMETQPVFDGDEITAPTLWIKHLVIKDSKLNNTNIRNSEKVYSCDQERQSALEEAQQNPREGIVIPECAPGGLYKPVQCHQSTGYCWCVLVDTGRPLPGTSTRYVMPSCESDARAKTTEADDPFKDRELPGCPEGKKMEFITSLLDALTTDMVQAINSAAPTGGGRFSEPDPSHTLEERVVHWYFSQLDSNSSNDINKREMKPFKRYVKKKAKPKKCARRFTDYCDLNKDKVISLPELKGCLGVSKEGRLV

SEQ ID NO: 82718 - protein, 457 aa, Homo sapiens
  Payload ID: 16470
  Gene Symbol: SMOC2
  Gene Name: SPARC related modular calcium binding 2
  Uniprot ID: Q9H3U7
  ENSP ID: ENSP00000346537
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTVSLQIFSVLNSDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQPRKQG

SEQ ID NO: 82719 - protein, 446 aa, Homo sapiens
  Payload ID: 16470
  Gene Symbol: SMOC2
  Gene Name: SPARC related modular calcium binding 2
  Uniprot ID: Q9H3U7
  ENSP ID: ENSP00000348630
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQPRKQG

SEQ ID NO: 82720 - protein, 67 aa, Homo sapiens
  Payload ID: 16470
  Gene Symbol: SMOC2
  Gene Name: SPARC related modular calcium binding 2
  ENSP ID: ENSP00000375949
GKKEIKPFKRFLRKKSKPKKCVKKFVEYCDVNNDKSISVQELMGCLGVAKEDGKADTKKRHRSKRNL

SEQ ID NO: 82721 - protein, 84 aa, Homo sapiens
  Payload ID: 16470
  Gene Symbol: SMOC2
  Gene Name: SPARC related modular calcium binding 2
  ENSP ID: ENSP00000398696
KKSKPKKCVKKFVEYCDVNNDKSISVQELMGCLGVAKEDGKADTKKRHTPRGHAESTSNRQDAMVVSSRPKATTHRKSRTLSRR

SEQ ID NO: 82722 - protein, 136 aa, Homo sapiens
  Payload ID: 16470
  Gene Symbol: SMOC2
  Gene Name: SPARC related modular calcium binding 2
  ENSP ID: ENSP00000477975
MVGGCLGGSKSSHSAWEGPILPKCKSSRGVTELANRLVCLVFLLHVDIILLILLPGPPQGYRKVKSSPEPIMSSLLTEGTAGYVVPPGLVLAAGGGAGSPRFLSAFLNASRVRELANGKFIRVALAEKDRSGMPTQ

SEQ ID NO: 82723 - protein, 377 aa, Homo sapiens
  Payload ID: 16471
  Gene Symbol: SPOCK1
  Gene Name: sparc/osteonectin, cwcv and kazal-like domains proteoglycan (testican) 1
  ENSP ID: ENSP00000282223
DDYFRNWNPNKPFDQALDPSKDPCLKVKCSPHKVCVTQDYQTALCVSRKHLLPRQKKGNVAQKHWVGPSNLVKCKPCPVAQSAMVCGSDGHSYTSKCKLEFHACSTGKSLATLCDGPCPCLPEPEPPKHKAERSACTDKELRNLASRLKDWFGALHEDANRVIKPTSSNTAQGRFDTSILPICKDSLGWMFNKLDMNYDLLLDPSEINAIYLDKYEPCIKPLFNSCDSFKDGKLSNNEWCYCFQKPGGLPCQNEMNRIQKLSKGKSLLGAFIPRCNEEGYYKATQCHGSTGQCWCVDKYGNELAGSRKQGAVSCEEEQETSGDFGSGGSVVLLDDLEYERELGPKDKEGKLRVHTRAVTEDDEDEDDDKEDEVGYIW

SEQ ID NO: 82724 - protein, 439 aa, Homo sapiens
  Payload ID: 16471
  Gene Symbol: SPOCK1
  Gene Name: sparc/osteonectin, cwcv and kazal-like domains proteoglycan (testican) 1
  Uniprot ID: Q08629
  ENSP ID: ENSP00000378401
MPAIAVLAAAAAAWCFLQVESRHLDALAGGAGPNHGNFLDNDQWLSTVSQYDRDKYWNRFRDDDYFRNWNPNKPFDQALDPSKDPCLKVKCSPHKVCVTQDYQTALCVSRKHLLPRQKKGNVAQKHWVGPSNLVKCKPCPVAQSAMVCGSDGHSYTSKCKLEFHACSTGKSLATLCDGPCPCLPEPEPPKHKAERSACTDKELRNLASRLKDWFGALHEDANRVIKPTSSNTAQGRFDTSILPICKDSLGWMFNKLDMNYDLLLDPSEINAIYLDKYEPCIKPLFNSCDSFKDGKLSNNEWCYCFQKPGGLPCQNEMNRIQKLSKGKSLLGAFIPRCNEEGYYKATQCHGSTGQCWCVDKYGNELAGSRKQGAVSCEEEQETSGDFGSGGSVVLLDDLEYERELGPKDKEGKLRVHTRAVTEDDEDEDDDKEDEVGYIW

SEQ ID NO: 82725 - protein, 67 aa, Homo sapiens
  Payload ID: 16471
  Gene Symbol: SPOCK1
  Gene Name: sparc/osteonectin, cwcv and kazal-like domains proteoglycan (testican) 1
  ENSP ID: ENSP00000421677
MVCGSDGHSYTSKCKLEFHACSTGKSLATLCDGPCPCLPEPEPPKHKAERSACTDKELRNLASRLKD

SEQ ID NO: 82726 - protein, 139 aa, Homo sapiens
  Payload ID: 16471
  Gene Symbol: SPOCK1
  Gene Name: sparc/osteonectin, cwcv and kazal-like domains proteoglycan (testican) 1
  ENSP ID: ENSP00000424517
MPAIAVLAAAAAAWCFLQVESRHLDALAGGAGPNHGNFLDNDQWLSTVSQYDRDKYWNRFRDDDYFRNWNPNKPFDQALDPSKDPCLKVKCSPHKVCVTQDYQTALCVSRKHLLPRQKKGNVAQKHWVGPSNLVKCKPC

SEQ ID NO: 82727 - protein, 424 aa, Homo sapiens
  Payload ID: 16472
  Gene Symbol: SPOCK2
  Gene Name: sparc/osteonectin, cwcv and kazal-like domains proteoglycan (testican) 2
  Uniprot ID: Q92563
  ENSP ID: ENSP00000321108
MRAPGCGRLVLPLLLLAAAALAEGDAKGLKEGETPGNFMEDEQWLSSISQYSGKIKHWNRFRDEVEDDYIKSWEDNQQGDEALDTTKDPCQKVKCSRHKVCIAQGYQRAMCISRKKLEHRIKQPTVKLHGNKDSICKPCHMAQLASVCGSDGHTYSSVCKLEQQACLSSKQLAVRCEGPCPCPTEQAATSTADGKPETCTGQDLADLGDRLRDWFQLLHENSKQNGSASSVAGPASGLDKSLGASCKDSIGWMFSKLDTSADLFLDQTELAAINLDKYEVCIRPFFNSCDTYKDGRVSTAEWCFCFWREKPPCLAELERIQIQEAAKKKPGIFIPSCDEDGYYRKMQCDQSSGDCWCVDQLGLELTGTRTHGSPDCDDIVGFSGDFGSGVGWEDEEEKETEEAGEEAEEEEGEAGEADDGGYIW

SEQ ID NO: 82728 - protein, 424 aa, Homo sapiens; identical to SEQ ID NO: 82727
  Payload ID: 16472
  Gene Symbol: SPOCK2
  Gene Name: sparc/osteonectin, cwcv and kazal-like domains proteoglycan (testican) 2
  Uniprot ID: Q92563
  ENSP ID: ENSP00000362201

SEQ ID NO: 82729 - protein, 77 aa, Homo sapiens
  Payload ID: 16472
  Gene Symbol: SPOCK2
  Gene Name: sparc/osteonectin, cwcv and kazal-like domains proteoglycan (testican) 2
  Uniprot ID: Q92563
  ENSP ID: ENSP00000397715
MRAPGCGRLVLPLLLLAAAALAEGDAKGLKEGETPGNFMEDEQWLSSISQYSGKIKHWNRFRDVPSSDPPSTTQATP

SEQ ID NO: 82730 - protein, 423 aa, Homo sapiens [sequence omitted]

SEQ ID NO: 82731 - protein, 436 aa, Homo sapiens
  Payload ID: 16473
  Gene Symbol: SPOCK3
  Gene Name: sparc/osteonectin, cwcv and kazal-like domains proteoglycan (testican) 3
  Uniprot ID: Q9BQ16
  ENSP ID: ENSP00000349677
MLKVSAVLCVCAAAWCSQSLAAAAAVAAAGGRSDGGNFLDDKQWLTTISQYDKEVGQWNKFRDEVEDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 82732 - protein, 433 aa, Homo sapiens
  Payload ID: 16473
  Gene Symbol: SPOCK3
  Gene Name: sparc/osteonectin, cwcv and kazal-like domains proteoglycan (testican) 3
  Uniprot ID: Q9BQ16
  ENSP ID: ENSP00000350153
MLKVSAVLCVCAAAWCSQSLAAAAAVAAAGGRSDGGNFLDDKQWLTTISQYDKEVGQWNKFRDDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 82733 - protein, 385 aa, Homo sapiens
  Payload ID: 16473
  Gene Symbol: SPOCK3
  Gene Name: sparc/osteonectin, cwcv and kazal-like domains proteoglycan (testican) 3
  Uniprot ID: Q9BQ16
  ENSP ID: ENSP00000411344
MITQDHIHMSSGLSQDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 82734 - protein, 436 aa, Homo sapiens; identical to SEQ ID NO: 82731
  Payload ID: 16473
  Gene Symbol: SPOCK3
  Gene Name: sparc/osteonectin, cwcv and kazal-like domains proteoglycan (testican) 3
  Uniprot ID: Q9BQ16
  ENSP ID: ENSP00000420920

SEQ ID NO: 82735 - protein, 122 aa, Homo sapiens
  Payload ID: 16473
  Gene Symbol: SPOCK3
  Gene Name: sparc/osteonectin, cwcv and kazal-like domains proteoglycan (testican) 3
  ENSP ID: ENSP00000420928
MLKVSAVLCVCAAAWCSQSLAAAAAVAAAGGRSDGGNFLDDKQWLTTISQYDKEVGQWNKFRDEVEDDYFRTWSPGKPFDQALDPAKDPCLKMKCSRHKVCIAQDSQTAVCISHRRLTHSAN

SEQ ID NO: 82736 - protein, 64 aa, Homo sapiens
  Payload ID: 16473
  Gene Symbol: SPOCK3
  Gene Name: sparc/osteonectin, cwcv and kazal-like domains proteoglycan (testican) 3
  ENSP ID: ENSP00000422170
MLKVSAVLCVCAAAWCSQSLAAAAAVAAAGGRSDGGNFLDDKQWLTTISQYDKEVGQWNKFRDL

SEQ ID NO: 82737 - protein, 122 aa, Homo sapiens; identical to SEQ ID NO: 82735
  Payload ID: 16473
  Gene Symbol: SPOCK3
  Gene Name: sparc/osteonectin, cwcv and kazal-like domains proteoglycan (testican) 3
  ENSP ID: ENSP00000422336

SEQ ID NO: 82738 - protein, 172 aa, Homo sapiens
  Payload ID: 16473
  Gene Symbol: SPOCK3
  Gene Name: sparc/osteonectin, cwcv and kazal-like domains proteoglycan (testican) 3
  ENSP ID: ENSP00000423176
MLKVSAVLCVCAAAWCSQSLAAAAAVAAAGGRSDGGNFLDDKQWLTTISQYDKEVGQWNKFRDDDYFRTWSPGKPFDQACSDLEFREVANRLRDWFKALHESGSQNKKTKTLLRPERSRFDTSILPICKDSLGWMFNRLDTNYDLLLDQSELRSIYLDKNEQCTKAFFNSCD

SEQ ID NO: 82739 - protein, 161 aa, Homo sapiens
  Payload ID: 16473
  Gene Symbol: SPOCK3
  Gene Name: sparc/osteonectin, cwcv and kazal-like domains proteoglycan (testican) 3
  ENSP ID: ENSP00000423367
MLKVSAVLCVCAAAWCSQSLAAAAAVAAAGGRSDGGNFLDDKQWLTTISQYDKEVGQWNKFRDDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKL

SEQ ID NO: 82740 - protein, 436 aa, Homo sapiens; identical to SEQ ID NO: 82731
  Payload ID: 16473
  Gene Symbol: SPOCK3
  Gene Name: sparc/osteonectin, cwcv and kazal-like domains proteoglycan (testican) 3
  Uniprot ID: Q9BQ16
  ENSP ID: ENSP00000423421

SEQ ID NO: 82741 - protein, 436 aa, Homo sapiens; identical to SEQ ID NO: 82731
  Payload ID: 16473
  Gene Symbol: SPOCK3
  Gene Name: sparc/osteonectin, cwcv and kazal-like domains proteoglycan (testican) 3
  Uniprot ID: Q9BQ16
  ENSP ID: ENSP00000423606

SEQ ID NO: 82742 - protein, 115 aa, Homo sapiens
  Payload ID: 16473
  Gene Symbol: SPOCK3
  Gene Name: sparc/osteonectin, cwcv and kazal-like domains proteoglycan (testican) 3
  ENSP ID: ENSP00000424168
MLKVSAVLCVCAAAWCSQSLAAAAAVAAAGGRSDGGNFLDDKQWLTTISQYDKEVGQWNKFRDEVEDDYFRTWSPGKPFDQALDPAKDPCLKMKCSRHKVCIAQDSQTAVCISHR

SEQ ID NO: 82743 - protein, 79 aa, Homo sapiens
  Payload ID: 16473
  Gene Symbol: SPOCK3
  Gene Name: sparc/osteonectin, cwcv and kazal-like domains proteoglycan (testican) 3
  ENSP ID: ENSP00000424674
MLKVSAVLCVCAAAWCSQSLAAAAAVAAAGGRSDGGNFLDDKQWLTTISQYDKEVGQWNKFRDDDYFRTWSPGKPFDQG

SEQ ID NO: 82744 - protein, 71 aa, Homo sapiens
  Payload ID: 16473
  Gene Symbol: SPOCK3
  Gene Name: sparc/osteonectin, cwcv and kazal-like domains proteoglycan (testican) 3
  ENSP ID: ENSP00000424677
MLKVSAVLCVCAAAWCSQSLAAAAAVAAAGGRSDGGNFLDDKQWLTTISQYDKEVGQWNKFRDDERSRSRP

SEQ ID NO: 82745 - protein, 63 aa, Homo sapiens
  Payload ID: 16473
  Gene Symbol: SPOCK3
  Gene Name: sparc/osteonectin, cwcv and kazal-like domains proteoglycan (testican) 3
  ENSP ID: ENSP00000424980
MLKVSAVLCVCAAAWCSQSLAAAAAVAAAGGRSDGGNFLDDKQWLTTISQYDKEVGQWNKFRD

SEQ ID NO: 82746 - protein, 115 aa, Homo sapiens; identical to SEQ ID NO: 82742
  Payload ID: 16473
  Gene Symbol: SPOCK3
  Gene Name: sparc/osteonectin, cwcv and kazal-like domains proteoglycan (testican) 3
  ENSP ID: ENSP00000425407

SEQ ID NO: 82747 - protein, 433 aa, Homo sapiens; identical to SEQ ID NO: 82732
  Payload ID: 16473
  Gene Symbol: SPOCK3
  Gene Name: sparc/osteonectin, cwcv and kazal-like domains proteoglycan (testican) 3
  Uniprot ID: Q9BQ16
  ENSP ID: ENSP00000425502

SEQ ID NO: 82748 - protein, 433 aa, Homo sapiens; identical to SEQ ID NO: 82732
  Payload ID: 16473
  Gene Symbol: SPOCK3
  Gene Name: sparc/osteonectin, cwcv and kazal-like domains proteoglycan (testican) 3
  Uniprot ID: Q9BQ16
  ENSP ID: ENSP00000425570

SEQ ID NO: 82749 - protein, 79 aa, Homo sapiens; identical to SEQ ID NO: 82743
  Payload ID: 16473
  Gene Symbol: SPOCK3
  Gene Name: sparc/osteonectin, cwcv and kazal-like domains proteoglycan (testican) 3
  ENSP ID: ENSP00000425712

SEQ ID NO: 82750 - protein, 83 aa, Homo sapiens
  Payload ID: 16473
  Gene Symbol: SPOCK3
  Gene Name: sparc/osteonectin, cwcv and kazal-like domains proteoglycan (testican) 3
  ENSP ID: ENSP00000425859
NFLDDKQWLTTISQYDKEVGQWNKFRDDDYFRTWSPGKPFDQALDPAKDPCLKMKCSRHKVCIAQDSQTAVCISHRRLTHSAN

SEQ ID NO: 82751 - protein, 313 aa, Homo sapiens
  Payload ID: 16473
  Gene Symbol: SPOCK3
  Gene Name: sparc/osteonectin, cwcv and kazal-like domains proteoglycan (testican) 3
  Uniprot ID: Q9BQ16
  ENSP ID: ENSP00000426177
MLKVSAVLCVCAAAWCSQSLAAAAAVAAAGGRSDGGNFLDDKQWLTTISQYDKEVGQWNKFRDDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQGKR

SEQ ID NO: 82752 - protein, 338 aa, Homo sapiens
  Payload ID: 16473
  Gene Symbol: SPOCK3
  Gene Name: sparc/osteonectin, cwcv and kazal-like domains proteoglycan (testican) 3
  Uniprot ID: Q9BQ16
  ENSP ID: ENSP00000426318
MLKVSAVLCVCAAAWCSQSLAAAAAVAAAGGRSDGGNFLDDKQWLTTISQYDKEVGQWNKFRDCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 82753 - protein, 393 aa, Homo sapiens
  Payload ID: 16473
  Gene Symbol: SPOCK3
  Gene Name: sparc/osteonectin, cwcv and kazal-like domains proteoglycan (testican) 3
  Uniprot ID: Q9BQ16
  ENSP ID: ENSP00000426716
MLKVSAVLCVCAAAWCSQSLAAAAAVAAAGGRSDGGNFLDDKQWLTTISQYDKEVGQWNKFRDDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRGFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 82754 - protein, 89 aa, Homo sapiens
  Payload ID: 16473
  Gene Symbol: SPOCK3
  Gene Name: sparc/osteonectin, cwcv and kazal-like domains proteoglycan (testican) 3
  ENSP ID: ENSP00000426995
MLKVSAVLCVCAAAWCSQSLAAAAAVAAAGGRSDGGNFLDDKQWLTTISQYDKEVGQWNKFRDDDYFRTWSPGKPFDQALSFHDLGIFV

SEQ ID NO: 82755 - protein, 344 aa, Homo sapiens
  Payload ID: 16473
  Gene Symbol: SPOCK3
  Gene Name: sparc/osteonectin, cwcv and kazal-like domains proteoglycan (testican) 3
  ENSP ID: ENSP00000441396
MKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 82756 - protein, 316 aa, Homo sapiens
  Payload ID: 16473
  Gene Symbol: SPOCK3
  Gene Name: sparc/osteonectin, cwcv and kazal-like domains proteoglycan (testican) 3
  Uniprot ID: Q9BQ16
  ENSP ID: ENSP00000444789
MKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPICKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 82757 - protein, 664 aa, Homo sapiens
  Payload ID: 16474
  Gene Symbol: SPARCL1
  Gene Name: SPARC-like 1 (hevin)
  Uniprot ID: Q14515
  ENSP ID: ENSP00000282470
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMSEPQEKKLSENTDFLAPGVSSFTDSNQQESITKREENQEQPRNYSHHQLNRSSKHSQGLRDQGNQEQDPNISNGEEEEEKEPGEVGTHNDNQERKTELPREHANSKQEEDNTQSDDILEESDQPTQVSKMQEDEFDQGNQEQEDNSNAEMEEENASNVNKHIQETEWQSQEGKTGLEAISNHKETEEKTVSEALLMEPTDDGNTTPRNHGVDDDGDDDGDDGGTDGPRHSASDDYFIPSQAFLEAERAQSIAYHLKIEEQREKVHENENIGTTEPGEHQEAKKAENSSNEEETSSEGNMRVHAVDSCMSFQCKRGHICKADQQGKPHCVCQDPVTCPPTKPLDQVCGTDNQTYASSCHLFATKCRLEGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 82758 - protein, 56 aa, Homo sapiens
  Payload ID: 16474
  Gene Symbol: SPARCL1
  Gene Name: SPARC-like 1 (hevin)
  ENSP ID: ENSP00000406251
MKTGLFFLCLLGTAAAIPTNARLLSDHSKPTAETVAPDNTAIPSLRAEAEENEKET

SEQ ID NO: 82759 - protein, 664 aa, Homo sapiens; identical to SEQ ID NO: 82757
  Payload ID: 16474
  Gene Symbol: SPARCL1
  Gene Name: SPARC-like 1 (hevin)
  Uniprot ID: Q14515
  ENSP ID: ENSP00000414856

SEQ ID NO: 82760 - protein, 141 aa, Homo sapiens
  Payload ID: 16474
  Gene Symbol: SPARCL1
  Gene Name: SPARC-like 1 (hevin)
  ENSP ID: ENSP00000416971
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMSEPQEKKLSENTDFL

SEQ ID NO: 82761 - protein, 539 aa, Homo sapiens
  Payload ID: 16474
  Gene Symbol: SPARCL1
  Gene Name: SPARC-like 1 (hevin)
  Uniprot ID: Q14515
  ENSP ID: ENSP00000422903
MSEPQEKKLSENTDFLAPGVSSFTDSNQQESITKREENQEQPRNYSHHQLNRSSKHSQGLRDQGNQEQDPNISNGEEEEEKEPGEVGTHNDNQERKTELPREHANSKQEEDNTQSDDILEESDQPTQVSKMQEDEFDQGNQEQEDNSNAEMEEENASNVNKHIQETEWQSQEGKTGLEAISNHKETEEKTVSEALLMEPTDDGNTTPRNHGVDDDGDDDGDDGGTDGPRHSASDDYFIPSQAFLEAERAQSIAYHLKIEEQREKVHENENIGTTEPGEHQEAKKAENSSNEEETSSEGNMRVHAVDSCMSFQCKRGHICKADQQGKPHCVCQDPVTCPPTKPLDQVCGTDNQTYASSCHLFATKCRLEGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 82762 - protein, 120 aa, Homo sapiens
  Payload ID: 16474
  Gene Symbol: SPARCL1
  Gene Name: SPARC-like 1 (hevin)
  ENSP ID: ENSP00000423448
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTL

SEQ ID NO: 82763 - protein, 143 aa, Homo sapiens
  Payload ID: 16474
  Gene Symbol: SPARCL1
  Gene Name: SPARC-like 1 (hevin)
  ENSP ID: ENSP00000423483
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMSEPQEKKLSENTDFLAP

SEQ ID NO: 82764 - protein, 127 aa, Homo sapiens
  Payload ID: 16474
  Gene Symbol: SPARCL1
  Gene Name: SPARC-like 1 (hevin)
  ENSP ID: ENSP00000438188
MKTGLFFLCLLGTAAAIPTNARLLSDHSKPTAETVAPDNTAIPSLRAEAEENEKETAVSTEDDSHHKAEKSSVLKSKEESHEQSAEQGKSSSQELGLKDQEDSDGHLSVNLEYAPTEGTLDIKEDMS

SEQ ID NO: 82765 - protein, 89 aa, Homo sapiens
  Payload ID: 16474
  Gene Symbol: SPARCL1
  Gene Name: SPARC-like 1 (hevin)
  ENSP ID: ENSP00000444832
MKTGLFFLCLLGTAAAIPTNARLLSDHSKPTAETVAPDNTAIPSLRAEAEENEKETAVSTEDDSHHKAEKSSVLKSKEESHEQSAEQGK

SEQ ID NO: 82766 - protein, 18 aa, Homo sapiens
  Payload ID: 16474
  Gene Symbol: SPARCL1
  Gene Name: SPARC-like 1 (hevin)
  ENSP ID: ENSP00000445678
MSEPQEKKLSENTDFLAP

SEQ ID NO: 82767 - protein, 2443 aa, Homo sapiens
  Payload ID: 16475
  Gene Symbol: SPG11
  Gene Name: spastic paraplegia 11 (autosomal recessive)
  Uniprot ID: Q96JI7
  ENSP ID: ENSP00000261866
MAAEEGVASAASAGGSWGTAAMGRVLPMLLVPVPAEAMGQLGSRAQLRTQPEALGSLTAAGSLQVLSLTPGSRGGGRCCLEGPFWHFLWEDSRNSSTPTEKPKLLALGENYELLIYEFNLKDGRCDATILYSCSREALQKLIDDQDISISLLSLRILSFHNNTSLLFINKCVILHIIFPERDAAIRVLNCFTLPLPAQAVDMIIDTQLCRGILFVLSSLGWIYIFDVVDGTYVAHVDLALHKEDMCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVEILKEKNYFSEKEKRTIDFVHQVEKLYLGHFQENMQIQSFPRYWIKEQDFFKHKSVLDSFLKYDCKDEFNKQDHRIVLNWALWWDQLTQESILLPRISPEEYKSYSPEALWRYLTARHDWLNIILWIGEFQTQHSYASLQQNKWPLLTVDVINQNTSCNNYMRNEILDKLARNGVFLASELEDFECFLLRLSRIGGVIQDTLPVQNYKTKEGWDFHSQFILYCLEHSLQHLLYVYLDCYKLSPENCPFLEKKELHEAHPWFEFLVQCRQVASNLTDPKLIFQASLANAQILIPTNQASVSSMLLEGHTLLALATTMYSPGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQLIQQVGNEAYVIGLSSFHIPSIGAACVCFLELLGLDSLKLRVDMKVANIILSYKCRNEDAQYSFIRESVAEKLSKLADGEKTTTEELLVLLEEGTWNSIQQQEIKRLSSESSSQWALVVQFCRLHNMKLSISYLRECAKANDWLQFIIHSQLHNYHPAEVKSLIQYFSPVIQDHLRLAFENLPSVPTSKMDSDQVCNKCPQELQGSKQEMTDLFEILLQCSEEPDSWHWLLVEAVKQQAPILSVLASCLQGASAISCLCVWIITSVEDNVATEAMGHIQDSTEDHTWNLEDLSVIWRTLLTRQKSKTLIRGFQLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGPDVKKLCILCQILKDTSIAINHTIITSYSIENLQHECRSILERLQTDGQFALARRVAELAELPVDNLVIKEITQEMQTLKHIEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEEEAPDIPLRRVHSTSSLDSQKFVTVPSSNEVVTNLEVLTSKCLHGKNYCRQVLCLYDLAKELGCSYTDVAAQDGEAMLRKILASQQPDRCKRAQAFISTQGLKPDTVAELVAEEVTRELLTSSQGTGHKQMFNPTEESQTFLQLTTLCQDRTLVGMKLLDKISSVPHGELSCTTELLILAHHCFTLTCHMEGIIRVLQAAHMLTDNHLAPSEEYGLVVRLLTGIGRYNEMTYIFDLLHKKHYFEVLMRKKLDPSGTLKTALLDYIKRCRPGDSEKHNMIALCFSMCREIGENHEAAARIQLKLIESQPWEDSLKDGHQLKQLLLKALTLMLDAAESYAKDSCVRQAQHCQRLTKLITLQIHFLNTGQNTMLINLGRHKLMDCILALPRFYQASIVAEAYDFVPDWAEILYQQVILKGDFNYLEEFKQQRLLKSSIFEEISKKYKQHQPTDMVMENLKKLLTYCEDVYLYYKLAYEHKFYEIVNVLLKDPQTGCCLKDMLAG

SEQ ID NO: 82768 - protein, 2265 aa, Homo sapiens
  Payload ID: 16475
  Gene Symbol: SPG11
  Gene Name: spastic paraplegia 11 (autosomal recessive)
  ENSP ID: ENSP00000396110
MAAEEGVASAASAGGSWGTAAMGRVLPMLLVPVPAEAMGQLGSRAQLRTQPEALGSLTAAGSLQVLSLTPGSRGGGRCCLEGPFWHFLWEDSRNSSTPTEKPKLLALGENYELLIYEFNLKDGRCDATILYSCSREALQKLIDDQDISISLLSLRILSFHNNTSLLFINKCVILHIIFPERDAAIRVLNCFTLPLPAQAVDMIIDTQLCRGILFVLSSLGWIYIFDVVDGTYVAHVDLALHKEDMCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVEILKEKNYFSEKEKRTIDFVHQVEKLYLGHFQENMQIQSFPRYWIKEQDFFKHKSVLDSFLKYDCKDEFNKQDHRIVLNWALWWDQLTQESILLPRISPEEYKSYSPEALWRYLTARHDWLNIILWIGEFQTQHSYASLQQNKWPLLTVDVINQNTSCNNYMRNEILDKLARNGVFLASELEDFECFLLRLSRIGGVIQDTLPVQNYKTKEGWDFHSQFILYCLEHSLQHLLYVYLDCYKLSPENCPFLEKKELHEAHPWFEFLVQCRQVASNLTDPKLIFQASLANAQILIPTNQASVSSMLLEGHTLLALATTMYSPGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQLIQQVGNEAYVIGLSSFHIPSIGAACVCFLELLGLDSLKLRVDMKVANIILSYKCRNEDAQYSFIRESVAEKLSKLADGEKTTTEELLVLLEEGTWNSIQQQEIKRLSSESSSQWALVVQFCRLHNMKLSISYLRECAKANDWLQFIIHSQLHNYHPAEVKSLIQYFSPVIQDHLRLAFENLPSVPTSKMDSDQVCNKCPQELQGSKQEMTDLFEILLQCSEEPDSWHWLLVEAVKQQAPILSVLASCLQGASAISCLCVWIITSVEDNVATEAMGHIQDSTEDHTWNLEDLSVIWRTLLTRQKSKTLIRGFQLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGPDVKKLCILCQILKDTSIAINHTIITSYSIENLQHECRSILERLQTDGQFALARRVAELAELPVDNLVIKEITQEMQTLKHIEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEEEAPDIPLRRVHSTSSLDSQKFVTVPSSNEVVTNLEVLTSKCLHGKNYCRQVLCLYDLAKELGCSYTDVAAQDGEAMLRKILASQQPDRCKRAQAFISTQGLKPDTVAELVAEEVTRELLTSSQGTGHKQMFNPTEESQTFLQLTTLCQDRTLVGMKLLDKISSVPHGELSCTTELLILAHHCFTLTCHMEGIIRVLQAAHMLTDNHLAPSEEYGLVVRLLTGIGRYNEMTYIFDLLHKKHYFEVLMRKKLDPSGTLKTALLDYIKRCRPGDSEKHNMIALCFSMCREIGENHEAAARIQLKLIESQPWDINNISLLTWSWKT

SEQ ID NO: 82769 - protein, 2330 aa, Homo sapiens
  Payload ID: 16475
  Gene Symbol: SPG11
  Gene Name: spastic paraplegia 11 (autosomal recessive)
  Uniprot ID: Q96JI7
  ENSP ID: ENSP00000445278
MAAEEGVASAASAGGSWGTAAMGRVLPMLLVPVPAEAMGQLGSRAQLRTQPEALGSLTAAGSLQVLSLTPGSRGGGRCCLEGPFWHFLWEDSRNSSTPTEKPKLLALGENYELLIYEFNLKDGRCDATILYSCSREALQKLIDDQDISISLLSLRILSFHNNTSLLFINKCVILHIIFPERDAAIRVLNCFTLPLPAQAVDMIIDTQLCRGILFVLSSLGWIYIFDVVDGTYVAHVDLALHKEDMCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVEILKEKNYFSEKEKRTIDFVHQVEKLYLGHFQENMQIQSFPRYWIKEQDFFKHKSVLDSFLKYDCKDEFNKQDHRIVLNWALWWDQLTQESILLPRISPEEYKSYSPEALWRYLTARHDWLNIILWIGEFQTQHSYASLQQNKWPLLTVDVINQNTSCNNYMRNEILDKLARNGVFLASELEDFECFLLRLSRIGGVIQDTLPVQNYKTKEGWDFHSQFILYCLEHSLQHLLYVYLDCYKLSPENCPFLEKKELHEAHPWFEFLVQCRQVASNLTDPKLIFQASLANAQILIPTNQASVSSMLLEGHTLLALATTMYSPGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQLIQQVGNEAYVIGLSSFHIPSIGAACVCFLELLGLDSLKLRVDMKVANIILSYKCRNEDAQYSFIRESVAEKLSKLADGEKTTTEELLVLLEEGTWNSIQQQEIKRLSSESSSQWALVVQFCRLHNMKLSISYLRECAKANDWLQFIIHSQLHNYHPAEVKSLIQYFSPVIQDHLRLAFENLPSVPTSKMDSDQVCNKCPQELQGSKQEMTDLFEILLQCSEEPDSWHWLLVEAVKQQAPILSVLASCLQGASAISCLCVWIITSVEDNVATEAMGHIQDSTEDHTWNLEDLSVIWRTLLTRQKSKTLIRGFQLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGPDVKKLCILCQILKDTSIAINHTIITSYSIENLQHECRSILERLQTDGQFALARRVAELAELPVDNLVIKEITQEMQTLKHIEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEEEAPDIPLRRVHSRHKQMFNPTEESQTFLQLTTLCQDRTLVGMKLLDKISSVPHGELSCTTELLILAHHCFTLTCHMEGIIRVLQAAHMLTDNHLAPSEEYGLVVRLLTGIGRYNEMTYIFDLLHKKHYFEVLMRKKLDPSGTLKTALLDYIKRCRPGDSEKHNMIALCFSMCREIGENHEAAARIQLKLIESQPWEDSLKDGHQLKQLLLKALTLMLDAAESYAKDSCVRQAQHCQRLTKLITLQIHFLNTGQNTMLINLGRHKLMDCILALPRFYQASIVAEAYDFVPDWAEILYQQVILKGDFNYLEEFKQQRLLKSSIFEEISKKYKQHQPTDMVMENLKKLLTYCEDVYLYYKLAYEHKFYEIVNVLLKDPQTGCCLKDMLAG

SEQ ID NO: 82770 - protein, 43 aa, Homo sapiens
  Payload ID: 16475
  Gene Symbol: SPG11
  Gene Name: spastic paraplegia 11 (autosomal recessive)
  ENSP ID: ENSP00000452629
HSYASLQQNKWPLLTVDVINQNTSCNNYMRNEILDKLARYYNC

SEQ ID NO: 82771 - protein, 131 aa, Homo sapiens
  Payload ID: 16475
  Gene Symbol: SPG11
  Gene Name: spastic paraplegia 11 (autosomal recessive)
  ENSP ID: ENSP00000452744
  MOD_RES (1)..(1): Any amino acid
XSSKAASSFFSTQAHVACEHPTGWSSMEERHLLLTLAGHWLAQEDVVPLDKLEELEKQIWLCRITQHTLGRNQEETEPRFSRQISTSGELSFDSLAKHWPQGKLVWRICTQRSMLSYKVLSCLRKKHPTFP

SEQ ID NO: 82772 - protein, 99 aa, Homo sapiens
  Payload ID: 16475
  Gene Symbol: SPG11
  Gene Name: spastic paraplegia 11 (autosomal recessive)
  ENSP ID: ENSP00000452991
QLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGKED

SEQ ID NO: 82773 - protein, 156 aa, Homo sapiens
  Payload ID: 16475
  Gene Symbol: SPG11
  Gene Name: spastic paraplegia 11 (autosomal recessive)
  ENSP ID: ENSP00000453227
FTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRSKWNKDFYICIY

SEQ ID NO: 82774 - protein, 102 aa, Homo sapiens
  Payload ID: 16475
  Gene Symbol: SPG11
  Gene Name: spastic paraplegia 11 (autosomal recessive)
  ENSP ID: ENSP00000453238
LIQYFSPVIQDHLRLAFENLPSVPTSKMDSDQVCNKCPQELQGSKQEMTDLFEILLQCSEEPDSWHWLLVEAVKQQAPILSVLASCLQVRIMRSLKIPRYYW

SEQ ID NO: 82775 - protein, 567 aa, Homo sapiens
  Payload ID: 16475
  Gene Symbol: SPG11
  Gene Name: spastic paraplegia 11 (autosomal recessive)
  ENSP ID: ENSP00000453246
  MOD_RES (1)..(1): Any amino acid
XEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEEEAPDIPLRRVHSTTELLILAHHCFTLTCHMEGIIRVLQAAHMLTDNHLAPSEEYGLVVRLLTGIGRYNEMTYIFDLLHKKHYFEVLMRKKLDPSGTLKTALLDYIKRCRPGDSEKHNMIALCFSMCREIGENHEAAARIQLKLIESQPWEDSLKDGHQLKQLLLKALTLMLDAAESYAKDSCVRQAQHCQRLTKLITLQIHFLNTGQNTMLINLGRHKLMDCILALPRFYQASIVAEAYDFVPDWAEILYQQVILKGDFNYLEEFKQQRLLKSSIFEEISKKYKQHQPTDMVMENLKKLLTYCEDVYLYYKLAYEHKFYEIVNVLLKDPQTGCCLKDMLAG

SEQ ID NO: 82776 - protein, 250 aa, Homo sapiens
  Payload ID: 16475
  Gene Symbol: SPG11
  Gene Name: spastic paraplegia 11 (autosomal recessive)
  ENSP ID: ENSP00000453314
TGHKQMFNPTEESQTFLQLTTLCQDRTLVGMKLLDKISSVPHGELSCTTELLILAHHCFTLTCHMEGIIRVLQAAHMLTDNHLAPSEEYGLVSGTLKTALLDYIKRCRPGDSEKHNMIALCFSMCREIGENHEAAARIQLKLIESQPWEDSLKDGHQLKQLLLKALTLMLDAAESYAKDSCVRQAQHCQRLTKLITLQIHFLNTGQNTMLINLGRHKLMDCILALPRFYQASIVAEAYDFVPDWAEILYQ

SEQ ID NO: 82777 - protein, 107 aa, Homo sapiens
  Payload ID: 16475
  Gene Symbol: SPG11
  Gene Name: spastic paraplegia 11 (autosomal recessive)
  ENSP ID: ENSP00000453490
  MOD_RES (1)..(1): Any amino acid
XPGGVSQVVQNEENENCLKKVDPQLLKMALTPYPKLKTALFPQCTPPSVLPSDITIYHLIQSLSPFDPSRLFGWQSANTLAIGGIRSQCEKSLEFHEKTQLYFRNKL

SEQ ID NO: 82778 - protein, 2079 aa, Homo sapiens
  Payload ID: 16475
  Gene Symbol: SPG11
  Gene Name: spastic paraplegia 11 (autosomal recessive)
  Uniprot ID: Q96JI7
  ENSP ID: ENSP00000453599
MAAEEGVASAASAGGSWGTAAMGRVLPMLLVPVPAEAMGQLGSRAQLRTQPEALGSLTAAGSLQVLSLTPGSRGGGRCCLEGPFWHFLWEDSRNSSTPTEKPKLLALGENYELLIYEFNLKDGRCDATILYSCSREALQKLIDDQDISISLLSLRILSFHNNTSLLFINKCVILHIIFPERDAAIRVLNCFTLPLPAQAVDMIIDTQLCRGILFVLSSLGWIYIFDVVDGTYVAHVDLALHKEDMCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVEILKEKNYFSEKEKRTIDFVHQVEKLYLGHFQENMQIQSFPRYWIKEQDFFKHKSVLDSFLKYDCKDEFNKQDHRIVLNWALWWDQLTQESILLPRISPEEYKSYSPEALWRYLTARHDWLNIILWIGEFQTQHSYASLQQNKWPLLTVDVINQNTSCNNYMRNEILDKLARNGVFLASELEDFECFLLRLSRIGGVIQDTLPVQNYKTKEGWDFHSQFILYCLEHSLQHLLYVYLDCYKLSPENCPFLEKKELHEAHPWFEFLVQCRQVASNLTDPKLIFQASLANAQILIPTNQASVSSMLLEGHTLLALATTMYSPGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQLIQQVGNEAYVIGLSSFHIPSIGAACVCFLELLGLDSLKLRVDMKVANIILSYKCRNEDAQYSFIRESVAEKLSKLADGEKTTTEELLVLLEEGTWNSIQQQEIKRLSSESSSQWALVVQFCRLHNMKLSISYLRECAKANDWLQFIIHSQLHNYHPAEVKSLIQYFSPVIQDHLRLAFENLPSVPTSKMDSDQVCNKCPQELQGSKQEMTDLFEILLQCSEEPDSWHWLLVEAVKQQAPILSVLASCLQGASAISCLCVWIITSVEDNVATEAMGHIQDSTEDHTWNLEDLSVIWRTLLTRQKSKTLIRGFQLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGPDVKKLCILCQILKDTSIAINHTIITSYSIENLQHECRSILERLQTDGQFALARRVAELAELPVDNLVIKEITQEMQTLKHIEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEEEAPDIPLRRVHSTSSLDSQKFVTVPSSNEVVTNLEVLTSKCLHGKNYCRQVLCLYDLAKELGCSYTDVAAQDGEAMLRKILASQQPDRCKRAQAFISTQGLKPDTVAELVAEEVTRELLTSSQGTGALPPGDSQPL

SEQ ID NO: 82779 - protein, 779 aa, Homo sapiens
  Payload ID: 16475
  Gene Symbol: SPG11
  Gene Name: spastic paraplegia 11 (autosomal recessive)
  ENSP ID: ENSP00000453848
MAAEEGVASAASAGGSWGTAAMGRVLPMLLVPVPAEAMGQLGSRAQLRTQPEALGSLTAAGSLQVLSLTPGSRGGGRCCLEGPFWHFLWEDSRNSSTPTEKPKLLALGENYELLIYEFNLKDGRCDATILYSCSREALQKLIDDQDISISLLSLRILSFHNNTSLLFINKCVILHIIFPERDAAIRVLNCFTLPLPAQAVDMIIDTQLCRGILFVLSSLGWIYIFDVVDGTYVAHVDLALHKEDMCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVGKGETT

SEQ ID NO: 82780 - protein, 138 aa, Homo sapiens
  Payload ID: 16475
  Gene Symbol: SPG11
  Gene Name: spastic paraplegia 11 (autosomal recessive)
  ENSP ID: ENSP00000453921
PGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQL

SEQ ID NO: 82781 - protein, 666 aa, Homo sapiens
  Payload ID: 16476
  Gene Symbol: SPG20
  Gene Name: spastic paraplegia 20 (Troyer syndrome)
  Uniprot ID: Q8N0X7
  ENSP ID: ENSP00000347314
MEQEPQNGEPAEIKIIREAYKKAFLFVNKGLNTDELGQKEEAKNYYKQGIGHLLRGISISSKESEHTGPGWESARQMQQKMKETLQNVRTRLEILEKGLATSLQNDLQEVPKLYPEFPPKDMCEKLPEPQSFSSAPQHAEVNGNTSTPSAGAVAAPASLSLPSQSCPAEAPPAYTPQAAEGHYTVSYGTDSGEFSSVGEEFYRNHSQPPPLETLGLDADELILIPNGVQIFFVNPAGEVSAPSYPGYLRIVRFLDNSLDTVLNRPPGFLQVCDWLYPLVPDRSPVLKCTAGAYMFPDTMLQAAGCFVGVVLSSELPEDDRELFEDLLRQMSDLRLQANWNRAEEENEFQIPGRTRPSSDQLKEASGTDVKQLDQGNKDVRHKGKRGKRAKDTSSEEVNLSHIVPCEPVPEEKPKELPEWSEKVAHNILSGASWVSWGLVKGAEITGKAIQKGASKLRERIQPEEKPVEVSPAVTKGLYIAKQATGGAAKVSQFLVDGVCTVANCVGKELAPHVKKHGSKLVPESLKKDKDGKSPLDGAMVVAASSVQGFSTVWQGLECAAKCIVNNVSAETVQTVRYKYGYNAGEATHHAVDSAVNVGVTAYNINNIGIKAMVKKTATQTGHTLLEDYQIVDNSQRENQEGAANVNVRGEKDEQTKEVKEAKKKDK

SEQ ID NO: 82782 - protein, 666 aa, Homo sapiens; identical to SEQ ID NO: 82781
  Payload ID: 16476
  Gene Symbol: SPG20
  Gene Name: spastic paraplegia 20 (Troyer syndrome)
  Uniprot ID: Q8N0X7
  ENSP ID: ENSP00000406061

SEQ ID NO: 82783 - protein, 666 aa, Homo sapiens; identical to SEQ ID NO: 82781
  Payload ID: 16476
  Gene Symbol: SPG20
  Gene Name: spastic paraplegia 20 (Troyer syndrome)
  Uniprot ID: Q8N0X7
  ENSP ID: ENSP00000414147

SEQ ID NO: 82784 - protein, 666 aa, Homo sapiens; identical to SEQ ID NO: 82781
  Payload ID: 16476
  Gene Symbol: SPG20
  Gene Name: spastic paraplegia 20 (Troyer syndrome)
  Uniprot ID: Q8N0X7
  ENSP ID: ENSP00000473599

SEQ ID NO: 82785 - protein, 308 aa, Homo sapiens
  Payload ID: 16477
  Gene Symbol: SPG21
  Gene Name: spastic paraplegia 21 (autosomal recessive, Mast syndrome)
  Uniprot ID: Q9NZD8
  ENSP ID: ENSP00000204566
MGEIKVSPDYNWFRGTVPLKKIIVDDDDSKIWSLYDAGPRSIRCPLIFLPPVSGTADVFFRQILALTGWGYRVIALQYPVYWDHLEFCDGFRKLLDHLQLDKVHLFGASLGGFLAQKFAEYTHKSPRVHSLILCNSFSDTSIFNQTWTANSFWLMPAFMLKKIVLGNFSSGPVDPMMADAIDFMVDRLESLGQSELASRLTLNCQNSYVEPHKIRDIPVTIMDVFDQSALSTEAKEEMYKLYPNARRAHLKTGGNFPYLCRSAEVNLYVQIHLLQFHGTKYAAIDPSMVSAEELEVQKGSLGISQEEQ

SEQ ID NO: 82786 - protein, 281 aa, Homo sapiens
  Payload ID: 16477
  Gene Symbol: SPG21
  Gene Name: spastic paraplegia 21 (autosomal recessive, Mast syndrome)
  Uniprot ID: Q9NZD8
  ENSP ID: ENSP00000394846
MGEIKVSPDYNWFRGTVPLKKIIVDDDDSKIWSLYDAGPRSIRCPLIFLPPVSGTADVFFRQILALTGWGYRVIAVHLFGASLGGFLAQKFAEYTHKSPRVHSLILCNSFSDTSIFNQTWTANSFWLMPAFMLKKIVLGNFSSGPVDPMMADAIDFMVDRLESLGQSELASRLTLNCQNSYVEPHKIRDIPVTIMDVFDQSALSTEAKEEMYKLYPNARRAHLKTGGNFPYLCRSAEVNLYVQIHLLQFHGTKYAAIDPSMVSAEELEVQKGSLGISQEEQ

SEQ ID NO: 82787 - protein, 308 aa, Homo sapiens; identical to SEQ ID NO: 82785
  Payload ID: 16477
  Gene Symbol: SPG21
  Gene Name: spastic paraplegia 21 (autosomal recessive, Mast syndrome)
  Uniprot ID: Q9NZD8
  ENSP ID: ENSP00000404111

SEQ ID NO: 82788 - protein, 150 aa, Homo sapiens
  Payload ID: 16477
  Gene Symbol: SPG21
  Gene Name: spastic paraplegia 21 (autosomal recessive, Mast syndrome)
  ENSP ID: ENSP00000452728
MGEIKVSPDYNWFRGTVPLKKIIVDDDDSKIWSLYDAGPRSIRCPLIFLPPVSGTADVFFRQILALTGWGYRVIALQYPVYWDHLEFCDGFRKLLDHLQLDKVHLFGASLGGFLAQKFAEYTHKSPRVHSLILCNSFSDTSIFNQTWTAN

SEQ ID NO: 82789 - protein, 129 aa, Homo sapiens
  Payload ID: 16477
  Gene Symbol: SPG21
  Gene Name: spastic paraplegia 21 (autosomal recessive, Mast syndrome)
  ENSP ID: ENSP00000452865
MGEIKVSPDYNWFRGTVPLKKIIVDDDDSKIWSLYDAGPRSIRCPLIFLPPVSGTADVFFRQILALTGWGYRVIALQYPVYWDHLEFCDGFRKLLDHLQLDKLLADACIYAQKNSSWKFFIWPGGPYDG

SEQ ID NO: 82790 - protein, 53 aa, Homo sapiens
  Payload ID: 16477
  Gene Symbol: SPG21
  Gene Name: spastic paraplegia 21 (autosomal recessive, Mast syndrome)
  ENSP ID: ENSP00000453167
MGEIKVSPDYNWFRGTVPLKKIIVDDDDSKIWSLYDAGPRSIRCPLIFLPPVS

SEQ ID NO: 82791 - protein, 102 aa, Homo sapiens
  Payload ID: 16477
  Gene Symbol: SPG21
  Gene Name: spastic paraplegia 21 (autosomal recessive, Mast syndrome)
  ENSP ID: ENSP00000453333
MGEIKVSPDYNWFRGTVPLKKIIVDDDDSKIWSLYDAGPRSIRCPLIFLPPVSGTADVFFRQILALTGWGYRVIALQYPVYWDHLEFCDGFRKLLDHLQLDK

SEQ ID NO: 82792 - protein, 71 aa, Homo sapiens
  Payload ID: 16477
  Gene Symbol: SPG21
  Gene Name: spastic paraplegia 21 (autosomal recessive, Mast syndrome)
  ENSP ID: ENSP00000453362
MGEIKVSPDYNWFRGTVPLKKIIVDDDDSKIWSLYDAGPRSIRCPLIFLPPVSGTADVFFRQILALTGWGY

SEQ ID NO: 82793 - protein, 141 aa, Homo sapiens
  Payload ID: 16477
  Gene Symbol: SPG21
  Gene Name: spastic paraplegia 21 (autosomal recessive, Mast syndrome)
  ENSP ID: ENSP00000453541
MGEIKVSPDYNWFRGTVPLKKIIVDDDDSKIWSLYDAGPRSIRCPLIFLPPVSGTADVFFRQILALTGWGYRVIALQYPVYWDHLEFCDGFRKLLDHLQLDKVHLFGASLGGFLAQKFAEYTHKSPRVHSLILCNSFSDTS

SEQ ID NO: 82794 - protein, 40 aa, Homo sapiens
  Payload ID: 16477
  Gene Symbol: SPG21
  Gene Name: spastic paraplegia 21 (autosomal recessive, Mast syndrome)
  ENSP ID: ENSP00000453658
MGEIKVSPDYNWFRGTVPLKKIIVDDDDSKIWSLYDAGPR

SEQ ID NO: 82795 - protein, 154 aa, Homo sapiens
  Payload ID: 16477
  Gene Symbol: SPG21
  Gene Name: spastic paraplegia 21 (autosomal recessive, Mast syndrome)
  ENSP ID: ENSP00000456365
MPAFMLKKIVLGNFSSGPVDPMMADAIDFMVDRLESLGQSELASRLTLNCQNSYVEPHKIRDIPVTIMDVFDQSALSTEAKEEMYKLYPNARRAHLKTGGNFPYLCRSAEVNLYVQIHLLQFHGTKYAAIDPSMVSAEELEVQKGSLGISQEEQ

SEQ ID NO: 82796 - protein, 795 aa, Homo sapiens
  Payload ID: 16478
  Gene Symbol: SPG7
  Gene Name: spastic paraplegia 7 (pure and complicated autosomal recessive)
  Uniprot ID: Q9UQ90
  ENSP ID: ENSP00000268704
MAVLLLLLRALRRGPGPGPRPLWGPGPAWSPGFPARPGRGRPYMASRPPGDLAEAGGRALQSLQLRLLTPTFEGINGLLLKQHLVQNPVRLWQLLGGTFYFNTSRLKQKNKEKDKSKGKAPEEDEEERRRRERDDQMYRERLRTLLVIAVVMSLLNALSTSGGSISWNDFVHEMLAKGEVQRVQVVPESDVVEVYLHPGAVVFGRPRLALMYRMQVANIDKFEEKLRAAEDELNIEAKDRIPVSYKRTGFFGNALYSVGMTAVGLAILWYVFRLAGMTGREGGFSAFNQLKMARFTIVDGKMGKGVSFKDVAGMHEAKLEVREFVDYLKSPERFLQLGAKVPKGALLLGPPGCGKTLLAKAVATEAQVPFLAMAGPEFVEVIGGLGAARVRSLFKEARARAPCIVYIDEIDAVGKKRSTTMSGFSNTEEEQTLNQLLVEMDGMGTTDHVIVLASTNRADILDGALMRPGRLDRHVFIDLPTLQERREIFEQHLKSLKLTQSSTFYSQRLAELTPGFSGADIANICNEAALHAAREGHTSVHTLNFEYAVERVLAGTAKKSKILSKEEQKVVAFHESGHALVGWMLEHTEAVMKVSITPRTNAALGFAQMLPRDQHLFTKEQLFERMCMALGGRASEALSFNEVTSGAQDDLRKVTRIAYSMVKQFGMAPGIGPISFPEAQEGLMGIGRRPFSQGLQQMMDHEARLLVAKAYRHTEKVLQDNLDKLQALANALLEKEVINYEDIEALIGPPPHGPKKMIAPQRWIDAQREKQDLGEEETEETQQPPLGGEEPTWPK

SEQ ID NO: 82797 - protein, 489 aa, Homo sapiens
  Payload ID: 16478
  Gene Symbol: SPG7
  Gene Name: spastic paraplegia 7 (pure and complicated autosomal recessive)
  Uniprot ID: Q9UQ90
  ENSP ID: ENSP00000341157
MAVLLLLLRALRRGPGPGPRPLWGPGPAWSPGFPARPGRGRPYMASRPPGDLAEAGGRALQSLQLRLLTPTFEGINGLLLKQHLVQNPVRLWQLLGGTFYFNTSRLKQKNKEKDKSKGKAPEEDEEERRRRERDDQMYRERLRTLLVIAVVMSLLNALSTSGGSISWNDFVHEMLAKGEVQRVQVVPESDVVEVYLHPGAVVFGRPRLALMYRMQVANIDKFEEKLRAAEDELNIEAKDRIPVSYKRTGFFGNALYSVGMTAVGLAILWYVFRLAGMTGREGGFSAFNQLKMARFTIVDGKMGKGVSFKDVAGMHEAKLEVREFVDYLKSPERFLQLGAKVPKGALLLGPPGCGKTLLAKAVATEAQVPFLAMAGPEFVEVIGGLGAARVRSLFKEARARAPCIVYIDEIDAVGKKRSTTMSGFSNTEEEQTLNQLLVEMDGASLDQLPSQGTMRKLRGKTPACSCLTEPTGSRRAMEGHSLCWGCLLH

SEQ ID NO: 82798 - protein, 131 aa, Homo sapiens
  Payload ID: 16478
  Gene Symbol: SPG7
  Gene Name: spastic paraplegia 7 (pure and complicated autosomal recessive)
  ENSP ID: ENSP00000454475
MGSRSGRGRTEARSASESLQLRLLTPTFEGINGLLLKQHLVQNPVRLWQLLGGTFYFNTSRLKQKNKEKDKSKGKAPEEDEEERRRRERDDQMYRERLRTLLVIAVVMSLLNALSTSGGSISWNDFVHEML

SEQ ID NO: 82799 - protein, 70 aa, Homo sapiens
  Payload ID: 16478
  Gene Symbol: SPG7
  Gene Name: spastic paraplegia 7 (pure and complicated autosomal recessive)
  ENSP ID: ENSP00000454805
  MOD_RES (1)..(1): Any amino acid
XMGTTDHVIVLASTNRADILDGALMRPGRLDRHVFIDLPTLQRKGVALSPRLECSAAITTHCGLNLQGSS

SEQ ID NO: 82800 - protein, 106 aa, Homo sapiens
  Payload ID: 16478
  Gene Symbol: SPG7
  Gene Name: spastic paraplegia 7 (pure and complicated autosomal recessive)
  ENSP ID: ENSP00000457298
  MOD_RES (1)..(1): Any amino acid
XGRLDRHVFIDLPTLQERREIFEQHLKSLKLTQSSTFYSQRLAELTPGFSGADIANICNEAALHAAREGHTSVHTLNFEYAVERVLAALRVERTGAACVLLKFIFV

SEQ ID NO: 82801 - protein, 210 aa, Homo sapiens
  Payload ID: 16478
  Gene Symbol: SPG7
  Gene Name: spastic paraplegia 7 (pure and complicated autosomal recessive)
  ENSP ID: ENSP00000457387
REIFEQHLKSLKLTQSSTFYSQRLAELTPGFSGADIANICNEAALHAAREGHTSVHTLNFEYAVERVLAGTAKKSKILSKEEQKVVAFHESGHALVGWMLEHTEAVMKVSITPRTNAALGFAQMLPRDQHLFTKEQLFERMCMALGGRASEALSFNEVTSALLCACSAEDASVSTPPSRGTGRPEEGHPHRLLHGEAVWDGTWHRAHLLP

SEQ ID NO: 82802 - protein, 181 aa, Homo sapiens
  Payload ID: 16478
  Gene Symbol: SPG7
  Gene Name: spastic paraplegia 7 (pure and complicated autosomal recessive)
  ENSP ID: ENSP00000457719
LWARGSPSCGPRRGATVGALDRGRWAGREEAGLGSAQSSAWTFPTRLLCVDVLRPSSSPFKVESSNGFRRSTNLQSTPVDRFRHQEFQRLPVRSLQLRLLTPTFEGINGLLLKQHLVQNPVRLWQLLGGTFYFNTSRLKQKNKEKDKSKGKAPEEDEEERRRRERDDQMYRERLRTLLVIA

SEQ ID NO: 82803 - protein, 154 aa, Homo sapiens
  Payload ID: 16478
  Gene Symbol: SPG7
  Gene Name: spastic paraplegia 7 (pure and complicated autosomal recessive)
  ENSP ID: ENSP00000461979
  MOD_RES (1)..(1): Any amino acid
XFERMCMALGGRASEALSFNEVTSGAQDDLRKVTRIAYSMVKQFGMAPGIGPISFPEAQEGLMGIGRRPFSQGLQQMMDHEARLLVAKAYRHTEKVLQDNLDKLQAVRPWPGVGATASHSVHTAPTVPTPLVKYFQGTQSTENTLTDVNSTQLN

SEQ ID NO: 82804 - protein, 238 aa, Homo sapiens
  Payload ID: 16478
  Gene Symbol: SPG7
  Gene Name: spastic paraplegia 7 (pure and complicated autosomal recessive)
  ENSP ID: ENSP00000478030
MRLRCTRRGRDTLPCTLSTSSTPWSASSQVPRAQLGKAVGSCRGVGSCCARHCKTHLASLRQPCGERTGAACVLLIYFRVTIYFYVEIEKLLIIVAKQEGLSGNHKPVERKYMTYLSAQDHELIQVVQNGHLQMCGKSETGNEASPGLPKRARSCPRKNRKWLRFMSRATPWWAGCWSTRRDEGLHNPSTNAALGFAQAPQRPAPLHEQLFERMCMALGGRASEALSQRGHFWGHRTT

SEQ ID NO: 82805 - protein, 109 aa, Homo sapiens
  Payload ID: 16478
  Gene Symbol: SPG7
  Gene Name: spastic paraplegia 7 (pure and complicated autosomal recessive)
  ENSP ID: ENSP00000483351
  MOD_RES (1)..(1): Any amino acid
XAGPEFVEVIGGLGAARVRSLFKEARARAPCIVYIDEIDAVGKKRSTTMSGFSNTEEEQTLNQLLVEMDGQCSCAPHPHCTIRGGFPMSFRTGCGEPRSCHCTPAWVTE

SEQ ID NO: 82806 - protein, 616 aa, Homo sapiens
  Payload ID: 16479
  Gene Symbol: SPAST
  Gene Name: spastin
  Uniprot ID: Q9UBP0
  ENSP ID: ENSP00000320885
MNSPGGRGKKKGSGGASNPVPPRPPPPCLAPAPPAAGPAPPPESPHKRNLYYFSYPLFVGFALLRLVAFHLGLLFVWLCQRFSRALMAAKRSSGAAPAPASASAPAPVPGGEAERVRVFHKQAFEYISIALRIDEDEKAGQKEQAVEWYKKGIEELEKGIAVIVTGQGEQCERARRLQAKMMTNLVMAKDRLQLLEKMQPVLPFSKSQTDVYNDSTNLACRNGHLQSESGAVPKRKDPLTHTSNSLPRSKTVMKTGSAGLSGHHRAPSYSGLSMVSGVKQGSGPAPTTHKGTPKTNRTNKPSTPTTATRKKKDLKNFRNVDSNLANLIMNEIVDNGTAVKFDDIAGQDLAKQALQEIVILPSLRPELFTGLRAPARGLLLFGPPGNGKTMLAKAVAAESNATFFNISAASLTSKYVGEGEKLVRALFAVARELQPSIIFIDEVDSLLCERREGEHDASRRLKTEFLIEFDGVQSAGDDRVLVMGATNRPQELDEAVLRRFIKRVYVSLPNEETRLLLLKNLLCKQGSPLTQKELAQLARMTDGYSGSDLTALAKDAALGPIRELKPEQVKNMSASEMRNIRLSDFTESLKKIKRSVSPQTLEAYIRWNKDFGDTTV

SEQ ID NO: 82807 - protein, 584 aa, Homo sapiens
  Payload ID: 16479
  Gene Symbol: SPAST
  Gene Name: spastin
  Uniprot ID: Q9UBP0
  ENSP ID: ENSP00000340817
MNSPGGRGKKKGSGGASNPVPPRPPPPCLAPAPPAAGPAPPPESPHKRNLYYFSYPLFVGFALLRLVAFHLGLLFVWLCQRFSRALMAAKRSSGAAPAPASASAPAPVPGGEAERVRVFHKQAFEYISIALRIDEDEKAGQKEQAVEWYKKGIEELEKGIAVIVTGQGEQCERARRLQAKMMTNLVMAKDRLQLLESGAVPKRKDPLTHTSNSLPRSKTVMKTGSAGLSGHHRAPSYSGLSMVSGVKQGSGPAPTTHKGTPKTNRTNKPSTPTTATRKKKDLKNFRNVDSNLANLIMNEIVDNGTAVKFDDIAGQDLAKQALQEIVILPSLRPELFTGLRAPARGLLLFGPPGNGKTMLAKAVAAESNATFFNISAASLTSKYVGEGEKLVRALFAVARELQPSIIFIDEVDSLLCERREGEHDASRRLKTEFLIEFDGVQSAGDDRVLVMGATNRPQELDEAVLRRFIKRVYVSLPNEETRLLLLKNLLCKQGSPLTQKELAQLARMTDGYSGSDLTALAKDAALGPIRELKPEQVKNMSASEMRNIRLSDFTESLKKIKRSVSPQTLEAYIRWNKDFGDTTV

SEQ ID NO: 82808 - protein, 616 aa, Homo sapiens; identical to SEQ ID NO: 82806
  Payload ID: 16479
  Gene Symbol: SPAST
  Gene Name: spastin
  Uniprot ID: Q9UBP0
  ENSP ID: ENSP00000480893

SEQ ID NO: 82809 - protein, 530 aa, Homo sapiens
  Payload ID: 16479
  Gene Symbol: SPAST
  Gene Name: spastin
  Uniprot ID: Q9UBP0
  ENSP ID: ENSP00000482496
MAAKRSSGAAPAPASASAPAPVPGGEAERVRVFHKQAFEYISIALRIDEDEKAGQKEQAVEWYKKGIEELEKGIAVIVTGQGEQCERARRLQAKMMTNLVMAKDRLQLLEKMQPVLPFSKSQTDVYNDSTNLACRNGHLQSESGAVPKRKDPLTHTSNSLPRSKTVMKTGSAGLSGHHRAPSYSGLSMVSGVKQGSGPAPTTHKGTPKTNRTNKPSTPTTATRKKKDLKNFRNVDSNLANLIMNEIVDNGTAVKFDDIAGQDLAKQALQEIVILPSLRPELFTGLRAPARGLLLFGPPGNGKTMLAKAVAAESNATFFNISAASLTSKYVGEGEKLVRALFAVARELQPSIIFIDEVDSLLCERREGEHDASRRLKTEFLIEFDGVQSAGDDRVLVMGATNRPQELDEAVLRRFIKRVYVSLPNEETRLLLLKNLLCKQGSPLTQKELAQLARMTDGYSGSDLTALAKDAALGPIRELKPEQVKNMSASEMRNIRLSDFTESLKKIKRSVSPQTLEAYIRWNKDFGDTTV

SEQ ID NO: 82810 - protein, 1361 aa, Homo sapiens
  Payload ID: 16480
  Gene Symbol: SPATA31A1
  Gene Name: SPATA31 subfamily A, member 1
  ENSP ID: ENSP00000366875
MPRAQLLESNAPIHMENLPFPLKLLSASSLNAPSSTPWVLDIFLTLVFALGFFFLLLPYLSYFRCDDPPSPSPGKRKCPVGRRRRPRGRMKNHSLRAGRECPRGLQETSDLLSQLQSLLGPHLDKGDFGQLSGPDPPGEVGERAPDGASQSSHEPMEDAAPILSPLASPDPQAKHPQDLASTPSPGPMTTSVSSLSASQPPEPSLPLEHPSPEPPALFPHPPHTPDPLACSPPPPKGFTAPPLRDSTLITPSHCDSVALPLGTVPQSLSPHEDLVASVPAISGLGGSNSHVSASSRWQETARTSCAFNSSVQQDHLSRHPPETYQMEAGSLFLLSSDGQNAVGIQVTETAKVNIWEEKENVGSFTDRMTPEKHLNSLRNLAKSLDAEQDTTNPKPFWNMGENSKQLPGPQKLSDPRLWQESFWKNYSQLFWGLPSLHSESLVANAWVTDRSYTLQSPPFLFNEMSNVCPIQRETTMSPLLFQAQPPSHLGPECQPFISSTPQFRPTPMAQAEAQAHLQSSFPVLSPAFPSLIKNTGVACPASQNKVQALSLPETQHPEWPLLRRQLEGRLALPSRVQKSQDVFSVSTPNLPQESLTSILPENFPVSPELRRQLEQHIKKWIIQHWGNLGRIQESLDLMQLRDESPGTSQAKGKPSPWQSSMSTGESSKEAQKVKFQLERDPCPHLGQILGETPQNLSRDMKSFPRKVLGVTSEESERNLRKPLRSDSGSDLLRCTERTHIENILKAHMGRNLGQTNEGLIPVRVRRSWLAVNQALPVSNTHVKTSNLAAPKSGKACVNTAQVLSFLEPCTQQGLGAHIVRFWAKHRWGLPLRVLKPIQCFKLEKVSSLSLTQLAGPSSATCESGAGSEVEVDMFLRKPPMASLRKQVLTKASDHMPESLLASSPAWKQFQRAPRGIPSWNDHGPLKPPPAGQEGRWPSKPLTYSLTGSTQQSRSLGAQSSKAGETREAVPQCRVPLETCMLANLQATSEDMHGFEAPGTSKSSLHPRVSVSQDPRKLCLMEEVVNEFEPGMATKSETQPQVCAAVVLLPDGQASVVPHASENLVSQVPQGHLQSMPAGNMRASQELHDLMAARRSKLVHEEPRNPNCQGSCKNQRPMFPPIHKSEKSRKPNLEKHEERLEGLRTPQLTPVRKTEDTHQDEGVQLLPSKKQPPSVSHFGGNIKQFFQWIFSKKKSKPAPVTAESQKTVKNRSCVYSSSAEAQGLMTAVGQMLDEKMSLCHARHASKVNQHKQKFQAPVCGFPCNHRHLFYSEHGRILSYAASSQQATLKSQGCPNRDRQIRNQQPLKSVRCNNEQWGLRHPQILHPKKAVSPVSPLQHWPKTSGASSHHHHCPRHCLLWEGI

SEQ ID NO: 82811 - protein, 1347 aa, Homo sapiens
  Payload ID: 16481
  Gene Symbol: SPATA31A3
  Gene Name: SPATA31 subfamily A, member 3
  Uniprot ID: Q5VYP0
  ENSP ID: ENSP00000485118
MENLPFPLKLLSASSLNAPSSTPWVLDIFLTLVFALGFFFLLLPYLSYFRCDDPPSPSPGKRKCPVGRRRRPRGRMKNHSLRAGRECRRGLEETSDLLSQLQSLLGPHLDKGDFGQLSGPDPPGEVGERAPDGASQSSHEPMEDAAPILSLLASPDPQAKHPQDLASTPSPGPMTTSVSSLSASQPPEPSLPLEHPSPEPPALFPHPPHTPDPLACSLPPPKGFTAPPLRDSTLITPSHCDSVALPLGTVPQSLSPHEDLVASVPAISGLGGSNSHVSASSRWQETARTSCAFNSSVQQDHLSRHPPETCQMEAGSLFLLSSDGQNVVGIQVTETAKVNIWEEKENVGSFTNRMTPEKHLNSLRNLAKSLDAEQDTTNPKPFWNMGENSKQLPGPQKLSDPRLWQESFWKNYSQLFWGLPSLHSESLVANAWVTDRSYTLQSPPFLFNEMSNVCPIQRETTMSPLLFQAQPLSHLGPECQPFISSTPQFRPTPMAQAEAQAHLQSSFPVLSPAFPSLIQNTGVACPASQNKVQALSLPETQHPEWPLLRRQLEGRLALPSRVQKSQDVFSVSTPNLPQESLTSILPENFPVSPELRRQLEQHIKKWIIQHWGNLGRIQESLDLMQLQDESPGTSQAKGKPSPWQSSMSTGESSKEAQKVKFQLERDPCPHLGQILGETPQNLSRDMKSFPRKVLGVTSEELERNLRKPLRSDSGSDLLRCTERTHIENILKAHMGRNLGQTNEGLIPVRVRRSWLAVNQALPVSNTHVKTSNLAAPKSGKACVNTAQVLSFLEPCTQQGLGAHIVRFWAKHRWGLPLRVLKPIQCFKLEKVSSLSLTQLAGPSSATCESGAGSEVEVDMFLRKPPMASLRKQVLTKASDHMPESLLASSPAWKQFQRAPRGIPSWNDHEPLKPPPAGQEGRWPSKPLTYSLTGSTQQSRSLGAQSSKAGETREAVPQCRVPLETCMLANLQATSEDVHGFEAPGTSKSSLHPRVSVSQDPRKLCLMEEVVSEFEPGMATKSETQPQVCAAVVLLPDGQASVVPHASENLVSQVPQGHLQSMPTGNMRASQELHDLMAARRSKLVHEEPRKPNCQGSCKSQRPMFPPIHKSEKFRKPNLEKHEERLEGLRTPQLTPVRKTEDTHQDEGVQLLPSKKQPPSVSPFGENIKQIFQWIFSKKKSKPAPVTAESQKTVKNRSCVYSSSAEAQGLMTAVGQMLDEKMSLCHARHASKVNQHKQKFQAPVCGFPCNHRHLFYSEHGRILSYAASSQQATLKSQGCPNRDRQIRNQQPLKSVRCNNEQWGLRHPQILHPKKAVSPVSPPQHWPKTSGASSHHHHCPRHCLLWEGI

SEQ ID NO: 82812 - protein, 1347 aa, Homo sapiens
  Payload ID: 16482
  Gene Symbol: SPATA31A5
  Gene Name: SPATA31 subfamily A, member 5
  Uniprot ID: Q5VU36
  ENSP ID: ENSP00000485628
MENLPFPLKLLSASSLNAPSSTPWVLDIFLTLVFALGFFFLLLPYLSYFRCDDPPSPSPGKRKCPVGRRRRPRGRMKNHSLRAGRECRRGLEETSDLLSQLQSLLGPHLDKGDFGQLSGPDPPGEVGERAPDGASQSSHEPMEDAAPILSPLASPDPQAKHPQDLASTPSPGPMTTSVSSLSASQPPEPSLPLEHPSPEPPALFPHPPHTPDPLACSLPPPKGFTAPPLRDSTLITPSHCDSVAFPLGTVPQSLSPHEDLVASVPAISGLGGSNSHVSASSRWQETARTSCAFNSSVQQDHLSRHPPETCQMEAGSLFLLSSDGQNVVGIQVTETAKVNIWEEKENVGSFTNRMTPEKHLNSLRNLAKSLDAEQDTTNPKPFWNMGENSKQLPGPQKLSDPRLWQESFWKNYSQLFWGLPSLHSESLVANAWVTDRSYTLQSPPFLFNEMSNVCPIQRETTMSPLLFQAQPLSHLGPECQPFISSTPQFRPTPMAQAEAQAHLQSSFPVLSPAFPSLIQNTGVACPASQNKVQALSLPETQHPEWPLLRRQLEGRLALPSRVQKSQDVFSVSTPNLPQESLTSILPENFPVSPELRRQLEQHIKKWIIQHWGNLGRIQESLDLMQLRDESPGTSQAKGKPSPWQSSMSTGEGSKEAQKVKFQLERDPCPHLGQILGETPQNLSRDMKSFPRKVLGVTSEELERNLRKPLRSDSGSDLLRCTERTHIENILKAHMGRNLGQTNEGLIPVCVRRSWLAVNQALPVSNTHVKTSNLAAPKSGKACVNTAQVLSFLEPCTQQGLGAHIVRFWAKHRWGLPLRVLKPIQCFKLEKVSSLSLTQLAGPSSATCESGAGSEVEVDMFLRKPPMASLRKQVLTKASDHMPESLLASSPAWKQFQRAPRGIPSWNDHEPLKPPPAGQEGRWPSKPLTYSLTGSIQQSRSLGAQSSKAGETREAVPQCRVPLETCMLANLQATSEDVHGFEAPGTSKSSLHPRVSVSQDPRKLCLMEEVVNEFEPGMATKSETQPQVCAAVVLLPDGQASVVPHASENLVSQVPQGHLQSMPTGNMRASQELHDLMAARRSKLVHEEPRNPNCQGSCKSQRPMFPPIHKSEKSRKPNLEKHEERLEGLRTPQLTPVRKTEDTHQDEGVQLLPSKKQPPSVSPFGENIKQIFQWIFSKKKSKPAPVTAESQKTVKNRSRVYSSSAEAQGLMTAVGQMLDEKMSLCHARHASKVNQHKQKFQAPVCGFPCNHRHLFYSEHGRILSYAASSQQATLKSQGCPNRDRQIRNQQPLKSVRCNNEQWGLRHPQILHPKKAVSPVSPPQHWPKTSGASSHHHHCPRHCLLWEGI

SEQ ID NO: 82813 - protein, 1343 aa, Homo sapiens
  Payload ID: 16483
  Gene Symbol: SPATA31A6
  Gene Name: SPATA31 subfamily A, member 6
  Uniprot ID: Q5VVP1
  ENSP ID: ENSP00000329825
MENLPFPLKLLSASSLNAPSSTPWVLDIFLTLVFALGFFFLLLPYLSYFHCDDPPSPSPGKRKCPVGRRRRPRGRMKNHSLRAGRECPRGLEETSDLLSQLQSLLGPHLDKGDFGQLSGPDPPGEVGERAPDGASQSSHEPMEDAAPILSPLASPDPQAKHPQDLASTPSPGPMTTSVSSLSASQPPEPSLPLEHPSPEPPALFPHPPHTPDPLACSPPPPKGFTAPPLRDSTLITPSHCDSVALPLGTVPQSLSPHEDLVASVPAISGLGGSNSHVSASSRWQETARTSCAFNSSVQQDPLSRHPPETCQMEAGSLFLLSSDGQNVVGIQVTETAKVNIWEEKENVGSFTNQMTPEKHLNSLGNLAKSLDAEQDTTNPKPFWNMGENSKQLPGPQKCSDPRLLQESFWKNYSQLFWGLPSLHSESLVANAWVTDRSYTLQSPPFLFNEMSNVCPIQRETTMSPLLFQAQPLSHRQPFISSTPQFLPTPMAQAEAQAHLQSSFPVLSPAFPSLIKNTGVACPASQNKVQALSLPETQHPEWPLLRKQLEGRLALPSRVQKSQDVFSVSTPNLPQESLTSILPENFPVSPELRRQLEQHIKKWIIQHWGNLGRIQESLDLMQLRDESPGTSQAKGKPSPWQSSTSTGESSKEAQKVKFQLERDLCPHLGQILGETPQNLSRDMKSFPRKVLGVTSEESERNLRKPLRSDSGSDLLRCTERTHIENILKAHMGRNLGQTNEGLIPVRVRRSWLAVNQALPVSNTHVKTSNLAAPKSGKACVNTAQVLSFLEPCTQQGLGAHIVRFWAKHRWGLPLRVLKPIQCFKLEKVSSLSLTQLAGPSSATCESGAGSEVEVDMFLRKPPMASLRKQVLTKASDHMPESLLASSPAWKQFQRAPRGIPSWNDHGPLKPPPAGQEGRWPSKPLTYSLTGSTQQSRSLGAQSSKAGETREAVPQCRVPLETCMLANLQATSEDVHGFEAPGTSKSSLHPRVSVSQDPRKLCLMEEVVSEFEPGMATKSETQPQVCAAVVLLPDGQASVVPHASENLVSQVPQGHLQSMPTGNMRASQELHDLMAARRSKLVQEEPRNPNCQGSCKSQRPMFPPIHKSEKSRKPNLEKHEERLEGLRTPQLTPVRKTEDTHQDEGVQLLPSKKQPPSVSHFGENIKQFFQWIFSKKKSKPAPVTAESQKTVKNRSCVYSSSAEAQGLMTAVGQMLDKKMSLCHAHHASKVNQHKQKFQAPVCGFPCNHRHLFYSEHGRILSYAASSQQATLKSQGCPNRDRQIRNQQPLKSVRCNNEQWGLRHPQILHPKKAVSPVSPPQHWPKTSGASSHHHHCPRHCLLWEGI

SEQ ID NO: 82814 - protein, 1347 aa, Homo sapiens
  Payload ID: 16484
  Gene Symbol: SPATA31A7
  Gene Name: SPATA31 subfamily A, member 7
  Uniprot ID: Q8IWB4
  ENSP ID: ENSP00000484807
MENLPFPLKLLSASSLNAPSSTPWVLDIFLTLVFALGFFFLLLPYLSYFRCDDPPSPSPGKRKCPVGRRRRPRGRMKNHSLRAGRECPRGLEETSDLLSQLQSLLGPHLDKGDFGQLSGPDPPGEVGERAPDGASQSSHEPMEDAAPILSPLASPDPQAKHPQDLASTPSPGPMTTSVSSLSASQPPEPSLPLEHPSPEPPALFPHPPHTPDPLACSLPPPKGFTAPPLRDSTLITPSHCDSVAFPLGTVPQSLSPHEDLVASVPAISGLGGSNSHVSASSRWQETARTSCAFNSSVQQDHLSRHPPETCQMEAGSLFLLSSDGQNVVGIQVTETAKVNIWEEKENVGSFTNRMTPEKHLNYLRNLAKSLDAEQDTTNPKPFWNMGENSKQLPGPQKLSDPRLWQESFWKNYSQLFWGLPSLHSESLVANAWVTDRSYTLQSPPFLFNEMSNVCPIQRETTMSPLLFQAQPLSHLGPECQPFISSTPQFRPTPMAQAEAQAHLQSSFPVLSPAFPSLIQNTGVACPASQNKVQALSLPETQHPEWPLLRRQLEGRLALPSRVQKSQDVFSVSTPNLPQESLTSILPENFPVSPELRRQLEQHIKKWIIQHWGNLGRIQESLDLMQLRDESPGTSQAKGKPSPWQSSMSTGESSKEAQKVKFQLERDPCPHLGQILGETPQNLSRDMKSFPRKVLGVTSEELERNLRKPLRSDSGSDLLRCTERTHIENILKAHMGRNLGQTNEGLIPVCVRRSWLAVNQALPVSNTHVKTSNLAAPKSGKACVNTAQVLSFLEPCTQQGLGAHIVRFWAKHRWGLPLRVLKPIQCFKLEKVSSLSLTQLAGPSSATCESGAGSEVEVDMFLRKPPMASLRKQVLTKASDHMPESLLASSPAWKQFQRAPRGIPSWNDHEPLKPPPAGQEGRWPSKPLTYSLTGSIQQSRSLGAQSSKAGETREAVPQCRVPLETCMLANLQATSEDVHGFEAPGTSKSSLHPRVSVSQDPRKLCLMEEVVNEFEPGMATKSETQPQVCAAVVLLPDGQASVVPHASENLVSQVPQGHLQSMPTGNMRASQELHDLMAARRSKLVHEEPRNPNCQGSCKSQRPMFPPIHKSEKSRKPNLEKHEERLEGLRTPQLTPVRKTEDTHQDEGVQLLPSKKQPPSVSPFGENIKQIFQWIFSKKKSKPAPVTAESQKTVKNRSRVYSSSAEAQGLMTAVGQMLDEKMSLCHARHASKVNQHKQKFQAPVCGFPCNHRHLFYSEHGRILSYAASSQQATLKSQGCPNRDRQIRNQQPLKSVRCNNEQWGLRHPQILHPKKAVSPVSPPQHWPKTSGASSHHHHCPRHCLLWEGI

SEQ ID NO: 82815 - protein, 1576 aa, Homo sapiens
  Payload ID: 16485
  Gene Symbol: SPATA31D1
  Gene Name: SPATA31 subfamily D, member 1
  Uniprot ID: Q6ZQQ2
  ENSP ID: ENSP00000341988
MENILCFLNSYTETGLSPDSHWLDIDPNFICLSGLGLFILYLFYVVLTLYSSPTEKNNDIQKHQGRAKRRRKGGTFKGFPDWKSFQREEEEERKLLSLLKSFGPPVSCSPRGQHHDTNHFRRLLCPDPVCRVCKRATADIQQLLSWESLKDAAPSVSPLASSASATESSFTLASTPSATPPEDLILSPRPKASPPPPLILSPDLITTLADLFSPSPLRDPLPPQPVSPLDSKFPIDHSPPQQLPFPLLPPHHIERVESSLQPEASLSLNTIFSFGSTLCQDISQAMNPIDSCARHHGPPIPSALPPEDCTVTQSKSSLTILKTFPEMLSLGGSGGSSTSAPTIKGIDHSHLASSEFTWWQPHAKDSFSSNFVPSDFMEELLTLHSSEAFLGGHSVANLIEPVNISFLSHDILALLERQVKKRGDFLMWKENGKKPGSFPKQLRPNYQLNSSRNMLTSIAVKHDLAESFPFWASKGKLEWQHIHQQPPHSKCFEDHLEQKYVQLFWGLPSLHSESLHPTVLVQRGHSSMFVFFNGITNTSISHESPVLPPPQPLSLPSTQPLPLPQTLPQGQSPHLTQVKSLAQPQSPFRALLPSPLFLIRICGVCFHRPQNEARSLLPSEINHLEWNVLQKVQESLWGLPSVVQKSQEDFCPPAPNPELVRKSFKVHVPISIIPGDFPLSSEVRKKLEQHIRRRLIQRRWGLPRRIHESLSLLRPQSKISELSVSERIHGPLNISLVEGQRCNVLKKSASSFPRSFHERSSNMLSMENVGNYQGYSQETVPKDHLLHGPETSSDKDLRSNSERDLETHMMHLSGNDSGVRLGQKQLENALTVRLSKKFEEINEGRMPGTVHSSWHSVKQTMSLPEKSHSQIKHRNLVTLVSEDHCVDTSQEISFLSSNKQKMLEAHIKTFRMRMLWGLPLKVLESIEIFKSKADLSTSFSHFDLPSSATFISQGDSKDGVSKSRSRSTFQGEKLGTTSSVPILDRPHPVSSPVVQEGQGTLRRQFSDTDHDLIETDSKDGASTSLRRGTTDFQSEKLDSTSSFPILGHSYLVTSPVNQEKQGTLRREFSDTDNDLTESVRTTEDGRQTFLPPPHSIVDEVSQKQTVLASRCSAELPIMQAGAGCESWDKRKSSFHNVDRLQGSRKTFPVTNALQSQTRNNLTTSKSGSCSLTNVKASTSNETEIFPPRISVPQDPKSSYLKNQMLSQLKLVQRKHSQPQSHFTDMSFALDNLSSKDLLTNSQGISSGDMGTSQVVHVHLEDSGIRVAQKQEPRVPTCVLQKCQVTNFPPAVNRVSPVRPKGGELDGGDAGLGTSQRRRKSLPVHNKTSGEVLGSKSSPTLKTQPPPENLFRKWMKTSLQWFNKPSISYEEQESSWEKGSSLSSCVQNIGRVIRAAFTGTTEAQKIRKDTREFLEEKLGHRHGIDITCPQEPLSFPVGLGKAQHNPEVHVRAEPVQGCPCNYRAPSCKVTRTKSCSQQAIFVGQNYPTRIRQIIDKDRQPQKVEAFKGKILCQSHPQSMPHRKPVPHPNPTCRRQVSLVCPAVPTSAKSPVFSDVPFLTGQKMLPKHLQGGKFPPTK

SEQ ID NO: 82816 - protein, 917 aa, Homo sapiens
  Payload ID: 16486
  Gene Symbol: SPATA31D3
  Gene Name: SPATA31 subfamily D, member 3
  Uniprot ID: P0C874
  ENSP ID: ENSP00000488117
MENILCFLNSYTETGLSPDSHCLDIDLNFICLSGLGLFILYLFYMVLTLYSSPTEKNNDTQKHQGRARRKRKSVTFKDRKSLQKEAEEERKLHSFLKSFGPPVSCSPLGQHHDTTLFRRLLCPDPVCRVCNRATADIQRLLSWESLKDAAPSVSPLASSASGAESSFTLASTPSATTPEDLILSSRPKPSPPPPLILSPDLITTLADLFSPSPLRDPLPPQPVSPLDSKFPIDHSPPQQLPFPLLPPHHIERVEPSLQPEASLSLNTIFSFGSTLCQDISQAVNRTDSCARHHGPPTPSALPPEDCTVTQSKSNLTVLKTFPEMLSLGGSGGSSTSAPTTKGIDHSCPASSEFSWWQPHAKDSFSSNFVPSDFMEELLTLHSSEASLGGHSVANIIQPVNISFLSHDIPALLERQVKRRGDFLMWKENGKKPGSFPTQLRPNYQLNSSRNMLTSTAVKHDLAESFPFWASKGKLEWQHIHQQPPYSKCFEDHLEQKYVQLFWGLPSLHSESLHPTVFVQHGRSSMFVFFNGITNTSMSHESPVLPPPQPLFLPSTQPLPLPQTLPRGQSLHLTQVKSLAQPQSPFPALPPSPLFLIRVCGVCFHRPQNEARSLMPSEINHLEWNVLQKVQESVWGLPSVVQKSQEDFCPPAPNPVLVRKSFKVHVPISIIPGDFPLSSEVRKKLEQHIRKRLIQRRWGLPRRIHESLSLLRPQNKISELSVSESIHGPLNISLVEGQRCNVLKKSASSFPRSFHERSSNMLSMENVGNYQGCSQETAPKNHLLHDPETSSEEDLRSNSERDLGTHMMHLSGNDSGVRLGQKQLENALTVHLSKKFEEINEGRMPGTVHSSWHSVKQTICLPEKSHSQIKHRNLAALVSEDHRVDTSQEMSFLSSNKQKMLEAHIKSFHMKPILNLSI

SEQ ID NO: 82817 - protein, 917 aa, Homo sapiens; identical to SEQ ID NO: 82816
  Payload ID: 16486
  Gene Symbol: SPATA31D3
  Gene Name: SPATA31 subfamily D, member 3
  Uniprot ID: P0C874
  ENSP ID: ENSP00000488801

SEQ ID NO: 82818 - protein, 917 aa, Homo sapiens
  Payload ID: 16487
  Gene Symbol: SPATA31D4
  Gene Name: SPATA31 subfamily D, member 4
  ENSP ID: ENSP00000488251
MENILCFLNSYTETGLSPDSHCLDIDLNFICLSGLGLFILYLFYMVLTLYSSPTEKNNDTQKHQGRARRKRKSVTFKDRKSLQKEAEEERKLHSFLKSFGPPVSCSPLGQHHDTTLFRRLLCPDPVCRVCNRATADIQRLLSWESLKDAAPSVSPLASSASGAESSFTLASTPSATTPEDLILSSRPKPSPPPPLILSPDLITTLADLFSPSPLRDPLPPQPVSPLDSKFPIDHSPPQQLPFPLLPPHHIERVEPSLQPEASLSLNTIFSFGSTLCQDISQAVNRTDSCARHHGPPTPSALPPEDCTVTQSKSNLTVLKTFPEMLSLGGSGGSSTSAPTTKGIDHSCPASSEFSWWQPHAKDSFSSNFVPSDFMEELLTLHSSEASLGGHSVANIIQPVNISFLSHDIPALLERQVKRRGDFLMWKENGKKPGSFPTQLRPNYQLNSSRNMLTSTAVKHDLAESFPFWASKGKLEWQHIHQQPPYSKCFEDHLEQKYVQLFWGLPSLHSESLHPTVFVQHGRSSMFVFFNGITNTSMSHESPVLPPPQPLFLPSTQPLPLPQTLPRGQSLHLTQVKSLAQPQSPFPALPPSPLFLIRVCGVCFHRPQNEARSLMPSEINHLEWNVLQKVQESVWGLPSVVQKSQEDFCPPAPNPVLVRKSFKVHVPISIIPGDFPLSSEVRKKLEQHIRKRLIQRRWGLPRRIHESLSLLRPQNKISELSVSESIHGPLNISLVEGQRCNVLKKSASSFPRSFHERSSNMLSMENVGNYQGCSQETAPKNHLLHDPETSSDEDLRSNSERDLGTHMMHLSGNDSGVRLGQKQLENALTVHLSKKFEEINEGRMPGTVHSSWHSVKQTICLPEKSHSQIKHRNLAALVSEDHGVDTSQEMSFLSSNKQKMLEAHIKSFHMKPILNLSI

SEQ ID NO: 82819 - protein, 1445 aa, Homo sapiens
  Payload ID: 16488
  Gene Symbol: SPATA31E1
  Gene Name: SPATA31 subfamily E, member 1
  Uniprot ID: Q6ZUB1
  ENSP ID: ENSP00000322640
MGNLVIPLGKGRAGRVESGQRIPPPAPRPSVECTGDDIALQMEKMLFPLKSPSATWLSPSSTPWMMDFILTSVCGLVLLFLLLLYVHSDPPSPPPGRKRSSREPQRERSGRSRSRKISALKACRILLRELEETRDLNYLLESHLRKLAGEGSSHLPLGGDPLGDVCKPVPAKAHQPHGKCMQDPSPASLSPPAPPAPLASTLSPGPMTFSEPFGPHSTLSASGPPEPLLPLKCPATQPHVVFPPSPQPHGPLASSPPPPDSSLAGLQCGSTTCPVPQSSPLHNQVLPPPTRVISGLGCSSDPIWDLYCWREAATTWGLSTYSHGKSQPRHLPDHTSEASFWGDPTPKHMEVGGCTFIHPDVQKLLETLIAKRALMKMWQEKERKRADHPHMTSLGKEWDITTLNPFWNVSTQPQQLPRPQQVSDATTVGNHLQQKRSQLFWDLPSLNSESLATTVWVSRNPSSQNAHSVPLDKASTSLPGEPEVEASSQLSQAPPQPHHMAQPQHFTPAWPQSQPPPLAEIQTQAHLSPPVPSLGCSSPPQIRGCGASYPTSQERTQSVIPTGKEYLEWPLKKRPKWKRVLPSLLKKSQAVLSQPTAHLPQERPASWSPKSAPILPGVVTSPELPEHWWQGRNAIHQEQSCGPPSRLQASGDLLQPDGEFPGRPQSQAEDTQQALLPSQPSDFAGKGRKDVQKTGFRSSGRFSDKGCLGSKLGPDPSRDQGSGRTSVKALDEDKEAEGDLRRSWKYQSVSSTPRDPDKEHLENKLQIHLARKVGEIKEGWIPMPVRRSWLMAKCAVPKSDTHRKPGKLASWRGGKAHVNTSQELSFLHPCTQQILEVHLVRFCVRHSWGTDLQSLEPINVWSGEAQAPPFPQSTFTPWASWVSRVESVPKVPIFLGKRPQNGPGDNRTTSKSVPTVSGPLAAPPPEQEGVQRPPRGSQSADTHGRSEAFPTGHKGRGCSQPPTCSLVGRTWQSRTVLESGKPKPRLEGSMGSEMAGNEAWLESESMSPGDPCSSRALQVLSIGSQWARAEDALQALKVGEKPPTWEVTLGASVRASSGSVQEDLRSTGALGTTGNPSASSVCVAQDPEQLHLKAQVVSEIALIVQVDSEEQLPGRAPGILLQDGATGLCLPGRHMDMLTAADRLPTQAPLSTSQSVSGKNMTASQGPCALLWKGGDSPGQQEPGSPKAKAPQKSQKTLGCADKGEAHRRPRTGEQGHRSKGPRTSEASGRSHPAQAREIGDKQERKYNQLQLEKGQTPPESHFQRKISHHPQGLHPRKGGTRWEDVLQKGKPGADAFQSWGSGPPRQFMDCMADKAWTISRVVGQILVDKLGLQWGRGPSEVNRHKGDFRAQENVPSCCHRGHCHQERSREMRALACSPKATPKGHHCPVKNRGIRDRDSSWAPPPREPVSPAGPHHHRPRMASTSGGPHPQLQELMSAQRCLAS

SEQ ID NO: 82820 - protein, 134 aa, Homo sapiens
  Payload ID: 16489
  Gene Symbol: SPC24
  Gene Name: SPC24, NDC80 kinetochore complex component
  ENSP ID: ENSP00000397131
MAAFRDIEEVSQGLLSLLGANRAEAQQRRLLGRHEQVVERLLETQDGAEKQLRGLQTRGMFLASGGKWNHLLSALLGEGQTLGSLLLSTLQRSSPWRRKWPRAFSMRRSRCTREAWSCSSWKLGFRRLGRRTPV

SEQ ID NO: 82821 - protein, 197 aa, Homo sapiens
  Payload ID: 16489
  Gene Symbol: SPC24
  Gene Name: SPC24, NDC80 kinetochore complex component
  Uniprot ID: Q8NBT2
  ENSP ID: ENSP00000465075
MAAFRDIEEVSQGLLSLLGANRAEAQQRRLLGRHEQVVERLLETQDGAEKQLREILTMEKEVAQSLLNAKEQVHQGGVELQQLEAGLQEAGEEDTRLKASLLQLTRELEELKEIEADLERQEKEVDEDTTVTIPSAVYVAQLYHQVSKIEWDYECEPGMVKGIHHGPSVAQPIHLDSTQLSRKFISDYLWSLVDTEW

SEQ ID NO: 82822 - protein, 168 aa, Homo sapiens
  Payload ID: 16489
  Gene Symbol: SPC24
  Gene Name: SPC24, NDC80 kinetochore complex component
  ENSP ID: ENSP00000465167
  MOD_RES (1)..(1): Any amino acid
XFRDIEEVSQGLLSLLGANRAEAQQRRLLGRHEQVVERLLETQDGAEKQLREILTMEKEVAQSLLNAKEQVHQGGVELQQLEAGLQEAGEEDTRLKASLLQLTRELEELKEIEADLERQEKEVDEDTTVTIPSAVYVAQLYHQVSKIEWDYECEPGMVKGSILFGEPF

SEQ ID NO: 82823 - protein, 172 aa, Homo sapiens
  Payload ID: 16489
  Gene Symbol: SPC24
  Gene Name: SPC24, NDC80 kinetochore complex component
  ENSP ID: ENSP00000465335
  MOD_RES (1)..(1): Any amino acid
XRDIEEVSQGLLSLLGANRAEAQQRRLLGRHEQVVERLLETQDGAEKQLREILTMEKEVAQSLLNAKEQVHQGGVELQQLEAGLQEAGEEDTRLKASLLQLTRELEELKEIEADLERQEKEVDEDTTVTIPSAVYVAQLYHQLLEWPQLGNQRESTYLCQACSFTSVTGWDK

SEQ ID NO: 82824 - protein, 171 aa, Homo sapiens
  Payload ID: 16489
  Gene Symbol: SPC24
  Gene Name: SPC24, NDC80 kinetochore complex component
  ENSP ID: ENSP00000466688
RDIEEVSQGLLSLLGANRAEAQQRRLLGRHEQVVERLLETQDGAEKQLREILTMEKEVAQSLLNAKEQVHQGGVELQQLEAGLQEAGEEDTRLKASLLQLTRELEELKEIEADLERQEKEVDEDTTVTIPSAVYVAQLYHQVSKIEWDYECEPGMVKGRGMFECHGVPRLC

SEQ ID NO: 82825 - protein, 126 aa, Homo sapiens
  Payload ID: 16489
  Gene Symbol: SPC24
  Gene Name: SPC24, NDC80 kinetochore complex component
  ENSP ID: ENSP00000468366
DIEEVSQGLLSLLGANRAEAQQRRLLGRHEQVVERLLETQDGAEKQLRGTWLNFTTKLVKLSGIMSVSQGWSKASIMAPVWPSPSTWTAPSSPGNSSATTSGVWWTPSGSQEPRGCVLHPAGICRG

SEQ ID NO: 82826 - protein, 209 aa, Homo sapiens
  Payload ID: 16489
  Gene Symbol: SPC24
  Gene Name: SPC24, NDC80 kinetochore complex component
  ENSP ID: ENSP00000468818
MAAFRDIEEVSQGLLSLLGANRAEAQQRRLLGRHEQVVERLLETQDGAEKQLREILTMEKEVAQSLLNAKEQVHQGGVELQQLEAGLQEAGEEDTRLKASLLQLTRELEELKEIEADLERQEKEVDEDTTVTIPSAVYVAQLYHQVIRPPWPPKVLDSRDLPTSASKYLGLQVCAIASGWIVSRWRETQNFLERNGGVILVPPGLFLLS

SEQ ID NO: 82827 - protein, 224 aa, Homo sapiens
  Payload ID: 16490
  Gene Symbol: SPC25
  Gene Name: SPC25, NDC80 kinetochore complex component
  Uniprot ID: Q9HBM1
  ENSP ID: ENSP00000282074
MVEDELALFDKSINEFWNKFKSTDTSCQMAGLRDTYKDSIKAFAEKLSVKLKEEERMVEMFLEYQNQISRQNKLIQEKKDNLLKLIAEVKGKKQELEVLTANIQDLKEEYSRKKETISTANKANAERLKRLQKSADLYKDRLGLEIRKIYGEKLQFIFTNIDPKNPESPFMFSLHLNEARDYEVSDSAPHLEGLAEFQENVRKTNNFSAFLANVRKAFTATVYN

SEQ ID NO: 82828 - protein, 115 aa, Homo sapiens
  Payload ID: 16490
  Gene Symbol: SPC25
  Gene Name: SPC25, NDC80 kinetochore complex component
  ENSP ID: ENSP00000393322
MVEDELALFDKSINEFWNKFKSTDTSCQMAGLRDTYKDSIKAFAEKLSVKLKEEERMVEMFLEYQNQISRQNKLIQEKKDNLLKLIAEVKGKKQELEVLTANIQDLKEEYSRKKE

SEQ ID NO: 82829 - protein, 115 aa, Homo sapiens; identical to SEQ ID NO: 82828
  Payload ID: 16490
  Gene Symbol: SPC25
  Gene Name: SPC25, NDC80 kinetochore complex component
  ENSP ID: ENSP00000478742

SEQ ID NO: 82830 - protein, 224 aa, Homo sapiens; identical to SEQ ID NO: 82827
  Payload ID: 16490
  Gene Symbol: SPC25
  Gene Name: SPC25, NDC80 kinetochore complex component
  Uniprot ID: Q9HBM1
  ENSP ID: ENSP00000481354

SEQ ID NO: 82831 - protein, 224 aa, Homo sapiens; identical to SEQ ID NO: 82827
  Payload ID: 16490
  Gene Symbol: SPC25
  Gene Name: SPC25, NDC80 kinetochore complex component
  Uniprot ID: Q9HBM1
  ENSP ID: ENSP00000483050

SEQ ID NO: 82832 - protein, 911 aa, Homo sapiens
  Payload ID: 16491
  Gene Symbol: SPECC1L-ADORA2A
  Gene Name: SPECC1L-ADORA2A readthrough (NMD candidate)
  ENSP ID: ENSP00000351480
MKKASRSVGSVPKVSAISKTQTAEKIKPENSSSASTGGKLVKPGTAASLSKTKSSDDLLAGMAGGVTVTNGVKGKKSTCPSAAPSASAPAMTTVENKSKISTGTASSTKRSTSTGNKESSSTRERLRERTRLNQSKKLPSAGQGANDMALAKRSRSRTATECDVRMSKSKSDNQISDRAALEAKVKDLLTLAKTKDVEILHLRNELRDMRAQLGINEDHSEGDEKSEKETIMAHQPTDVESTLLQLQEQNTAIREELNQLKNENRMLKDRLNALGFSLEQRLDNSEKLFGYQSLSPEITPGNQSDGGGTLTSSVEGSAPGSVEDLLSQDENTLMDHQHSNSMDNLDSECSEVYQPLTSSDDALDAPSSSESEGIPSIERSRKGSSGNASEVSVACLTERIHQMEENQHSTSEELQATLQELADLQQITQELNSENERLGEEKVILMESLCQQSDKLEHFSRQIEYFRSLLDEHHISYVIDEDVKSGRYMELEQRYMDLAENARFEREQLLGVQQHLSNTLKMAEQDNKEAQEMIGALKERSHHMERIIESEQKGKAALAATLEEYKATVASDQIEMNRLKAQLENEKQKVAELYSIHNSGDKSDIQDLLESVRLDKEKAETLASSLQEDLAHTRNDANRLQDAIAKVEDEYRAFQEEAKKQIEDLNMTLEKLRSDLDEKETERSDMKETIFELEDEVEQHRAVKLHDNLIISDLENTVKKLQDQKHDMEREIKTLHRRLREESAEWRQFQADLQTAVVIANDIKSEAQEEIGDLKRRLHEAQEKNEKLTKELEEIKSRKQEEERGRVYNYMNAVERDLAALRQGMGLSRRSSTSSEPTPTVKTLIKSFDSASQVPNPAAAAIPRTPLSPSPMKTPPAAAVSPMQMESSSVAHAGMQWRDLGSLQPLPPGFK

SEQ ID NO: 82833 - protein, 412 aa, Homo sapiens; identical to SEQ ID NO: 2674
  Payload ID: 16491
  Gene Symbol: SPECC1L-ADORA2A
  Gene Name: SPECC1L-ADORA2A readthrough (NMD candidate)
  Uniprot ID: P29274
  ENSP ID: ENSP00000480012

SEQ ID NO: 82834 - protein, 412 aa, Homo sapiens; identical to SEQ ID NO: 2674
  Payload ID: 16491
  Gene Symbol: SPECC1L-ADORA2A
  Gene Name: SPECC1L-ADORA2A readthrough (NMD candidate)
  Uniprot ID: P29274
  ENSP ID: ENSP00000481552

SEQ ID NO: 82835 - protein, 412 aa, Homo sapiens; identical to SEQ ID NO: 2674
  Payload ID: 16491
  Gene Symbol: SPECC1L-ADORA2A
  Gene Name: SPECC1L-ADORA2A readthrough (NMD candidate)
  Uniprot ID: P29274
  ENSP ID: ENSP00000483102

SEQ ID NO: 82836 - protein, 374 aa, Homo sapiens
  Payload ID: 16492
  Gene Symbol: SPOP
  Gene Name: speckle-type POZ protein
  Uniprot ID: O43791
  ENSP ID: ENSP00000240327
MSRVPSPPPPAEMSSGPVAESWCYTQIKVVKFSYMWTINNFSFCREEMGEVIKSSTFSSGANDKLKWCLRVNPKGLDEESKDYLSLYLLLVSCPKSEVRAKFKFSILNAKGEETKAMESQRAYRFVQGKDWGFKKFIRRDFLLDEANGLLPDDKLTLFCEVSVVQDSVNISGQNTMNMVKVPECRLADELGGLWENSRFTDCCLCVAGQEFQAHKAILAARSPVFSAMFEHEMEESKKNRVEINDVEPEVFKEMMCFIYTGKAPNLDKMADDLLAAADKYALERLKVMCEDALCSNLSVENAAEILILADLHSADQLKTQAVDFINYHASDVLETSGWKSMVVSHPHLVAEAYRSLASAQCPFLGPPRKRLKQS

SEQ ID NO: 82837 - protein, 374 aa, Homo sapiens; identical to SEQ ID NO: 82836
  Payload ID: 16492
  Gene Symbol: SPOP
  Gene Name: speckle-type POZ protein
  Uniprot ID: O43791
  ENSP ID: ENSP00000377001

SEQ ID NO: 82838 - protein, 374 aa, Homo sapiens; identical to SEQ ID NO: 82836
  Payload ID: 16492
  Gene Symbol: SPOP
  Gene Name: speckle-type POZ protein
  Uniprot ID: O43791
  ENSP ID: ENSP00000420908

SEQ ID NO: 82839 - protein, 238 aa, Homo sapiens
  Payload ID: 16492
  Gene Symbol: SPOP
  Gene Name: speckle-type POZ protein
  ENSP ID: ENSP00000420960
MSRVPSPPPPAEMSSGPVAESWCYTQIKVVKFSYMWTINNFSFCREEMGEVIKSSTFSSGANDKLKWCLRVNPKGLDEESKDYLSLYLLLVSCPKSEVRAKFKFSILNAKGEETKAMESQRAYRFVQGKDWGFKKFIRRDFLLDEANGLLPDDKLTLFCEVSVVQDSVNISGQNTMNMVKVPECRLADELGGLWENSRFTDCCLCVAGQEFQAHKAILAARSPVFSAMFEHEMEESKK

SEQ ID NO: 82840 - protein, 44 aa, Homo sapiens
  Payload ID: 16492
  Gene Symbol: SPOP
  Gene Name: speckle-type POZ protein
  ENSP ID: ENSP00000422609
MSRVPSPPPPAEMSSGPVAESWCYTQCSQQLKKVIKAIGQCEIS

SEQ ID NO: 82841 - protein, 32 aa, Homo sapiens
  Payload ID: 16492
  Gene Symbol: SPOP
  Gene Name: speckle-type POZ protein
  ENSP ID: ENSP00000423076
MSRVPSPPPPAEMSSGPVAESWCYTQIKVVKF

SEQ ID NO: 82842 - protein, 72 aa, Homo sapiens
  Payload ID: 16492
  Gene Symbol: SPOP
  Gene Name: speckle-type POZ protein
  ENSP ID: ENSP00000423284
  MOD_RES (1)..(1): Any amino acid
XKSEVRAKFKFSILNAKGEETKAMESQRAYRFVQGKDWGFKKFIRRDFLLDEANGLLPDDKLTLFCEILIKS

SEQ ID NO: 82843 - protein, 138 aa, Homo sapiens
  Payload ID: 16492
  Gene Symbol: SPOP
  Gene Name: speckle-type POZ protein
  ENSP ID: ENSP00000424119
MSRVPSPPPPAEMSSGPVAESWCYTQIKVVKFSYMWTINNFSFCREEMGEVIKSSTFSSGANDKLKWCLRVNPKGLDEESKDYLSLYLLLVSCPKSEVRAKFKFSILNAKGEETKAMESQRAYRFVQGKDWGFKKFIR

SEQ ID NO: 82844 - protein, 66 aa, Homo sapiens
  Payload ID: 16492
  Gene Symbol: SPOP
  Gene Name: speckle-type POZ protein
  ENSP ID: ENSP00000425410
MSRVPSPPPPAEMSSGPVAESWCYTQIKVVKFSYMWTINNFSFCREEMGEVIKSSTFSSGANDKLK

SEQ ID NO: 82845 - protein, 44 aa, Homo sapiens; identical to SEQ ID NO: 82840
  Payload ID: 16492
  Gene Symbol: SPOP
  Gene Name: speckle-type POZ protein
  ENSP ID: ENSP00000425604

SEQ ID NO: 82846 - protein, 374 aa, Homo sapiens; identical to SEQ ID NO: 82836
  Payload ID: 16492
  Gene Symbol: SPOP
  Gene Name: speckle-type POZ protein
  Uniprot ID: O43791
  ENSP ID: ENSP00000425905

SEQ ID NO: 82847 - protein, 185 aa, Homo sapiens
  Payload ID: 16492
  Gene Symbol: SPOP
  Gene Name: speckle-type POZ protein
  ENSP ID: ENSP00000426262
MSRVPSPPPPAEMSSGPVAESWCYTQIKVVKFSYMWTINNFSFCREEMGEVIKSSTFSSGANDKLKWCLRVNPKGLDEESKDYLSLYLLLVSCPKSEVRAKFKFSILNAKGEETKAMESQRAYRFVQGKDWGFKKFIRRDFLLDEANGLLPDDKLTLFCEVSVVQDSVNISGQNTMNMVKVPECR

SEQ ID NO: 82848 - protein, 117 aa, Homo sapiens
  Payload ID: 16492
  Gene Symbol: SPOP
  Gene Name: speckle-type POZ protein
  ENSP ID: ENSP00000426537
MSRVPSPPPPAEMSSGPVAESWCYTQIKVVKFSYMWTINNFSFCREEMGEVIKSSTFSSGANDKLKWCLRVNPKGLDEESKDYLSLYLLLVSCPKSEVRAKFKFSILNAKGEETKAM

SEQ ID NO: 82849 - protein, 262 aa, Homo sapiens
  Payload ID: 16492
  Gene Symbol: SPOP
  Gene Name: speckle-type POZ protein
  ENSP ID: ENSP00000426986
MSRVPSPPPPAEMSSGPVAESWCYTQIKVVKFSYMWTINNFSFCREEMGEVIKSSTFSSGANDKLKWCLRVNPKGLDEESKDYLSLYLLLVSCPKSEVRAKFKFSILNAKGEETKAMESQRAYRFVQGKDWGFKKFIRRDFLLDEANGLLPDDKLTLFCEVSVVQDSVNISGQNTMNMVKVPECRLADELGGLWENSRFTDCCLCVAGQEFQAHKAILAARSPVFSAMFEHEMEESKKNRVEINDVEPEVFKEMMCFIYTGK

SEQ ID NO: 82850 - protein, 40 aa, Homo sapiens
  Payload ID: 16492
  Gene Symbol: SPOP
  Gene Name: speckle-type POZ protein
  ENSP ID: ENSP00000427419
MSRVPSPPPPAEMSSGPVAESWCYTQIKVVKFSYMWTINN

SEQ ID NO: 82851 - protein, 392 aa, Homo sapiens
  Payload ID: 16493
  Gene Symbol: SPOPL
  Gene Name: speckle-type POZ protein-like
  Uniprot ID: Q6IQ16
  ENSP ID: ENSP00000280098
MSREPTPPLPGDMSTGPIAESWCYTQVKVVKFSYMWTINNFSFCREEMGEVLKSSTFSSGPSDKMKWCLRVNPKGLDDESKDYLSLYLLLVSCPKSEVRAKFKFSLLNAKREETKAMESQRAYRFVQGKDWGFKKFIRRDFLLDEANGLLPDDKLTLFCEVSVVQDSVNISGHTNTNTLKVPECRLAEDLGNLWENTRFTDCSFFVRGQEFKAHKSVLAARSPVFNAMFEHEMEESKKNRVEINDLDPEVFKEMMRFIYTGRAPNLDKMADNLLAAADKYALERLKVMCEEALCSNLSVENVADTLVLADLHSAEQLKAQAIDFINRCSVLRQLGCKDGKNWNSNQATDIMETSGWKSMIQSHPHLVAEAFRALASAQCPQFGIPRKRLKQS

SEQ ID NO: 82852 - protein, 190 aa, Homo sapiens
  Payload ID: 16493
  Gene Symbol: SPOPL
  Gene Name: speckle-type POZ protein-like
  ENSP ID: ENSP00000396006
MSREPTPPLPGDMSTGPIAESWCYTQVKVVKFSYMWTINNFSFCREEMGEVLKSSTFSSGPSDKMKWCLRVNPKGLDDESKDYLSLYLLLVSCPKSEVRAKFKFSLLNAKREETKAMESQRAYRFVQGKDWGFKKFIRRDFLLDEANGLLPDDKLTLFCENLQHCLQKRRKHCTTLPKELPPPPPLQVVL

SEQ ID NO: 82853 - protein, 72 aa, Homo sapiens
  Payload ID: 16493
  Gene Symbol: SPOPL
  Gene Name: speckle-type POZ protein-like
  ENSP ID: ENSP00000410201
MSREPTPPLPGDMSTGPIAESWCYTQVKVVKFSYMWTINNFSFCREEMGEVLKSSTFSSGPSDKMKCQLPQK

SEQ ID NO: 82854 - protein, 8392 aa, Homo sapiens
  Payload ID: 16494
  Gene Symbol: SYNE1
  Gene Name: spectrin repeat containing, nuclear envelope 1
  ENSP ID: ENSP00000341887
MQRLQDEQEIVQKRTFTKWINSHLAKRKPPMVVDDLFEDMKDGVKLLALLEVLSGQKLPCEQGRRMKRIHAVANIGTALKFLEGRKIKLVNINSTDIADGRPSIVLGLMWTIILYFQIEELTSNLPQLQSLSSSASSVDSIVSSETPSPPSKRKVTTKIQGNAKKALLKWVQYTAGKQTGIEVKDFGKSWRSGVAFHSVIHAIRPELVDLETVKGRSNRENLEDAFTIAETELGIPRLLDPEDVDVDKPDEKSIMTYVAQFLKHYPDIHNASTDGQEDDEILPGFPSFANSVQNFKREDRVIFKEMKVWIEQFERDLTRAQMVESNLQDKYQSFKHFRVQYEMKRKQIEHLIQPLHRDGKLSLDQALVKQSWDRVTSRLFDWHIQLDKSLPAPLGTIGAWLYRAEVALREEITVQQVHEETANTIQRKLEQHKRKCQTIMDLLQNTDAHKRAFHEIYRTRSVNGIPVPPDQLEDMAERFHFVSSTSELHLMKMEFLELKYRLLSLLVLAESKLKSWIIKYGRRESVEQLLQNYVSFIENSKFFEQYEVTYQILKQTAEMYVKADGSVEEAENVMKFMNETTAQWRNLSVEVRSVRSMLEEVISNWDRYGNTVASLQAWLEDAEKMLNQSENAKKDFFRNLPHWIQQHTAMNDAGNFLIETCDEMVSRDLKQQLLLLNGRWRELFMEVKQYAQADEMDRMKKEYTDCVVTLSAFATEAHKKLSEPLEVSFMNVKLLIQDLEDIEQRVPVMDAQYKIITKTAHLITKESPQEEGKEMFATMSKLKEQLTKVKECYSPLLYESQQLLIPLEELEKQMTSFYDSLGKINEIITVLEREAQSSALFKQKHQLRILKCKWCNSSQKMTLCLVLGSMISMLSTAKITIAGYKSEVEVSELLACQENCKKTLTLIEKGSQSVQKFVTLSNVLKHFDQTRLQTDCRYSCCFSVMRKQHHIMIVFHIKSMVKKTGDWKKHVETNSRLMKKFEESRAELEKVLRIAQEGLEEKGDPEELLRRHTEFFSQLDQRVLNAFLKACDELTDILPEQEQQGLQEAVRKLHKQWKDLQGEAPYHLLHLKIDVEKNRFLASVEECRTELDRETKLMPQEGSEKIIKEHRVFFSDKGPHHLCEKRLQLIEELCVKLPVRDPVRDTPGTCHVTLKELRAAIDSTYRKLMEDPDKWKDYTSRFSEFSSWISTNETQLKGIKGEAIDTANHGEVKRAVEEIRNGVTKRGETLSWLKSRLKVLTEVSSENEAQKQGDELAKLSSSFKALVTLLSEVEKMLSNFGDCVQYKEIVKNSLEELISGSKEVQEQAEKILDTENLFEAQQLLLHHQQKTKRISAKKRDVQQQIAQAQQGEGGLPDRGHEELRKLESTLDGLERSRERQERRIQVTLRKWERFETNKETVVRYLFQTGSSHERFLSFSSLESLSSELEQTKEFSKRTESIAVQAENLVKEASEIPLGPQNKQLLQQQAKSIKEQVKKLEDTLEEEYVIDNKTMEMVKTKWDHFGSNFETLSVWITEKEKELNALETSSSAMDMQISQIKVTIQEIESKLSSIVGLEEEAQSFAQFVTTGESARIKAKLTQIRRYGEELREHAQCLEGTILGHLSQQQKFEENLRKIQQSVSEFEDKLAVPIKICSSATETYKVLQEHMDLCQALESLSSAITAFSASARKVVNRDSCVQEAAALQQQYEDILRRAKERQTALENLLAHWQRLEKELSSFLTWLERGEAKASSPEMDISADRVKVEASKDDVKMMKLHLEQLDERWRDLPQIINKRINFLQSVVAEHQQFDELLLSFSVWIKLFLSELQTTSEISIMDHQVALTRHKDHAAEVESKKGELQSLQGHLAKLGSLGRAEDLHLLQGKAEDCFQLFEEASQVVERRQLALSHLAEFLQSHASLSGILRQLRQTVEATNSMNKNESDLIEKDLNDALQNAKALESAAVSLDGILSKAQYHLKIGSSEQRTSCRATADQLCGEVERIQNLLGTKQSEADALAVLKKAFQDQKEELLKSIEDIEERTDKERLKEPTRQALQQRLRVFNQLEDELNSHEHELCWLKDKAKQIAQKDVAFAPEVDREINRLEVTWDDTKRLIHENQGQCCGLIDLMREYQNLKSAVSKVLENASSVIVTRTTIKDQEDLKWAFSKHETAKNKMNYKQKDLDNFTSKGKHLLSELKKIHSSDFSLVKTDMESTVDKWLDVSEKLEENMDRLRVSLSIWDDVLSTRDEIEGWSNNCVPQMAENISNLDNHLRAEELLKEFESEVKNKALRLEELHSKVNDLKELTKNLETPPDLQFIEADLMQKLEHAKEITEVAKGTLKDFTAQSTQVEKFINDITTWFTKVEESLMNCAQNETCEALKKVKDIQKELQSQQSNISSTQENLNSLCRKYHSAELESLGRAMTGLIKKHEAVSQLCSKTQASLQESLEKHFSEESMQEFQEWFLGAKAAAKESSDRTGDSKVLEAKLHDLQQNILDSVSDGQSKLDAVTQEGQTLYAHLSKQIVSSIQEQITKANEEFQAFLKQCLKDKQALQDCASELGSFEDQHRKLNLWIHEMEERFNTENLGESKQHIPEKKNEVHKVEMFLGELLAARESLDKLSQRGQLLSEEGHGAGQEGRLCSQLLTSHQNLLRMTKEKLRSCQVALQEHEALEEALQSMWFWVKAIQDRLACAESTLGSKDTLEKRLSQIQDILLMKGEGEVKLNMAIGKGEQALRSSNKEGQRVIQTQLETLKEVWADIMSSSVHAQSTLESVISQWNDYVERKNQLEQWMESVDQKIEHPLQPQPGLKEKFVLLDHLQSILSEAEDHTRALHRLIAKSRELYEKTEDESFKDTAQEELKTQFNDIMTVAKEKMRKVEEIVKDHLMYLDAVHEFTDWLHSAKEELHRWSDMSGDSSATQKKLSKIKELIDSREIGASRLSRVESLAPEVKQNTTASGCELMHTEMQALRADWKQWEDSVFQTQSCLENLVSQMALSEQEFSGQVAQLEQALEQFSALLKTWAQQLTLLEGKNTDEEIVECWHKGQEILDALQKAEPRTEDLKSQLNELCRFSRDLSTYSGKVSGLIKEYNCLCLQASKGCQNKEQILQQRFRKAFRDFQQWLVNAKITTAKCFDIPQNISEVSTSLQKIQEFLSESENGQHKLNMMLSKGELLSTLLTKEKAKGIQAKVTAAKEDWKNFHSNLHQKESALENLKIQMKDFEVSAEPIQDWLSKTEKMVHESSNRLYDLPAKRREQQKLQSVLEEIHCYEPQLNRLKEKAQQLWEGQAASKSFRHRVSQLSSQYLALSNLTKEKVSRLDRIVAEHNQFSLGIKELQDWMTDAIHMLDSYCHPTSDKSVLDSRTLKLEALLSVKQEKEIQMKMIVTRGESVLQNTSPEGIPTIQQQLQSVKDMWASLLSAGIRCKRVRLPCAYIALKLRVHQHAELRDKTTMLGKAKEAVTKSEKLVRLHQEYQRDLKAFEVWLGQEQEKLDQYSVLEGDAHTHETTLRDLQELQVHCAEGQALLNSVLHTREDVIPSGIPQAEDRALESLRQDWQAYQHRLSETRTQFNNVVNKLRLMEQKFQQVDEWLKTAEEKVSPRTRRQSNRATKEIQLHQMKKWHEEVTAYRDEVEEVGARAQEILDESHVNSRMGCQATQLTSRYQALLLQVLEQIKFLEEEIQSLEESESSLSSYSDWYGSTHKNFKNVATKIDKVDTVMMGKKLKTLEVLLKDMEKGHSLLKSAREKGERAVKYLEEGEAERLRKEIHDHMEQLKELTSTVRKEHMTLEKSLQQTVLSHEPSVKSVREKGEALLELVQDVTLKDKIDQLQSDYQDLCSIGKEHVFSLEAKVKDHEDYNSELQEVEKWLLQMSGRLVAPDLLETSSLETITQQLAHHKMYQSLEHELQKHVSRQDTLQQCQAWLSAVQPDLEPSPQPPLSRAEAIKQVKHFRALQEQARTYLDLLCSMCDLSNASVKTTAKDIQQTEQTIEQKLVQAQNLTQGWEEIKHLKSELWIYLQDADQQLQNMKRRHSELELNIAQNMVSQVKDFVKKLQSKQASVNTIIEKVNKLTKKEESPEHKEINHLNDQWLDLCRQSNNLCLQREEDLQRTRDYHDCMNVVEVFLEKFTTEWDNLARSDAESTAVHLEALKKLALALQERKYAIEDLKDQKQKMIEHLNLDDKELVKEQTSHLEQRWFQLEDLIKRKIQVSVTNLEELNVVQSRFQELMEWAEEQQPNIAEALKQSPPPDMAQNLLMDHLAICSELEAKQMLLKSLIKDADRVMADLGLNERQVIQKALSDAQSHVNCLSDLVGQRRKKHFKEDFDKACHWLKQADIVTFPEINLMNESSELHTQLAKYQNILEQSPEYENLLLTLQRTGQTILPSLNEVDHSYLSEKLNALPRQFNVIVALAKDKFYKVQEAILARKEYASLIELTTQSLSELEAQFLRMSKVPTDLAVEEALSLQDGCRAILDEVAGLGEAVDELNQKKEGFRSTGQPWQPDKMLHLVTLYHRLKRQTEQRVSLLEDTTSAYQEHEKMCQQLERQLKSVKEEQSKVNEETLPAEEKLKMYHSLAGSLQDSGIVLKRVTIHLEDLAPHLDPLAYEKARHQIQSWQGELKLLTSAIGETVTECESRMVQSIDFQTEMSRSLDWLRRVKAELSGPVYLDLNLQDIQEEIRKIQIHQEEVQSSLRIMNALSHKEKEKFTKAKELISADLEHSLAELSELDGDIQEALRTRQATLTEIYSQCQRYYQVFQAANDWLEDAQELLQLAGNGLDVESAEENLKSHMEFFSTEDQFHSNLEELHSLVATLDPLIKPTGKEDLEQKVASLELRSQRMSRDSGAQALVSVVNSFHEKIVALEEKASQLEKTGNDASKATLSRSMTTVWQRWTRLRAVAQDQEKILEDAVDEWTGFNNKVKKATEMIDQLQDKLPGSSAEKASKAELLTLLEYHDTFVLELEQQQSALGMLRQQTLSMLQDGAAPTPGEEPPLMQEITAMQDRCLKMVETQINSVKCWVQETKEYLGNPTIEIDAQLEELQILLTEATNHRQNIEKMAEEQKEKYLGLYTILPSELSLQLAEVALDLKIRDQIQDKIKEVEQSKATSQELSRQIQKLAKDLTTILTKLKAKTDNVVQAKTDQKAASHLEEYNEMLELILKWIEKAKVLAHGTIAWNSASQLREQYILHQTLLEESKEIDSELEAMTEKLQYLTSVYCTEKMSQQVAELGRETEELRQMIKIRLQNLQDAAKDMKKFEAELKKLQAALEQAQATLTSPEVGRLSLKEQLSHRQHLLSEMESLKPKVQAVQLCQSALRIPEDVVASLPLCHAALRLQEEASRLQHTAIQQCNIMQEAVVQYEQYEQEMKHLQQLIEGAHREIEDKPVATSNIQELQAQISRHEELAQKIKGYQEQIASLNSKCKMLTMKAKHATMLLTVTEVEGLAEGTEDLDGELLPTPSAHPSVVMMTAGRCHTLLSPVTEESGEEGTNSEISSPPACRSPSPVANTDASVNQDIAYYQALSAERLQTDAAKIHPSTSASQEFYEPGLEPSATAKLGDLQRSWETLKNVISEKQRTLYEALERQQKYQDSLQSISTKMEAIELKLSESPEPGRSPESQMAEHQALMDEILMLQDEINELQSSLAEELVSESCEADPAEQLALQSTLTVLAERMSTIRMKASGKRQLLEEKLNDQLEEQRQEQALQRYRCEADELDSWLLSTKATLDTALSPPKEPMDMEAQLMDCQNMLVEIEQKVVALSELSVHNENLLLEGKAHTKDEAEQLAGKLRRLKGSLLELQRALHDKQLNMQGTAQEKEESDVDLTATQSPGVQEWLAQARTTWTQQRQSSLQQQKELEQELAEQKSLLRSVASRGEEILIQHSAAETSGDAGEKPDVLSQELGMEGEKSSAEDQMRMKWESLHQEFSTKQKLLQNVLEQEQEQVLYSRPNRLLSGVPLYKGDVPTQDKSAVTSLLDGLNQAFEEVSSQSGGAKRQSIHLEQKLYDGVSATSTWLDDVEERLFVATALLPEETETCLFNQEILAKDIKEMSEEMDKNKNLFSQAFPENGDNRDVIEDTLGCLLGRLSLLDSVVNQRCHQMKERLQQILNFQNDLKVLFTSLADNKYIILQKLANVFEQPVAEQIEAIQQAEDGLKEFDAGIIELKRRGDKLQVEQPSMQELSKLQDMYDELMMIIGSRRSGLNQNLTLKSQYERALQDLADLLETGQEKMAGDQKIIVSSKEEIQQLLDKHKEYFQGLESHMILTETLFRKIISFAVQKETQFHTELMAQASAVLKRAHKRGVELEYILETWSHLDEDQQELSRQLEVVESSIPSVGLVEENEDRLIDRITLYQHLKSSLNEYQPKLYQVLDDGKRLLISISCSDLESQLNQLGECWLSNTNKMSKELHRLETILKHWTRYQSESADLIHWLQSAKDRLEFWTQQSVTVPQELEMVRDHLNAFLEFSKEVDAQSSLKSSVLSTGNQLLRLKKVDTATLRSELSRIDSQWTDLLTNIPAVQEKLHQLQMDKLPSRHAISEVMSWISLMENVIQKDEDNIKNSIGYKAIHEYLQKYKGFKIDINCKQLTVDFVNQSVLQISSQDVESKRSDKTDFAEQLGAMNKSWQILQGLVTEKIQLLEGLLESWSEYENNVQCLKTWFETQEKRLKQQHRIGDQASVQNALKDCQDLEDLIKAKEKEVEKIEQNGLALIQNKKEDVSSIVMSTLRELGQTWANLDHMVGQLKILLKSVLDQWSSHKVAFDKINSYLMEARYSLSRFRLLTGSLEAVQVQVDNLQNLQDDLEKQERSLQKFGSITNQLLKECHPPVTETLTNTLKEVNMRWNNLLEEIAEQLQSSKALLQLWQRYKDYSKQCASTVQQQEDRTNELLKAATNKDIADDEVATWIQDCNDLLKGLGTVKDSLFFLHELGEQLKQQVDASAASAIQSDQLSLSQHLCALEQALCKQQTSLQAGVLDYETFAKSLEALEAWIVEAEEILQGQDPSHSSDLSTIQERMEELKGQMLKFSSMAPDLDRLNELGYRLPLNDKEIKRMQNLNRHWSLISSQTTERFSKLQSFLLQHQTFLEKCETWMEFLVQTEQKLAVEISGNYQHLLEQQRAHELFQAEMFSRQQILHSIIIDGQRLLEQGQVDDRDEFNLKLTLLSNQWQGVIRRAQQRRGIIDSQIRQWQRYREMAEKLRKWLVEVSYLPMSGLGSVPIPLQQARTLFDEVQFKEKVFLRQQGSYILTVEAGKQLLLSADSGAEAALQAELAEIQEKWKSASMRLEEQKKKLAFLLKDWEKCEKGIADSLEKLRTFKKKLSQSLPDHHEELHAEQMRCKELENAVGSWTDDLTQLSLLKDTLSAYISADDISILNERVELLQRQWEELCHQLSLRRQQIGERLNEWAVFSEKNKELCEWLTQMESKVSQNGDILIEEMIEKLKKDYQEEIAIAQENKIQLQQMGERLAKASHESKASEIEYKLGKVNDRWQHLLDLIAARVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSGDHSALESQIRQLGKALDDSRFQIQQTENIIRSKTPTGPELDTSYKGYMKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKELQKAVDHRKAIILSINLCSPEFTQADSKESRDLQDRLSQMNGRWDRVCSLLEEWRGLLQDALMQCQGFHEMSHGLLLMLENIDRRKNEIVPIDSNLDAEILQDHHKQLMQIKHELLESQLRVASLQDMSCQLLVNAEGTDCLEAKEKVHVIGNRLKLLLKEVSRHIKELEKLLDVSSSQQDLSSWSSADELDTSGSVSPTSGRSTPNRQKTPRGKCSLSQPGPSVSSPHSRSTKGGSDSSLSEPGPGRSGRGFLFRVLRAALPLQLLLLLLIGLACLVPMSEEDYSCALSNNFARSFHPMLRYTNGPPPL

SEQ ID NO: 82855 - protein, 975 aa, Homo sapiens
  Payload ID: 16494
  Gene Symbol: SYNE1
  Gene Name: spectrin repeat containing, nuclear envelope 1
  ENSP ID: ENSP00000346701
MVVAEDLSALRMAEDSCVDADLPDCNCDVTRVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSDVMIPESPEAYVKLTENAIKNTSGDHSALESQIRQLGKALDDSRFQIQQTENIIRSKTPTGPELDTSYKGYMKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKELQKAVDHRKAIILSINLCSPEFTQADSKESRDLQDRLSQMNGRWDRVCSLLEEWRGLLQDALMQCQGFHEMSHGLLLMLENIDRRKNEIVPIDSNLDAEILQDHHKQLMQIKHELLESQLRVASLQDMSCQLLVNAEGTDCLEAKEKVHVIGNRLKLLLKEVSRHIKELEKLLDVSSSQQDLSSWSSADELDTSGSVSPTSGRSTPNRQKTPRGKCSLSQPGPSVSSPHSRSTKGGSDSSLSEPGPGRSGRGFLFRVLRAALPLQLLLLLLIGLACLVPMSEEDYSCALSNNFARSFHPMLRYTNGPPPL

SEQ ID NO: 82856 - protein, 1433 aa, Homo sapiens
  Payload ID: 16494
  Gene Symbol: SYNE1
  Gene Name: spectrin repeat containing, nuclear envelope 1
  ENSP ID: ENSP00000356217
MATSRGASRCPRDIANVMQRLQDEQEIVQKRTFTKWINSHLAKRKPPMVVDDLFEDMKDGVKLLALLEVLSGQKLPCEQGRRMKRIHAVANIGTALKFLEGRKSMHRGSPIKLVNINSTDIADGRPSIVLGLMWTIILYFQIEELTSNLPQLQSLSSSASSVDSIVSSETPSPPSKRKVTTKIQGNAKKALLKWVQYTAGKQTGIEVKDFGKSWRSGVAFHSVIHAIRPELVDLETVKGRSNRENLEDAFTIAETELGIPRLLDPEDVDVDKPDEKSIMTYVAQFLKHYPDIHNASTDGQEDDREDRVIFKEMKVWIEQFERDLTRAQMVESNLQDKYQSFKHFRVQYEMKRKQIEHLIQPLHRDGKLSLDQALVKQSWDRVTSRLFDWHIQLDKSLPAPLGTIGAWLYRAEVALREEITVQQVHEETANTIQRKLEQHKDLLQNTDAHKRAFHEIYRTRSVNGIPVPPDQLEDMAERFHFVSSTSELHLMKMEFLELKYRLLSLLVLAESKLKSWIIKYGRRESVEQLLQNYVSFIENSKFFEQYEVTYQILKQTAEMYVKADGSVEEAENVMKFMNETTAQWRNLSVEVRSVRSMLEEVISNWDRYGNTVASLQAWLEDAEKMLNQSENAKKDFFRNLPHWIQQHTAMNDAGNFLIETCDEMVSRDLKQQLLLLNGRWRELFMEVKQYAQADEMDRMKKEYTDCVVTLSAFATEAHKKLSEPLEVSFMNVKLLIQDLEDIEQRVPVMDAQYKIITKTAHLITKESPQEEGKEMFATMSKLKEQLTKVKECYSPLLYESQQLLIPLEELEKQMTSFYDSLGKINEIITVLEREAQSSALFKQKHQELLACQENCKKTLTLIEKGSQSVQKFVTLSNVLKHFDQTRLQRQIADIHVAFQSMVKKTGDWKKHVETNSRLMKKFEESRAELEKVLRIAQEGLEEKGDPEELLRRHTEFFSQLDQRVLNAFLKACDELTDILPEQEQQGLQEAVRKLHKQWKDLQGEAPYHLLHLKIDVEKNRFLASVEECRTELDRETKLMPQEGSEKIIKEHRVFFSDKGPHHLCEKRLQLIEELCVKLPVRDPVRDTPGTCHVTLKELRAAIDSTYRKLMEDPDKWKDYTSRFSEFSSWISTNETQLKGIKGEAIDTANHGEVKRAVEEIRNGVTKRGETLSWLKSRLKVLTEVSSENEAQKQGDELAKLSSSFKALVTLLSEVEKMLSNFGDCVQYKEIVKNSLEELISGSKEVQEQAEKILDTENLFEAQQLLLHHQQKTKRISAKKRDVQQQIAQAQQGEGGLPDRGHEELRKLESTLDGLERSRERQERRIQVTLRKWERFETNKETVVRYLFQTGSSHERFLSFSSLESLSSELEQTKEFSKRTESIAVQAENLVKEASEIPLGPQNKQLLQQQAKSIKEQVKKLEDTLEEEYVIDKS

SEQ ID NO: 82857 - protein, 1654 aa, Homo sapiens
  Payload ID: 16494
  Gene Symbol: SYNE1
  Gene Name: spectrin repeat containing, nuclear envelope 1
  ENSP ID: ENSP00000356220
EKIEQNGLALIQNKKEDVSSIVMSTLRELGQTWANLDHMVGQLKILLKSVLDQWSSHKVAFDKINSYLMEARYSLSRFRLLTGSLEAVQVQVDNLQNLQDDLEKQERSLQKFGSITNQLLKECHPPVTETLTNTLKEVNMRWNNLLEEIAEQLQSSKALLQLWQRYKDYSKQCASTVQQQEDRTNELLKAATNKDIADDEVATWIQDCNDLLKGLGTVKDSLFFLHELGEQLKQQVDASAASAIQSDQLSLSQHLCALEQALCKQQTSLQAGVLDYETFAKSLEALEAWIVEAEEILQGQDPSHSSDLSTIQERMEELKGQMLKFSSMAPDLDRLNELGYRLPLNDKEIKRMQNLNRHWSLISSQTTERFSKLQSFLLQHQTFLEKCETWMEFLVQTEQKLAVEISGNYQHLLEQQRAHELFQAEMFSRQQILHSIIIDGQRLLEQGQVDDRDEFNLKLTLLSNQWQGVIRRAQQRRGIIDSQIRQWQRYREMAEKLRKWLVEVSYLPMSGLGSVPIPLQQARTLFDEVQFKEKVFLRQQGSYILTVEAGKQLLLSADSGAEAALQAELAEIQEKWKSASMRLEEQKKKLAFLLKDWEKCEKGIADSLEKLRTFKKKLSQSLPDHHEELHAEQMRCKELENAVGSWTDDLTQLSLLKDTLSAYISADDISILNERVELLQRQWEELCHQLSLRRQQIGERLNEWAVFSEKNKELCEWLTQMESKVSQNGDILIEEMIEKLKKDYQEEIAIAQENKIQLQQMGERLAKASHESKASEIEYKLGKVNDRWQHLLDLIAARVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSDVMIPESPEAYVKLTENAIKNTSGDHSALESQIRQLGKALDDSRFQIQQTENIIRSKTPTGPELDTSYKGYMKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKELQKAVDHRKAIILSINLCSPEFTQADSKESRDLQDRLSQMNGRWDRVCSLLEEWRGLLQDALMQCQGFHEMSHGLLLMLENIDRRKNEIVPIDSNLDAEILQDHHKQLMQIKHELLESQLRVASLQDMSCQLLVNAEGTDCLEAKEKVHVIGNRLKLLLKEVSRHIKELEKLLDVSSSQQDLSSWSSADELDTSGSVSPTSGRSTPNRQKTVHKRWLRFLPF

SEQ ID NO: 82858 - protein, 1725 aa, Homo sapiens
  Payload ID: 16494
  Gene Symbol: SYNE1
  Gene Name: spectrin repeat containing, nuclear envelope 1
  Uniprot ID: Q8NF91
  ENSP ID: ENSP00000356222
MATSRGASRCPRDIANVMQRLQDEQEIVQKRTFTKWINSHLAKRKPPMVVDDLFEDMKDGVKLLALLEVLSGQKLPCEQGRRMKRIHAVANIGTALKFLEGRKIKLVNINSTDIADGRPSIVLGLMWTIILYFQIEELTSNLPQLQSLSSSASSVDSIVSSETPSPPSKRKVTTKIQGNAKKALLKWVQYTAGKQTGIEVKDFGKSWRSGVAFHSVIHAIRPELVDLETVKGRSNRENLEDAFTIAETELGIPRLLDPEDVDVDKPDEKSIMTYVAQFLKHYPDIHNASTDGQEDDEILPGFPSFANSVQNFKREDRVIFKEMKVWIEQFERDLTRAQMVESNLQDKYQSFKHFRVQYEMKRKQIEHLIQPLHRDGKLSLDQALVKQSWDRVTSRLFDWHIQLDKSLPAPLGTIGAWLYRAEVALREEITVQQVHEETANTIQRKLEQHKDLLQNTDAHKRAFHEIYRTRSVNGIPVPPDQLEDMAERFHFVSSTSELHLMKMEFLELKYRLLSLLVLAESKLKSWIIKYGRRESVEQLLQNYVSFIENSKFFEQYEVTYQILKQTAEMYVKADGSVEEAENVMKFMNETTAQWRNLSVEVRSVRSMLEEVISNWDRYGNTVASLQAWLEDAEKMLNQSENAKKDFFRNLPHWIQQHTAMNDAGNFLIETCDEMVSRDLKQQLLLLNGRWRELFMEVKQYAQADEMDRMKKEYTDCVVTLSAFATEAHKKLSEPLEVSFMNVKLLIQDLEDIEQRVPVMDAQYKIITKTAHLITKESPQEEGKEMFATMSKLKEQLTKVKECYSPLLYESQQLLIPLEELEKQMTSFYDSLGKINEIITVLEREAQSSALFKQKHQELLACQENCKKTLTLIEKGSQSVQKFVTLSNVLKHFDQTRLQRQIADIHVAFQSMVKKTGDWKKHVETNSRLMKKFEESRAELEKVLRIAQEGLEEKGDPEELLRRHTEFFSQLDQRVLNAFLKACDELTDILPEQEQQGLQEAVRKLHKQWKDLQGEAPYHLLHLKIDVEKNRFLASVEECRTELDRETKLMPQEGSEKIIKEHRVFFSDKGPHHLCEKRLQLIEELCVKLPVRDPVRDTPGTCHVTLKELRAAIDSTYRKLMEDPDKWKDYTSRFSEFSSWISTNETQLKGIKGEAIDTANHGEVKRAVEEIRNGVTKRGETLSWLKSRLKVLTEVSSENEAQKQGDELAKLSSSFKALVTLLSEVEKMLSNFGDCVQYKEIVKNSLEELISGSKEVQEQAEKILDTENLFEAQQLLLHHQQKTKRISAKKRDVQQQIAQAQQGEGGLPDRGHEELRKLESTLDGLERSRERQERRIQVTLRKWERFETNKETVVRYLFQTGSSHERFLSFSSLESLSSELEQTKEFSKRTESIAVQAENLVKEASEIPLGPQNKQLLQQQAKSIKEQVKKLEDTLEEDIKTMEMVKTKWDHFGSNFETLSVWITEKEKELNALETSSSAMDMQISQIKVTIQEIESKLSSIVGLEEEAQSFAQFVTTGESARIKAKLTQIRRYGEELREHAQCLEGTILGHLSQQQKFEENLRKIQQSVSEFEDKLAVPIKICSSATETYKVLQEHMDLCQALESLSSAITAFSASARKVVNRDSCVQEAAALQQQYEDILRRAKERQTALENLLAHWQRLEKELSSFLTWLERGEAKASSPEMDISADRVKVEGELQLIQASSRKCEEGKNKMLFVTVTLFKIIK

SEQ ID NO: 82859 - protein, 8797 aa, Homo sapiens
  Payload ID: 16494
  Gene Symbol: SYNE1
  Gene Name: spectrin repeat containing, nuclear envelope 1
  Uniprot ID: Q8NF91
  ENSP ID: ENSP00000356224
MATSRGASRCPRDIANVMQRLQDEQEIVQKRTFTKWINSHLAKRKPPMVVDDLFEDMKDGVKLLALLEVLSGQKLPCEQGRRMKRIHAVANIGTALKFLEGRKIKLVNINSTDIADGRPSIVLGLMWTIILYFQIEELTSNLPQLQSLSSSASSVDSIVSSETPSPPSKRKVTTKIQGNAKKALLKWVQYTAGKQTGIEVKDFGKSWRSGVAFHSVIHAIRPELVDLETVKGRSNRENLEDAFTIAETELGIPRLLDPEDVDVDKPDEKSIMTYVAQFLKHYPDIHNASTDGQEDDEILPGFPSFANSVQNFKREDRVIFKEMKVWIEQFERDLTRAQMVESNLQDKYQSFKHFRVQYEMKRKQIEHLIQPLHRDGKLSLDQALVKQSWDRVTSRLFDWHIQLDKSLPAPLGTIGAWLYRAEVALREEITVQQVHEETANTIQRKLEQHKDLLQNTDAHKRAFHEIYRTRSVNGIPVPPDQLEDMAERFHFVSSTSELHLMKMEFLELKYRLLSLLVLAESKLKSWIIKYGRRESVEQLLQNYVSFIENSKFFEQYEVTYQILKQTAEMYVKADGSVEEAENVMKFMNETTAQWRNLSVEVRSVRSMLEEVISNWDRYGNTVASLQAWLEDAEKMLNQSENAKKDFFRNLPHWIQQHTAMNDAGNFLIETCDEMVSRDLKQQLLLLNGRWRELFMEVKQYAQADEMDRMKKEYTDCVVTLSAFATEAHKKLSEPLEVSFMNVKLLIQDLEDIEQRVPVMDAQYKIITKTAHLITKESPQEEGKEMFATMSKLKEQLTKVKECYSPLLYESQQLLIPLEELEKQMTSFYDSLGKINEIITVLEREAQSSALFKQKHQELLACQENCKKTLTLIEKGSQSVQKFVTLSNVLKHFDQTRLQRQIADIHVAFQSMVKKTGDWKKHVETNSRLMKKFEESRAELEKVLRIAQEGLEEKGDPEELLRRHTEFFSQLDQRVLNAFLKACDELTDILPEQEQQGLQEAVRKLHKQWKDLQGEAPYHLLHLKIDVEKNRFLASVEECRTELDRETKLMPQEGSEKIIKEHRVFFSDKGPHHLCEKRLQLIEELCVKLPVRDPVRDTPGTCHVTLKELRAAIDSTYRKLMEDPDKWKDYTSRFSEFSSWISTNETQLKGIKGEAIDTANHGEVKRAVEEIRNGVTKRGETLSWLKSRLKVLTEVSSENEAQKQGDELAKLSSSFKALVTLLSEVEKMLSNFGDCVQYKEIVKNSLEELISGSKEVQEQAEKILDTENLFEAQQLLLHHQQKTKRISAKKRDVQQQIAQAQQGEGGLPDRGHEELRKLESTLDGLERSRERQERRIQVTLRKWERFETNKETVVRYLFQTGSSHERFLSFSSLESLSSELEQTKEFSKRTESIAVQAENLVKEASEIPLGPQNKQLLQQQAKSIKEQVKKLEDTLEEDIKTMEMVKTKWDHFGSNFETLSVWITEKEKELNALETSSSAMDMQISQIKVTIQEIESKLSSIVGLEEEAQSFAQFVTTGESARIKAKLTQIRRYGEELREHAQCLEGTILGHLSQQQKFEENLRKIQQSVSEFEDKLAVPIKICSSATETYKVLQEHMDLCQALESLSSAITAFSASARKVVNRDSCVQEAAALQQQYEDILRRAKERQTALENLLAHWQRLEKELSSFLTWLERGEAKASSPEMDISADRVKVEGELQLIQALQNEVVSQASFYSKLLQLKESLFSVASKDDVKMMKLHLEQLDERWRDLPQIINKRINFLQSVVAEHQQFDELLLSFSVWIKLFLSELQTTSEISIMDHQVALTRHKDHAAEVESKKGELQSLQGHLAKLGSLGRAEDLHLLQGKAEDCFQLFEEASQVVERRQLALSHLAEFLQSHASLSGILRQLRQTVEATNSMNKNESDLIEKDLNDALQNAKALESAAVSLDGILSKAQYHLKIGSSEQRTSCRATADQLCGEVERIQNLLGTKQSEADALAVLKKAFQDQKEELLKSIEDIEERTDKERLKEPTRQALQQRLRVFNQLEDELNSHEHELCWLKDKAKQIAQKDVAFAPEVDREINRLEVTWDDTKRLIHENQGQCCGLIDLMREYQNLKSAVSKVLENASSVIVTRTTIKDQEDLKWAFSKHETAKNKMNYKQKDLDNFTSKGKHLLSELKKIHSSDFSLVKTDMESTVDKWLDVSEKLEENMDRLRVSLSIWDDVLSTRDEIEGWSNNCVPQMAENISNLDNHLRAEELLKEFESEVKNKALRLEELHSKVNDLKELTKNLETPPDLQFIEADLMQKLEHAKEITEVAKGTLKDFTAQSTQVEKFINDITTWFTKVEESLMNCAQNETCEALKKVKDIQKELQSQQSNISSTQENLNSLCRKYHSAELESLGRAMTGLIKKHEAVSQLCSKTQASLQESLEKHFSESMQEFQEWFLGAKAAAKESSDRTGDSKVLEAKLHDLQNILDSVSDGQSKLDAVTQEGQTLYAHLSKQIVSSIQEQITKANEEFQAFLKQCLKDKQALQDCASELGSFEDQHRKLNLWIHEMEERFNTENLGESKQHIPEKKNEVHKVEMFLGELLAARESLDKLSQRGQLLSEEGHGAGQEGRLCSQLLTSHQNLLRMTKEKLRSCQVALQEHEALEEALQSMWFWVKAIQDRLACAESTLGSKDTLEKRLSQIQDILLMKGEGEVKLNMAIGKGEQALRSSNKEGQRVIQTQLETLKEVWADIMSSSVHAQSTLESVISQWNDYVERKNQLEQWMESVDQKIEHPLQPQPGLKEKFVLLDHLQSILSEAEDHTRALHRLIAKSRELYEKTEDESFKDTAQEELKTQFNDIMTVAKEKMRKVEEIVKDHLMYLDAVHEFTDWLHSAKEELHRWSDMSGDSSATQKKLSKIKELIDSREIGASRLSRVESLAPEVKQNTTASGCELMHTEMQALRADWKQWEDSVFQTQSCLENLVSQMALSEQEFSGQVAQLEQALEQFSALLKTWAQQLTLLEGKNTDEEIVECWHKGQEILDALQKAEPRTEDLKSQLNELCRFSRDLSTYSGKVSGLIKEYNCLCLQASKGCQNKEQILQQRFRKAFRDFQQWLVNAKITTAKCFDIPQNISEVSTSLQKIQEFLSESENGQHKLNMMLSKGELLSTLLTKEKAKGIQAKVTAAKEDWKNFHSNLHQKESALENLKIQMKDFEVSAEPIQDWLSKTEKMVHESSNRLYDLPAKRREQQKLQSVLEEIHCYEPQLNRLKEKAQQLWEGQAASKSFRHRVSQLSSQYLALSNLTKEKVSRLDRIVAEHNQFSLGIKELQDWMTDAIHMLDSYCHPTSDKSVLDSRTLKLEALLSVKQEKEIQMKMIVTRGESVLQNTSPEGIPTIQQQLQSVKDMWASLLSAGIRCKSQLEGALSKWTSYQDGVRQFSGWMDSMEANLNESERQHAELRDKTTMLGKAKLLNEEVLSYSSLLETIEVKGAGMTEHYVTQLELQDLQERYRAIQERAKEAVTKSEKLVRLHQEYQRDLKAFEVWLGQEQEKLDQYSVLEGDAHTHETTLRDLQELQVHCAEGQALLNSVLHTREDVIPSGIPQAEDRALESLRQDWQAYQHRLSETRTQFNNVVNKLRLMEQKFQQVDEWLKTAEEKVSPRTRRQSNRATKEIQLHQMKKWHEEVTAYRDEVEEVGARAQEILDESHVNSRMGCQATQLTSRYQALLLQVLEQIKFLEEEIQSLEESESSLSSYSDWYGSTHKNFKNVATKIDKVDTVMMGKKLKTLEVLLKDMEKGHSLLKSAREKGERAVKYLEEGEAERLRKEIHDHMEQLKELTSTVRKEHMTLEKGLHLAKEFSDKCKALTQWIAEYQEILHVPEEPKMELYEKKAQLSKYKSLQQTVLSHEPSVKSVREKGEALLELVQDVTLKDKIDQLQSDYQDLCSIGKEHVFSLEAKVKDHEDYNSELQEVEKWLLQMSGRLVAPDLLETSSLETITQQLAHHKAMMEEIAGFEDRLNNLQMKGDTLIGQCADHLQAKLKQNVHAHLQGTKDSYSAICSTAQRMYQSLEHELQKHVSRQDTLQQCQAWLSAVQPDLEPSPQPPLSRAEAIKQVKHFRALQEQARTYLDLLCSMCDLSNASVKTTAKDIQQTEQTIEQKLVQAQNLTQGWEEIKHLKSELWIYLQDADQQLQNMKRRHSELELNIAQNMVSQVKDFVKKLQSKQASVNTIIEKVNKLTKKEESPEHKEINHLNDQWLDLCRQSNNLCLQREEDLQRTRDYHDCMNVVEVFLEKFTTEWDNLARSDAESTAVHLEALKKLALALQERKYAIEDLKDQKQKMIEHLNLDDKELVKEQTSHLEQRWFQLEDLIKRKIQVSVTNLEELNVVQSRFQELMEWAEEQQPNIAEALKQSPPPDMAQNLLMDHLAICSELEAKQMLLKSLIKDADRVMADLGLNERQVIQKALSDAQSHVNCLSDLVGQRRKYLNKALSEKTQFLMAVFQATSQIQQHERKIMFREHICLLPDDVSKQVKTCKSAQASLKTYQNEVTGLWAQGRELMKEVTEQEKSEVLGKLQELQSVYDSVLQKCSHRLQELEKNLVSRKHFKEDFDKACHWLKQADIVTFPEINLMNESSELHTQLAKYQNILEQSPEYENLLLTLQRTGQTILPSLNEVDHSYLSEKLNALPRQFNVIVALAKDKFYKVQEAILARKEYASLIELTTQSLSELEAQFLRMSKVPTDLAVEEALSLQDGCRAILDEVAGLGEAVDELNQKKEGFRSTGQPWQPDKMLHLVTLYHRLKRQTEQRVSLLEDTTSAYQEHEKMCQQLERQLKSVKEEQSKVNEETLPAEEKLKMYHSLAGSLQDSGIVLKRVTIHLEDLAPHLDPLAYEKARHQIQSWQGELKLLTSAIGETVTECESRMVQSIDFQTEMSRSLDWLRRVKAELSGPVYLDLNLQDIQEEIRKIQIHQEEVQSSLRIMNALSHKEKEKFTKAKELISADLEHSLAELSELDGDIQEALRTRQATLTEIYSQCQRYYQVFQAANDWLEDAQELLQLAGNGLDVESAEENLKSHMEFFSTEDQFHSNLEELHSLVATLDPLIKPTGKEDLEQKVASLELRSQRMSRDSGAQVDLLQRCTAQWHDYQKAREEVIELMNDTEKKLSEFSLLKTSSSHEAEEKLSEHKALVSVVNSFHEKIVALEEKASQLEKTGNDASKATLSRSMTTVWQRWTRLRAVAQDQEKILEDAVDEWTGFNNKVKKATEMIDQLQDKLPGSSAEKASKAELLTLLEYHDTFVLELEQQQSALGMLRQQTLSMLQDGAAPTPGEEPPLMQEITAMQDRCLNMQEKVKTNGKLVKQELKDREMVETQINSVKCWVQETKEYLGNPTIEIDAQLEELQILLTEATNHRQNIEKMAEEQKEKYLGLYTILPSELSLQLAEVALDLKIRDQIQDKIKEVEQSKATSQELSRQIQKLAKDLTTILTKLKAKTDNVVQAKTDQKVLGEELDGCNSKLMELDAAVQKFLEQNGQLGKPLAKKIGKLTELHQQTIRQAENRLSKLNQAASHLEEYNEMLELILKWIEKAKVLAHGTIAWNSASQLREQYILHQTLLEESKEIDSELEAMTEKLQYLTSVYCTEKMSQQVAELGRETEELRQMIKIRLQNLQDAAKDMKKFEAELKKLQAALEQAQATLTSPEVGRLSLKEQLSHRQHLLSEMESLKPKVQAVQLCQSALRIPEDVVASLPLCHAALRLQEEASRLQHTAIQQCNIMQEAVVQYEQYEQEMKHLQQLIEGAHREIEDKPVATSNIQELQAQISRHEELAQKIKGYQEQIASLNSKCKMLTMKAKHATMLLTVTEVEGLAEGTEDLDGELLPTPSAHPSVVMMTAGRCHTLLSPVTEESGEEGTNSEISSPPACRSPSPVANTDASVNQDIAYYQALSAERLQTDAAKIHPSTSASQEFYEPGLEPSATAKLGDLQRSWETLKNVISEKQRTLYEALERQQKYQDSLQSISTKMEAIELKLSESPEPGRSPESQMAEHQALMDEILMLQDEINELQSSLAEELVSESCEADPAEQLALQSTLTVLAERMSTIRMKASGKRQLLEEKLNDQLEEQRQEQALQRYRCEADELDSWLLSTKATLDTALSPPKEPMDMEAQLMDCQNMLVEIEQKVVALSELSVHNENLLLEGKAHTKDEAEQLAGKLRRLKGSLLELQRALHDKQLNMQGTAQEKEESDVDLTATQSPGVQEWLAQARTTWTQQRQSSLQQQKELEQELAEQKSLLRSVASRGEEILIQHSAAETSGDAGEKPDVLSQELGMEGEKSSAEDQMRMKWESLHQEFSTKQKLLQNVLEQEQEQVLYSRPNRLLSGVPLYKGDVPTQDKSAVTSLLDGLNQAFEEVSSQSGGAKRQSIHLEQKLYDGVSATSTWLDDVEERLFVATALLPEETETCLFNQEILAKDIKEMSEEMDKNKNLFSQAFPENGDNRDVIEDTLGCLLGRLSLLDSVVNQRCHQMKERLQQILNFQNDLKVLFTSLADNKYIILQKLANVFEQPVAEQIEAIQQAEDGLKEFDAGIIELKRRGDKLQVEQPSMQELSKLQDMYDELMMIIGSRRSGLNQNLTLKSQYERALQDLADLLETGQEKMAGDQKIIVSSKEEIQQLLDKHKEYFQGLESHMILTETLFRKIISFAVQKETQFHTELMAQASAVLKRAHKRGVELEYILETWSHLDEDQQELSRQLEVVESSIPSVGLVEENEDRLIDRITLYQHLKSSLNEYQPKLYQVLDDGKRLLISISCSDLESQLNQLGECWLSNTNKMSKELHRLETILKHWTRYQSESADLIHWLQSAKDRLEFWTQQSVTVPQELEMVRDHLNAFLEFSKEVDAQSSLKSSVLSTGNQLLRLKKVDTATLRSELSRIDSQWTDLLTNIPAVQEKLHQLQMDKLPSRHAISEVMSWISLMENVIQKDEDNIKNSIGYKAIHEYLQKYKGFKIDINCKQLTVDFVNQSVLQISSQDVESKRSDKTDFAEQLGAMNKSWQILQGLVTEKIQLLEGLLESWSEYENNVQCLKTWFETQEKRLKQQHRIGDQASVQNALKDCQDLEDLIKAKEKEVEKIEQNGLALIQNKKEDVSSIVMSTLRELGQTWANLDHMVGQLKILLKSVLDQWSSHKVAFDKINSYLMEARYSLSRFRLLTGSLEAVQVQVDNLQNLQDDLEKQERSLQKFGSITNQLLKECHPPVTETLTNTLKEVNMRWNNLLEEIAEQLQSSKALLQLWQRYKDYSKQCASTVQQQEDRTNELLKAATNKDIADDEVATWIQDCNDLLKGLGTVKDSLFFLHELGEQLKQQVDASAASAIQSDQLSLSQHLCALEQALCKQQTSLQAGVLDYETFAKSLEALEAWIVEAEEILQGQDPSHSSDLSTIQERMEELKGQMLKFSSMAPDLDRLNELGYRLPLNDKEIKRMQNLNRHWSLISSQTTERFSKLQSFLLQHQTFLEKCETWMEFLVQTEQKLAVEISGNYQHLLEQQRAHELFQAEMFSRQQILHSIIIDGQRLLEQGQVDDRDEFNLKLTLLSNQWQGVIRRAQQRRGIIDSQIRQWQRYREMAEKLRKWLVEVSYLPMSGLGSVPIPLQQARTLFDEVQFKEKVFLRQQGSYILTVEAGKQLLLSADSGAEAALQAELAEIQEKWKSASMRLEEQKKKLAFLLKDWEKCEKGIADSLEKLRTFKKKLSQSLPDHHEELHAEQMRCKELENAVGSWTDDLTQLSLLKDTLSAYISADDISILNERVELLQRQWEELCHQLSLRRQQIGERLNEWAVFSEKNKELCEWLTQMESKVSQNGDILIEEMIEKLKKDYQEEIAIAQENKIQLQQMGERLAKASHESKASEIEYKLGKVNDRWQHLLDLIAARVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSGDHSALESQIRQLGKALDDSRFQIQQTENIIRSKTPTGPELDTSYKGYMKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKELQKAVDHRKAIILSINLCSPEFTQADSKESRDLQDRLSQMNGRWDRVCSLLEEWRGLLQDALMQCQGFHEMSHGLLLMLENIDRRKNEIVPIDSNLDAEILQDHHKQLMQIKHELLESQLRVASLQDMSCQLLVNAEGTDCLEAKEKVHVIGNRLKLLLKEVSRHIKELEKLLDVSSSQQDLSSWSSADELDTSGSVSPTSGRSTPNRQKTPRGKCSLSQPGPSVSSPHSRSTKGGSDSSLSEPGPGRSGRGFLFRVLRAALPLQLLLLLLIGLACLVPMSEEDYSCALSNNFARSFHPMLRYTNGPPPL

SEQ ID NO: 82860 - protein, 1355 aa, Homo sapiens
  Payload ID: 16494
  Gene Symbol: SYNE1
  Gene Name: spectrin repeat containing, nuclear envelope 1
  ENSP ID: ENSP00000356226
ETFAKSLEALEAWIVEAEEILQGQDPSHSSDLSTIQERMEELKGQMLKFSSMAPDLDRLNELGYRLPLNDKEIKRMQNLNRHWSLISSQTTERFSKLQSFLLQHQTFLEKCETWMEFLVQTEQKLAVEISGNYQHLLEQQRAHELFQAEMFSRQQILHSIIIDGQRLLEQGQVDDRDEFNLKLTLLSNQWQGVIRRAQQRRGIIDSQIRQWQRYREMAEKLRKWLVEVSYLPMSGLGSVPIPLQQARTLFDEVQFKEKVFLRQQGSYILTVEAGKQLLLSADSGAEAALQAELAEIQEKWKSASMRLEEQKKKLAFLLKDWEKCEKGIADSLEKLRTFKKKLSQSLPDHHEELHAEQMRCKELENAVGSWTDDLTQLSLLKDTLSAYISADDISILNERVELLQRQWEELCHQLSLRRQQIGERLNEWAVFSEKNKELCEWLTQMESKVSQNGDILIEEMIEKLKKDYQEEIAIAQENKIQLQQMGERLAKASHESKASEIEYKLGKVNDRWQHLLDLIAARVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSGDHSALESQIRQLGKALDDSRFQIQQTENIIRSKTPTGPELDTSYKGYMKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKELQKAVDHRKAIILSINLCSPEFTQADSKESRDLQDRLSQMNGRWDRVCSLLEEWRGLLQDALMQCQGFHEMSHGLLLMLENIDRRKNEIVPIDSNLDAEILQDHHKQLMQIKHELLESQLRVASLQDMSCQLLVNAEGTDCLEAKEKVHVIGNRLKLLLKEVSRHIKELEKLLDVSSSQQDLSSWSSADELDTSGSVSPTSGRSTPNRQKTVHKRWLRFLPF

SEQ ID NO: 82861 - protein, 510 aa, Homo sapiens
  Payload ID: 16494
  Gene Symbol: SYNE1
  Gene Name: spectrin repeat containing, nuclear envelope 1
  ENSP ID: ENSP00000390858
ELIDSREIGASRLSRVESLAPEVKQNTTASGCELMHTEMQALRADWKQWEDSVFQTQSCLENLVSQMALSEQEFSGQVAQLEQALEQFSALLKTWAQQLTLLEGKNTDEEIVECWHKGQEILDALQKAEPRTEDLKSQLNELCRFSRDLSTYSGKVSGLIKEYNCLCLQASKGCQNKEQILQQRFRKAFRDFQQWLVNAKITTAKCFDIPQNISEVSTSLQKIQEFLSESENGQHKLNMMLSKGELLSTLLTKEKAKGIQAKVTAAKEDWKNFHSNLHQKESALENLKIQMKDFEVSAEPIQDWLSKTEKMVHESSNRLYDLPAKRREQQKLQSVLEEIHCYEPQLNRLKEKAQQLWEGQAASKSFRHRVSQLSSQYLALSNLTKEKVSRLDRIVAEHNQFSLGIKELQDWMTDAIHMLDSYCHPTSDKSVLDSRTLKLEVCIFTQKYLQPTEFVFLKISRLHPPGVMMSHSLHDKSQMLCECNAVCLGCTCQRIPESSDPGCFPKNKIK

SEQ ID NO: 82862 - protein, 380 aa, Homo sapiens
  Payload ID: 16494
  Gene Symbol: SYNE1
  Gene Name: spectrin repeat containing, nuclear envelope 1
  ENSP ID: ENSP00000390975
MQEKVKTNGKLVKQELKDREMVETQINSVKCWVQETKEYLGNPTIEIDAQLEELQILLTEATNHRQNIEKMAEEQKEKYLGLYTILPSELSLQLAEVALDLKIRDQTLEDLLGRMTWQVHGLFIFLRQSLALSPRLECSETISAYCNLLGLSSSRASASQVAGIPGMHHHTRLIFCIFSKKRQGFAMLASLVSNSWPQVSCLPQPPKVLGLQIQDKIKEVEQSKATSQELSRQIQKLAKDLTTILTKLKAKTDNVVQAKTDQKVLGEELDGCNSKLMELDAAVQKFLEQNGQLGKPLAKKIGKLTELHQQTIRQAENRLSKLNQAASHLEEYNEMLELILKWIEKAKVLAHGTIAWNSASQLREQYILHQVTLGKIIFKK

SEQ ID NO: 82863 - protein, 8749 aa, Homo sapiens
  Payload ID: 16494
  Gene Symbol: SYNE1
  Gene Name: spectrin repeat containing, nuclear envelope 1
  ENSP ID: ENSP00000396024
MATSRGASRCPRDIANVMQRLQDEQEIVQKRTFTKWINSHLAKRKPPMVVDDLFEDMKDGVKLLALLEVLSGQKLPCEQGRRMKRIHAVANIGTALKFLEGRKSMHRGSPIKLVNINSTDIADGRPSIVLGLMWTIILYFQIEELTSNLPQLQSLSSSASSVDSIVSSETPSPPSKRKVTTKIQGNAKKALLKWVQYTAGKQTGIEVKDFGKSWRSGVAFHSVIHAIRPELVDLETVKGRSNRENLEDAFTIAETELGIPRLLDPEDVDVDKPDEKSIMTYVAQFLKHYPDIHNASTDGQEDDEILPGFPSFANSVQNFKREDRVIFKEMKVWIEQFERDLTRAQMVESNLQDKYQSFKHFRVQYEMKRKQIEHLIQPLHRDGKLSLDQALVKQSWDRVTSRLFDWHIQLDKSLPAPLGTIGAWLYRAEVALREEITVQQVHEETANTIQRKLEQHKDLLQNTDAHKRAFHEIYRTRSVNGIPVPPDQLEDMAERFHFVSSTSELHLMKMEFLELKYRLLSLLVLAESKLKSWIIKYGRRESVEQLLQNYVSFIENSKFFEQYEVTYQILKQTAEMYVKADGSVEEAENVMKFMNETTAQWRNLSVEVRSVRSMLEEVISNWDRYGNTVASLQAWLEDAEKMLNQSENAKKDFFRNLPHWIQQHTAMNDAGNFLIETCDEMVSRDLKQQLLLLNGRWRELFMEVKQYAQADEMDRMKKEYTDCVVTLSAFATEAHKKLSEPLEVSFMNVKLLIQDLEDIEQRVPVMDAQYKIITKTAHLITKESPQEEGKEMFATMSKLKEQLTKVKECYSPLLYESQQLLIPLEELEKQMTSFYDSLGKINEIITVLEREAQSSALFKQKHQELLACQENCKKTLTLIEKGSQSVQKFVTLSNVLKHFDQTRLQRQIADIHVAFQSMVKKTGDWKKHVETNSRLMKKFEESRAELEKVLRIAQEGLEEKGDPEELLRRHTEFFSQLDQRVLNAFLKACDELTDILPEQEQQGLQEAVRKLHKQWKDLQGEAPYHLLHLKIDVEKNRFLASVEECRTELDRETKLMPQEGSEKIIKEHRVFFSDKGPHHLCEKRLQLIEELCVKLPVRDPVRDTPGTCHVTLKELRAAIDSTYRKLMEDPDKWKDYTSRFSEFSSWISTNETQLKGIKGEAIDTANHGEVKRAVEEIRNGVTKRGETLSWLKSRLKVLTEVSSENEAQKQGDELAKLSSSFKALVTLLSEVEKMLSNFGDCVQYKEIVKNSLEELISGSKEVQEQAEKILDTENLFEAQQLLLHHQQKTKRISAKKRDVQQQIAQAQQGEGGLPDRGHEELRKLESTLDGLERSRERQERRIQVTLRKWERFETNKETVVRYLFQTGSSHERFLSFSSLESLSSELEQTKEFSKRTESIAVQAENLVKEASEIPLGPQNKQLLQQQAKSIKEQVKKLEDTLEEDIKTMEMVKTKWDHFGSNFETLSVWITEKEKELNALETSSSAMDMQISQIKVTIQEIESKLSSIVGLEEEAQSFAQFVTTGESARIKAKLTQIRRYGEELREHAQCLEGTILGHLSQQQKFEENLRKIQQSVSEFEDKLAVPIKICSSATETYKVLQEHMDLCQALESLSSAITAFSASARKVVNRDSCVQEAAALQQQYEDILRRAKERQTALENLLAHWQRLEKELSSFLTWLERGEAKASSPEMDISADRVKVEGELQLIQALQNEVVSQASFYSKLLQLKESLFSVASKDDVKMMKLHLEQLDERWRDLPQIINKRINFLQSVVAEHQQFDELLLSFSVWIKLFLSELQTTSEISIMDHQVALTRHKDHAAEVESKKGELQSLQGHLAKLGSLGRAEDLHLLQGKAEDCFQLFEEASQVVERRQLALSHLAEFLQSHASLSGILRQLRQTVEATNSMNKNESDLIEKDLNDALQNAKALESAAVSLDGILSKAQYHLKIGSSEQRTSCRATADQLCGEVERIQNLLGTKQSEADALAVLKKAFQDQKEELLKSIEDIEERTDKERLKEPTRQALQQRLRVFNQLEDELNSHEHELCWLKDKAKQIAQKDVAFAPEVDREINRLEVTWDDTKRLIHENQGQCCGLIDLMREYQNLKSAVSKVLENASSVIVTRTTIKDQEDLKWAFSKHETAKNKMNYKQKDLDNFTSKGKHLLSELKKIHSSDFSLVKTDMESTVDKWLDVSEKLEENMDRLRVSLSIWDDVLSTRDEIEGWSNNCVPQMAENISNLDNHLRAEELLKEFESEVKNKALRLEELHSKVNDLKELTKNLETPPDLQFIEADLMQKLEHAKEITEVAKGTLKDFTAQSTQVEKFINDITTWFTKVEESLMNCAQNETCEALKKVKDIQKELQSQQSNISSTQENLNSLCRKYHSAELESLGRAMTGLIKKHEAVSQLCSKTQASLQESLEKHFSESMQEFQEWFLGAKAAAKESSDRTGDSKVLEAKLHDLQNILDSVSDGQSKLDAVTQEGQTLYAHLSKQIVSSIQEQITKANEEFQAFLKQCLKDKQALQDCASELGSFEDQHRKLNLWIHEMEERFNTENLGESKQHIPEKKNEVHKVEMFLGELLAARESLDKLSQRGQLLSEEGHGAGQEGRLCSQLLTSHQNLLRMTKEKLRSCQVALQEHEALEEALQSMWFWVKAIQDRLACAESTLGSKDTLEKRLSQIQDILLMKGEGEVKLNMAIGKGEQALRSSNKEGQRVIQTQLETLKEVWADIMSSSVHAQSTLESVISQWNDYVERKNQLEQWMESVDQKIEHPLQPQPGLKEKFVLLDHLQSILSEAEDHTRALHRLIAKSRELYEKTEDESFKDTAQEELKTQFNDIMTVAKEKMRKVEEIVKDHLMYLDAVHEFTDWLHSAKEELHRWSDMSGDSSATQKKLSKIKELIDSREIGASRLSRVESLAPEVKQNTTASGCELMHTEMQALRADWKQWEDSVFQTQSCLENLVSQMALSEQEFSGQVAQLEQALEQFSALLKTWAQQLTLLEGKNTDEEIVECWHKGQEILDALQKAEPRTEDLKSQLNELCRFSRDLSTYSGKVSGLIKEYNCLCLQASKGCQNKEQILQQRFRKAFRDFQQWLVNAKITTAKCFDIPQNISEVSTSLQKIQEFLSESENGQHKLNMMLSKGELLSTLLTKEKAKGIQAKVTAAKEDWKNFHSNLHQKESALENLKIQMKDFEVSAEPIQDWLSKTEKMVHESSNRLYDLPAKRREQQKLQSVLEEIHCYEPQLNRLKEKAQQLWEGQAASKSFRHRVSQLSSQYLALSNLTKEKVSRLDRIVAEHNQFSLGIKELQDWMTDAIHMLDSYCHPTSDKSVLDSRTLKLEALLSVKQEKEIQMKMIVTRGESVLQNTSPEGIPTIQQQLQSVKDMWASLLSAGIRCKSQLEGALSKWTSYQDGVRQFSGWMDSMEANLNESERQHAELRDKTTMLGKAKLLNEEVLSYSSLLETIEVKGAGMTEHYVTQLELQDLQERYRAIQERAKEAVTKSEKLVRLHQEYQRDLKAFEVWLGQEQEKLDQYSVLEGDAHTHETTLRDLQELQVHCAEGQALLNSVLHTREDVIPSGIPQAEDRALESLRQDWQAYQHRLSETRTQFNNVVNKLRLMEQKFQQVDEWLKTAEEKKWHEEVTAYRDEVEEVGARAQEILDESHVNSRMGCQATQLTSRYQALLLQVLEQIKFLEEEIQSLEESESSLSSYSDWYGSTHKNFKNVATKIDKVDTVMMGKKLKTLEVLLKDMEKGHSLLKSAREKGERAVKYLEEGEAERLRKEIHDHMEQLKELTSTVRKEHMTLEKGLHLAKEFSDKCKALTQWIAEYQEILHVPEEPKMELYEKKAQLSKYKSLQQTVLSHEPSVKSVREKGEALLELVQDVTLKDKIDQLQSDYQDLCSIGKAMMEEIAGFEDRLNNLQMKGDTLIGQCADHLQAKLKQNVHAHLQGTKDSYSAICSTAQRMYQSLEHELQKHVSRQDTLQQCQAWLSAVQPDLEPSPQPPLSRAEAIKQVKHFRALQEQARTYLDLLCSMCDLSNASVKTTAKDIQQTEQTIEQKLVQAQNLTQGWEEIKHLKSELWIYLQDADQQLQNMKRRHSELELNIAQNMVSQVKDFVKKLQSKQASVNTIIEKVNKLTKKEESPEHKEINHLNDQWLDLCRQSNNLCLQREEDLQRTRDYHDCMNVVEVFLEKFTTEWDNLARSDAESTAVHLEALKKLALALQERKYAIEDLKDQKQKMIEHLNLDDKELVKEQTSHLEQRWFQLEDLIKRKIQVSVTNLEELNVVQSRFQELMEWAEEQQPNIAEALKQSPPPDMAQNLLMDHLAICSELEAKQMLLKSLIKDADRVMADLGLNERQVIQKALSDAQSHVNCLSDLVGQRRKYLNKALSEKTQFLMAVFQATSQIQQHERKIMFREHICLLPDDVSKQVKTCKSAQASLKTYQNEVTGLWAQGRELMKEVTEQEKSEVLGKLQELQSVYDSVLQKCSHRLQELEKNLVSRKHFKEDFDKACHWLKQADIVTFPEINLMNESSELHTQLAKYQNILEQSPEYENLLLTLQRTGQTILPSLNEVDHSYLSEKLNALPRQFNVIVALAKDKFYKVQEAILARKEYASLIELTTQSLSELEAQFLRMSKVPTDLAVEEALSLQDGCRAILDEVAGLGEAVDELNQKKEGFRSTGQPWQPDKMLHLVTLYHRLKRQTEQRVSLLEDTTSAYQEHEKMCQQLERQLKSVKEEQSKVNEETLPAEEKLKMYHSLAGSLQDSGIVLKRVTIHLEDLAPHLDPLAYEKARHQIQSWQGELKLLTSAIGETVTECESRMVQSIDFQTEMSRSLDWLRRVKAELSGPVYLDLNLQDIQEEIRKIQIHQEEVQSSLRIMNALSHKEKEKFTKAKELISADLEHSLAELSELDGDIQEALRTRQATLTEIYSQCQRYYQVFQAANDWLEDAQELLQLAGNGLDVESAEENLKSHMEFFSTEDQFHSNLEELHSLVATLDPLIKPTGKEDLEQKVASLELRSQRMSRDSGAQVDLLQRCTAQWHDYQKAREEVIELMNDTEKKLSEFSLLKTSSSHEAEEKLSEHKALVSVVNSFHEKIVALEEKASQLEKTGNDASKATLSRSMTTVWQRWTRLRAVAQDQEKILEDAVDEWTGFNNKVKKATEMIDQLQDKLPGSSAEKASKAELLTLLEYHDTFVLELEQQQSALGMLRQQTLSMLQDGAAPTPGEEPPLMQEITAMQDRCLNMQEKVKTNGKLVKQELKDREMVETQINSVKCWVQETKEYLGNPTIEIDAQLEELQILLTEATNHRQNIEKMAEEQKEKYLGLYTILPSELSLQLAEVALDLKIRDQIQDKIKEVEQSKATSQELSRQIQKLAKDLTTILTKLKAKTDNVVQAKTDQKVLGEELDGCNSKLMELDAAVQKFLEQNGQLGKPLAKKIGKLTELHQQTIRQAENRLSKLNQAASHLEEYNEMLELILKWIEKAKVLAHGTIAWNSASQLREQYILHQTLLEESKEIDSELEAMTEKLQYLTSVYCTEKMSQQVAELGRETEELRQMIKIRLQNLQDAAKDMKKFEAELKKLQAALEQAQATLTSPEVGRLSLKEQLSHRQHLLSEMESLKPKVQAVQLCQSALRIPEDVVASLPLCHAALRLQEEASRLQHTAIQQCNIMQAAVVQYEQYEQEMKHLQQLIEGAHREIEDKPVATSNIQELQAQISRHEELAQKIKGYQEQIASLNSKCKMLTMKAKHATMLLTVTEVEGLAEGTEDLDGELLPTPSAHPSVVMMTAGRCHTLLSPVTEESGEEGTNSEISSPPACRSPSPVANTDASVNQDIAYYQALSAERLQTDAAKIHPSTSASQEFYEPGLEPSATAKLGDLQRSWETLKNVISEKQRTLYEALERQQKYQDSLQSISTKMEAIELKLSESPEPGRSPESQMAEHQALMDEILMLQDEINELQSSLAEELVSESCEADPAEQLALQSTLTVLAERMSTIRMKASGKRQLLEEKLNDQLEEQRQEQALQRYRCEADELDSWLLSTKATLDTALSPPKEPMDMEAQLMDCQNMLVEIEQKVVALSELSVHNENLLLEGKAHTKDEAEQLAGKLRRLKGSLLELQRALHDKQLNMQGTAQEKEESDVDLTATQSPGVQEWLAQARTTWTQQRQSSLQQQKELEQELAEQKSLLRSVASRGEEILIQHSAAETSGDAGEKPDVLSQELGMEGEKSSAEDQMRMKWESLHQEFSTKQKLLQNVLEQEQEQVLYSRPNRLLSGVPLYKGDVPTQDKSAVTSLLDGLNQAFEEVSSQSGGAKRQSIHLEQKLYDGVSATSTWLDDVEERLFVATALLPEETETCLFNQEILAKDIKEMSEEMDKNKNLFSQAFPENGDNRDVIEDTLGCLLGRLSLLDSVVNQRCHQMKERLQQILNFQNDLKVLFTSLADNKYIILQKLANVFEQPVAEQIEAIQQAEDGLKEFDAGIIELKRRGDKLQVEQPSMQELSKLQDMYDELMMIIGSRRSGLNQNLTLKSQYERALQDLADLLETGQEKMAGDQKIIVSSKEEIQQLLDKHKEYFQGLESHMILTETLFRKIISFAVQKETQFHTELMAQASAVLKRAHKRGVELEYILETWSHLDEDQQELSRQLEVVESSIPSVGLVEENEDRLIDRITLYQHLKSSLNEYQPKLYQVLDDGKRLLISISCSDLESQLNQLGECWLSNTNKMSKELHRLETILKHWTRYQSESADLIHWLQSAKDRLEFWTQQSVTVPQELEMVRDHLNAFLEFSKEVDAQSSLKSSVLSTGNQLLRLKKVDTATLRSELSRIDSQWTDLLTNIPAVQEKLHQLQMDKLPSRHAISEVMSWISLMENVIQKDEDNIKNSIGYKAIHEYLQKYKGFKIDINCKQLTVDFVNQSVLQISSQDVESKRSDKTDFAEQLGAMNKSWQILQGLVTEKIQLLEGLLESWSEYENNVQCLKTWFETQEKRLKQQHRIGDQASVQNALKDCQDLEDLIKAKEKEVEKIEQNGLALIQNKKEDVSSIVMSTLRELGQTWANLDHMVGQLKILLKSVLDQWSSHKVAFDKINSYLMEARYSLSRFRLLTGSLEAVQVQVDNLQNLQDDLEKQERSLQKFGSITNQLLKECHPPVTETLTNTLKEVNMRWNNLLEEIAEQLQSSKALLQLWQRYKDYSKQCASTVQQQEDRTNELLKAATNKDIADDEVATWIQDCNDLLKGLGTVKDSLFFLHELGEQLKQQVDASAASAIQSDQLSLSQHLCALEQALCKQQTSLQAGVLDYETFAKSLEALEAWIVEAEEILQGQDPSHSSDLSTIQERMEELKGQMLKFSSMAPDLDRLNELGYRLPLNDKEIKRMQNLNRHWSLISSQTTERFSKLQSFLLQHQTFLEKCETWMEFLVQTEQKLAVEISGNYQHLLEQQRAHELFQAEMFSRQQILHSIIIDGQRLLEQGQVDDRDEFNLKLTLLSNQWQGVIRRAQQRRGIIDSQIRQWQRYREMAEKLRKWLVEVSYLPMSGLGSVPIPLQQARTLFDEVQFKEKVFLRQQGSYILTVEAGKQLLLSADSGAEAALQAELAEIQEKWKSASMRLEEQKKKLAFLLKDWEKCEKGIADSLEKLRTFKKKLSQSLPDHHEELHAEQMRCKELENAVGSWTDDLTQLSLLKDTLSAYISADDISILNERVELLQRQWEELCHQLSLRRQQIGERLNEWAVFSEKNKELCEWLTQMESKVSQNGDILIEEMIEKLKKDYQEEIAIAQENKIQLQQMGERLAKASHESKASEIEYKLGKVNDRWQHLLDLIAARVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSDVMIPESPEAYVKLTENAIKNTSGDHSALESQIRQLGKALDDSRFQIQQTENIIRSKTPTGPELDTSYKGYMKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKELQKAVDHRKAIILSINLCSPEFTQADSKESRDLQDRLSQMNGRWDRVCSLLEEWRGLLQDALMQCQGFHEMSHGLLLMLENIDRRKNEIVPIDSNLDAEILQDHHKQLMQIKHELLESQLRVASLQDMSCQLLVNAEGTDCLEAKEKVHVIGNRLKLLLKEVSRHIKELEKLLDVSSSQQDLSSWSSADELDTSGSVSPTSGRSTPNRQKTPRGKCSLSQPGPSVSSPHSRSTKGGSDSSLSEPGPGRSGRGFLFRVLRAALPLQLLLLLLIGLACLVPMSEEDYSCALSNNFARSFHPMLRYTNGPPPL

SEQ ID NO: 82864 - protein, 1443 aa, Homo sapiens
  Payload ID: 16494
  Gene Symbol: SYNE1
  Gene Name: spectrin repeat containing, nuclear envelope 1
  Uniprot ID: Q8NF91
  ENSP ID: ENSP00000414510
MATSRGASRCPRDIANVMQRLQDEQEIVQKRTFTKWINSHLAKRKPPMVVDDLFEDMKDGVKLLALLEVLSGQKLPCEQGRRMKRIHAVANIGTALKFLEGRKIKLVNINSTDIADGRPSIVLGLMWTIILYFQIEELTSNLPQLQSLSSSASSVDSIVSSETPSPPSKRKVTTKIQGNAKKALLKWVQYTAGKQTGIEVKDFGKSWRSGVAFHSVIHAIRPELVDLETVKGRSNRENLEDAFTIAETELGIPRLLDPEDVDVDKPDEKSIMTYVAQFLKHYPDIHNASTDGQEDDEILPGFPSFANSVQNFKREDRVIFKEMKVWIEQFERDLTRAQMVESNLQDKYQSFKHFRVQYEMKRKQIEHLIQPLHRDGKLSLDQALVKQSWDRVTSRLFDWHIQLDKSLPAPLGTIGAWLYRAEVALREEITVQQVHEETANTIQRKLEQHKDLLQNTDAHKRAFHEIYRTRSVNGIPVPPDQLEDMAERFHFVSSTSELHLMKMEFLELKYRLLSLLVLAESKLKSWIIKYGRRESVEQLLQNYVSFIENSKFFEQYEVTYQILKQTAEMYVKADGSVEEAENVMKFMNETTAQWRNLSVEVRSVRSMLEEVISNWDRYGNTVASLQAWLEDAEKMLNQSENAKKDFFRNLPHWIQQHTAMNDAGNFLIETCDEMVSRDLKQQLLLLNGRWRELFMEVKQYAQADEMDRMKKEYTDCVVTLSAFATEAHKKLSEPLEVSFMNVKLLIQDLEDIEQRVPVMDAQYKIITKTAHLITKESPQEEGKEMFATMSKLKEQLTKVKECYSPLLYESQQLLIPLEELEKQMTSFYDSLGKINEIITVLEREAQSSALFKQKHQELLACQENCKKTLTLIEKGSQSVQKFVTLSNVLKHFDQTRLQRQIADIHVAFQSMVKKTGDWKKHVETNSRLMKKFEESRAELEKVLRIAQEGLEEKGDPEELLRRHTEFFSQLDQRVLNAFLKACDELTDILPEQEQQGLQEAVRKLHKQWKDLQGEAPYHLLHLKIDVEKNRFLASVEECRTELDRETKLMPQEGSEKIIKEHRVFFSDKGPHHLCEKRLQLIEELCVKLPVRDPVRDTPGTCHVTLKELRAAIDSTYRKLMEDPDKWKDYTSRFSEFSSWISTNETQLKGIKGEAIDTANHGEVKRAVEEIRNGVTKRGETLSWLKSRLKVLTEVSSENEAQKQGDELAKLSSSFKALVTLLSEVEKMLSNFGDCVQYKEIVKNSLEELISGSKEVQEQAEKILDTENLFEAQQLLLHHQQKTKRISAKKRDVQQQIAQAQQGEGGLPDRGHEELRKLESTLDGLERSRERQERRIQVTLRKWERFETNKETVVRYLFQTGSSHERFLSFSSLESLSSELEQTKEFSKRTESIAVQAENLVKEASEIPLGPQNKQLLQQQAKSIKEQVKKLEDTLEEEYVIDKS

SEQ ID NO: 82865 - protein, 242 aa, Homo sapiens
  Payload ID: 16494
  Gene Symbol: SYNE1
  Gene Name: spectrin repeat containing, nuclear envelope 1
  ENSP ID: ENSP00000437411
MFPQELAQKIKGYQEQIASLNSKCKMLTMKAKHATMLLTVTEVEGLAEGTEDLDGELLPTPSAHPSVVMDIAYYQALSAERLQTDAAKIHPSTSASQEFYEPGLEPSATAKLGDLQRSWETLKNVISEKQRTLYEALERQQKYQDSLQSISTKMEAIELKLSESPEPGRSPESQMAEHQALMDEILMLQDEINELQSSLAEELVSESCEADPAEQLALQSTLTVLAERMSTIRMKASGKRQL

SEQ ID NO: 82866 - protein, 612 aa, Homo sapiens
  Payload ID: 16494
  Gene Symbol: SYNE1
  Gene Name: spectrin repeat containing, nuclear envelope 1
  ENSP ID: ENSP00000438508
MQFQHSVLSTSTQLLFKDLLQNTDAHKRAFHEIYRTRSVNGIPVPPDQLEDMAERFHFVSSTSELHLMKMEFLELKYRLLSLLVLAESKLKSWIIKYGRRESVEQLLQNYVSFIENSKFFEQYEVTYQILKQTAEMYVKADGSVEEAENVMKFMNETTAQWRNLSVEVRSVRSMLEEVISNWDRYGNTVASLQAWLEDAEKMLNQSENAKKDFFRNLPHWIQQHTAMNDAGNFLIETCDEMVSRDLKQQLLLLNGRWRELFMEVKQYAQADEMDRMKKEYTDCVVTLSAFATEAHKKLSEPLEVSFMNVKLLIQDLEDIEQRVPVMDAQYKIITKTAHLITKESPQEEGKEMFATMSKLKEQLTKVKECYSPLLYESQQLLIPLEELEKQMTSFYDSLGKINEIITVLEREAQSSALFKQKHQELLACQENCKKTLTLIEKGSQSVQKFVTLSNVLKHFDQTRLQRQIADIHVAFQSMVKKTGDWKKHVETNSRLMKKFEESRAELEKVLRIAQEGLEEKGDPEELLRRHTEFFSQLDQRVLNAFLKACDELTDILPEQEQQGLQEAVRKLHKQWKVSQDRTETPCILNEGRSLSVLRSKCKRNLEIPGKSL

SEQ ID NO: 82867 - protein, 62 aa, Homo sapiens
  Payload ID: 16494
  Gene Symbol: SYNE1
  Gene Name: spectrin repeat containing, nuclear envelope 1
  ENSP ID: ENSP00000440193
  MOD_RES (1)..(1): Any amino acid
XFQHSVLSTSTQLLFKDLLQNTDAHKRAFHEIYRTRSVNGIPVPPDQLEDMAERVKAEVLDH

SEQ ID NO: 82868 - protein, 952 aa, Homo sapiens
  Payload ID: 16494
  Gene Symbol: SYNE1
  Gene Name: spectrin repeat containing, nuclear envelope 1
  ENSP ID: ENSP00000441052
MVVAEDLSALRMAEDSCVDADLPDCNCDVTRVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSGDHSALESQIRQLGKALDDSRFQIQQTENIIRSKTPTGPELDTSYKGYMKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKELQKAVDHRKAIILSINLCSPEFTQADSKESRDLQDRLSQMNGRWDRVCSLLEEWRGLLQDALMQCQGFHEMSHGLLLMLENIDRRKNEIVPIDSNLDAEILQDHHKQLMQIKHELLESQLRVASLQDMSCQLLVNAEGTDCLEAKEKVHVIGNRLKLLLKEVSRHIKELEKLLDVSSSQQDLSSWSSADELDTSGSVSPTSGRSTPNRQKTPRGKCSLSQPGPSVSSPHSRSTKGGSDSSLSEPGPGRSGRGFLFRVLRAALPLQLLLLLLIGLACLVPMSEEDYSCALSNNFARSFHPMLRYTNGPPPL

SEQ ID NO: 82869 - protein, 615 aa, Homo sapiens
  Payload ID: 16494
  Gene Symbol: SYNE1
  Gene Name: spectrin repeat containing, nuclear envelope 1
  ENSP ID: ENSP00000441264
MATSRGASRCPRDIANVMQRLQDEQEIVQKRTFTKWINSHLAKRKPPMVVDDLFEDMKDGVKLLALLEVLSGQKLPCEQGRRMKRIHAVANIGTALKFLEGRKIKLVNINSTDIADGRPSIVLGLMWTIILYFQIEELTSNLPQLQSLSSSASSVDSIVSSETPSPPSKRKVTTKIQGNAKKALLKWVQYTAGKQTGIEVKDFGKSWRSGVAFHSVIHAIRPELVDLETVKGRSNRENLEDAFTIAETELGIPRLLDPEDVDVDKPDEKSIMTYVAQFLKHYPDIHNASTDGQEDDREDRVIFKEMKVWIEQFERDLTRAQMVESNLQDKYQSFKHFRVQYEMKRKQIEHLIQPLHRDGKLSLDQALVKQSWDRVTSRLFDWHIQLDKSLPAPLGTIGAWLYRAEVALREEITVQQVHEETANTIQRKLEQHKDLLQNTDAHKRAFHEIYRTRSVNGIPVPPDQLEDMAERFHFVSSTSELHLMKMEFLELKYRLLSLLVLAESKLKSWIIKYGRRESVEQLLQNYVSFIENSKFFEQYEVTYQILKQTAEMYVKADGSVEEAENVMKFMNETTAQWRNLSVEVRSVRSMLEEVISNWDRYGNTVASLQAWLEDA

SEQ ID NO: 82870 - protein, 207 aa, Homo sapiens
  Payload ID: 16494
  Gene Symbol: SYNE1
  Gene Name: spectrin repeat containing, nuclear envelope 1
  ENSP ID: ENSP00000442805
  MOD_RES (1)..(1): Any amino acid
XKEKAKGIQAKVTAAKEDWKNFHSNLHQKESALENLKIQMKDFEVSAEPIQDWLSKTEKMVHESSNRLYDLPAKRREQQKLQEKVSRLDRIVAEHNQFSLGIKELQDWMTDAIHMLDSYCHPTSDKSVLDSRTLKLEVCIFTQKYLQPTEFVFLKISRLHPPGVMMSHSLHDKSQMLCECNAVCLGCTCQRIPESSDPGCFPKNKIK

SEQ ID NO: 82871 - protein, 195 aa, Homo sapiens
  Payload ID: 16494
  Gene Symbol: SYNE1
  Gene Name: spectrin repeat containing, nuclear envelope 1
  ENSP ID: ENSP00000443879
MFPQELAQKIKGYQEQIASLNSKCKMLTMKAKHATMLLTVTEVEGLAEGTEDLDGELLPTPSAHPSVVMMTAGRCHTLLSPVTEESGEEGTNSEISSPPACRSPSPVANTDASVNQDIAYYQALSAERLQTDAAKIHPSTSASQEFYEPGLEPSATAKLGDLQRSWETLKNVISEKQRTLYEALERQQKYQDSLQ

SEQ ID NO: 82872 - protein, 754 aa, Homo sapiens
  Payload ID: 16494
  Gene Symbol: SYNE1
  Gene Name: spectrin repeat containing, nuclear envelope 1
  ENSP ID: ENSP00000446021
MATSRGASRCPRDIANVMQRLQDEQEIVQKRTFTKWINSHLAKRKPPMVVDDLFEDMKDGVKLLALLEVLSGQKLPCEQGRRMKRIHAVANIGTALKFLEGRKIKLVNINSTDIADGRPSIVLGLMWTIILYFQIEELTSNLPQLQSLSSSASSVDSIVSSETPSPPSKRKVTTKIQGNAKKALLKWVQYTAGKQTGIEVKDFGKSWRSGVAFHSVIHAIRPELVDLETVKGRSNRENLEDAFTIAETELGIPRLLDPEDVDVDKPDEKSIMTYVAQFLKHYPDIHNASTDGQEDDEILPGFPSFANSVQNFKREDRVIFKEMKVWIEQFERDLTRAQMVESNLQDKYQSFKHFRVQYEMKRKQIEHLIQPLHRDGKLSLDQALVKQSWDRVTSRLFDWHIQLDKSLPAPLGTIGAWLYRAEVALREEITVQQVHEETANTIQRKLEQHKDLLQNTDAHKRAFHEIYRTRSVNGIPVPPDQLEDMAERFHFVSSTSELHLMKMEFLELKYRLLSLLVLAESKLKSWIIKYGRRESVEQLLQNYVSFIENSKFFEQYEVTYQILKQTAEMYVKADGSVEEAENVMKFMNETTAQWRNLSVEVRSVRSMLEEVISNWDRYGNTVASLQAWLEDAEKMLNQSENAKKDFFRNLPHWIQQHTAMNDAGNFLIETCDEMVSRDLKQQLLLLNGRWRELFMEVKQYAQADEMDRMKKEYTDCVVTLSAFATEAHKKLSEPLEVSFMNVKLLIQDLEVRGF

SEQ ID NO: 82873 - protein, 477 aa, Homo sapiens
  Payload ID: 16494
  Gene Symbol: SYNE1
  Gene Name: spectrin repeat containing, nuclear envelope 1
  ENSP ID: ENSP00000481873
MQRLQDEQEIVQKRTFTKWINSHLAKRKPPMVVDDLFEDMKDGVKLLALLEVLSGQKLPCEQGRRMKRIHAVANIGTALKFLEGRKSMHRGSPIKLVNINSTDIADGRPSIVLGLMWTIILYFQIEELTSNLPQLQSLSSSASSVDSIVSSETPSPPSKRKVTTKIQGNAKKALLKWVQYTAGKQTGIEVKDFGKSWRSGVAFHSVIHAIRPELVDLETVKGRSNRENLEDAFTIAETELGIPRLLDPEDVDVDKPDEKSIMTYVAQFLKHYPDIHNASTDGQEDDEILPGFPSFANSVQNFKREDRVIFKEMKVWIEQFERDLTRAQMVESNLQDKYQSFKHFRVQYEMKRKQIEHLIQPLHRDGKLSLDQALVKQSWDRVTSRLFDWHIQLDKSLPAPLGTIGAWLYRAEVALREEITVQQVHEETANTIQRKLEQHKKIEAIRKELPPAPTATSTHLRNCICARIHALHFCYYG

SEQ ID NO: 82874 - protein, 6885 aa, Homo sapiens
  Payload ID: 16495
  Gene Symbol: SYNE2
  Gene Name: spectrin repeat containing, nuclear envelope 2
  Uniprot ID: Q8WXH0
  ENSP ID: ENSP00000341781
MASSPELPTEDEQGSWGIDDLHISLQAEQEDTQKKAFTCWINSQLARHTSPSVISDLFTDIKKGHVLLDLLEVLSGQQLPRDKGSNTFQCRINIEHALTFLRNRSIKLINIHVTDIIDGNPSIILGLIWTIILHFHIEKLAQTLSCNYNQPSLDDVSVVDSSPASSPPAKKCSKVQARWQMSARKALLLWAQEQCATYESVNVTDFKSSWRNGMAFLAIIHALRPDLIDMKSVKHRSNKDNLREAFRIAEQELKIPRLLEPEDVDVVDPDEKSIMTYVAQFLQYSKDAPGTGEEAQGKVKDAMGWLTLQKEKLQKLLKDSENDTYFKKYNSLLSFMESFNEEKKSFLDVLSIKRDLDELDKDHLQLREAWDGLDHQINAWKIKLNYALPPPLHQTEAWLQEVEELMDEDLSASQDHSQAVTLIQEKMTLFKSLMDRFEHHSNILLTFENKDENHLPLVPPNKLEEMKRRINNILEKKFILLLEFHYYKCLVLGLVDEVKSKLDIWNIKYGSRESVELLLEDWHKFIEEKEFLARLDTSFQKCGEIYKNLAGECQNINKQYMMVKSDVCMYRKNIYNVKSTLQKVLACWATYVENLRLLRACFEETKKEEIKEVPFETLAQWNLEHATLNEAGNFLVEVSNDVVGSSISKELRRLNKRWRKLVSKTQLEMNLPLMIKKQDQPTFDNSGNILSKEEKATVEFSTDMSVELPENYNQNIKAGEKHEKENEEFTGQLKVAKDVEKLIGQVEIWEAEAKSVLDQDDVDTSMEESLKHLIAKGSMFDELMARSEDMLQMDIQNISSQESFQHVLTTGLQAKIQEAKEKVQINVVKLIAALKNLTDVSPDLDIRLKMEESQKELESYMMRAQQLLGQRESPGELISKHKEALIISNTKSLAKYLKAVEELKNNVTEDIKMSLEEKSRDVCAKWESLHHELSLYVQQLKIDIEKGKLSDNILKLEKQINKEKKLIRRGRTKGLIKEHEACFSEEGCLYQLNHHMEVLRELCEELPSQKSQQEVKRLLKDYEQKIERLLKCASEIHMTLQPTAGGTSKNEGTITTSENRGGDPHSEAPFAKSDNQPSTEKAMEPTMKFSLASVLRPLQEESIMEKDYSASINSLLERYDTYRDILEHHLQNNKFRITSDFSSEEDRSSSCLQAKLTDLQVIKNETDARWKEFEIISLKLENHVNDIKKPFVIKERDTLKERERELQMTLNTRMESLETALRLVLPVEKASLLLCGSDLPLHKMAIQGFHLIDADRIYQHLRNIQDSIAKQIEICNRLEEPGNFVLKELHPFDLHAMQNIILKYKTQFEGMNHRVQRSEDTLKALEDFLASLRTAKLSAEPVTDLSASDTQVAQENTLTVKNKEGEIHLMKDKAKHLDKCLKMLDMSFKDAERGDDTSCENLLDAFSIKLSETHGYGVQEEFTEENKLLEACIFKNNELLKNIQDVQSQISKIGLKDPTVPAVKHRKKSLIRLDKVLDEYEEEKRHLQEMANSLPHFKDGREKTVNQQCQNTVVLWENTKALVTECLEQCGRVLELLKQYQNFKSILTTLIQKEESVISLQASYMGKENLKKRIAEIEIVKEEFNEHLEVVDKINQVCKNLQFYLNKMKTFEEPPFEKEANIIVDRWLDINEKTEDYYENLGRALALWDKLFNLKNVIDEWTEKALQKMELHQLTEEDRERLKEELQVHEQKTSEFSRRVAEIQFLLQSSEIPLELQVMESSILNKMEHVQKCLTGESNCHALSGSTAELREDLDQAKTQIGMTESLLKALSPSDSLEIFTKLEEIQQQILQQKHSMILLENQIGCLTPELSELKKQYESVSDLFNTKKSVLQDHFSKLLNDQCKNFNDWFSNIKVNLKECFESSETKKSVEQKLQKLSDFLTLEGRNSKIKQVDSVLKHVKKHLPKAHVKELISWLVGQEFELEKMESICQARAKELEDSLQQLLRLQDDHRNLRKWLTNQEEKWKGMEEPGEKTELFCQALARKREQFESVAQLNNSLKEYGFTEEEEIIMEATCLMDRYQTLLRQLSEIEEEDKLLPTEDQSFNDLAHDVIHWIKEIKESLMVLNSSEGKMPLEERIQKIKEIILLKPEGDARIETIMKQAESSEAPLVQKTLTDISNQWDNTLHLASTYLSHQEKLLLEGEKYLQSKEDLRLMLIELKKKQEAGFALQHGLQEKKAQLKIYKKFLKKAQDLTSLLKELKSQGNYLLECTKNPSFSEEPWLEIKHLHESLLQQLQDSVQNLDGHVREHDSYQVCVTDLNTTLDNFSKEFVSFSDKPVDQIAVEEKLQKLQELENRLSLQDGTLKKILALAKSVKQNTSSVGQKIIKDDIKSLQCKQKDLENRLASAKQEMECCLNSILKSKRSTEKKGKFTLPGREKQATSDVQESTQESAAVEKLEEDWEINKDSAVEMAMSKQLSLNAQESMKNTEDERKVNELQNQPLELDTMLRNEQLEEIEKLYTQLEAKKAAIKPLEQTECLNKTETGALVLHNIGYSAQHLDNLLQALITLKKNKESQYCVLRDFQEYLAAVESSMKALLTDKESLKVGPLDSVTYLDKIKKFIASIEKEKDSLGNLKIKWENLSNHVTDMDKKLLESQIKQLEHGWEQVEQQIQKKYSQQVVEYDEFTTLMNKVQDTEISLQQQQQHLQLRLKSPEERAGNQSMIALTTDLQATKHGFSVLKGQAELQMKRIWGEKEKKNLEDGINNLKKQWETLEPLHLEAENQIKKCDIRNKMKETILWAKNLLGELNPSIPLLPDDILSQIRKCKVTHDGILARQQSVESLAEEVKDKVPSLTTYEGSDLNNTLEDLRNQYQMLVLKSTQRSQQLEFKLEERSNFFAIIRKFQLMVQESETLIIPRVETAATEAELKHHHVTLEASQKELQEIDSGISTHLQELTNIYEELNVFERLFLEDQLKNLKIRTNRIQRFIQNTCNEVEHKIKFCRQFHEKTSALQEEADSIQRNELLLNQEVNKGVKEEIYNLKDRLTAIKCCILQVLKLKKVFDYIGLNWDFSQLDQLQTQVFEKEKELEEKIKQLDTFEEEHGKYQALLSKMRAIDLQIKKMTEVVLKAPDSSPESRRLNAQILSQRIEKAKCLCDEIIKKLNENKTFDDSFKEKEILQIKLNAEENDKLYKVLQNMVLELSPKELDEKNCQDKLETSLHVLNQIKSQLQQPLLINLEIKHIQNEKDNCEAFQEQVWAEMCSIKAVTAIEKQREENSSEASDVETKLREFEDLQMQLNTSIDLRTNVLNDAYENLTRYKEAVTRAVESITSLEAIIIPYRVDVGNPEESLEMPLRKQEELESTVAHIQDLTEKLGMISSPEAKLQLQYTLQELVSKNSAMKEAFKAQETEAERYLENYKCYRKMEEDIYTNLSKMETVLGQSMSSLPLSYREALERLEQSKALVSNLISTKEELMKLRQILRLLRLRCTENDGICLLKIVSALWEKWLSLLEAAKEWEMWCEELKQEWKFVSEEIEREAIILDNLQEELPEISKTKEAATTEELSELLDCLCQYGENVEKQQLLLTLLLQRIRSIQNVPESSGAVETVPAFQEITSMKERCNKLLQKVQKNKELVQTEIQERHSFTKEIIALKNFFQQTTTSFQNMAFQDHPEKSEQFEELQSILKKGKLTFENIMEKLRIKYSEMYTIVPAEIESQVEECRKALEDIDEKISNEVLKSSPSYAMRRKIEEINNGLHNVEKMLQQKSKNIEKAQEIQKKMWDELDLWHSKLNELDSEVQDIVEQDPGQAQEWMDNLMIPFQQYQQVSQRAECRTSQLNKATVKMEEYSDLLKSTEAWIENTSHLLANPADYDSLRTLSHHASTVQMALEDSEQKHNLLHSIFMDLEDLSIIFETDELTQSIQELSNQVTALQQKIMESLPQIQRMADDVVAIESEVKSMEKRVSKIKTILLSKEIFDFSPEEHLKHGEVILENIRPMKKTIAEIVSYQVELRLPQTGMKPLPVFQRTNQLLQDIKLLENVTQEQNELLKVVIKQTNEWDEEIENLKQILNNYSAQFSLEHMSPDQADKLPQLQGEIERMEKQILSLNQRKEDLLVDLKATVLNLHQHLKQEQEGVERDRLPAVTSEEGGVAERDASERKLNRRGSMSYLAAVEEEVEESSVKSDNGDEKAEPSPQSWSSLWKHDKDMEEDRASSSSGTIVQEAYGKISTSDNSMAQILTPDSLNTEQGPECSLRPNQTEEGTTPPIEADTLDSSDAQGGLEPRVEKTRPEPTEVLHACKTQVAELELWLQQANVAVEPETLNADMQQVLEQQLVGCQAMLTEIEHKVAFLLETCKDQGLGDNGATQHEAEALSLKLKTVKCNLEKVQMMLQEKHSEDQHPTILKKSSEPEHQEALQPVNLSELESIVTERPQFSRQKDFQQQQVLELKPMEQKDFIKFIEFNAKKMWPQYCQHDNDTTQESSASNQASSPENDVPDSILSPQGQNGDKWQYLHHELSSKIKLPLPQLVEPQVSTNMGILPSVTMYNFRYPTTEELKTYTTQLEDLRQEASNLQTQENMTEEAYINLDKKLFELFLTLSQCLSSVEEMLEMPRLYREDGSGQQVHYETLALELKKLYLALSDKKGDLLKAMTWPGENTNLLLECFDNLQVCLEHTQAAAVCRSKSLKAGLDYNRSYQNEIKRLYHQLIKSKTSLQQSLNEISGQSVAEQLQKADAYTVELENAESRVAKLRDEGERLHLPYALLQEVYKLEDVLDSMWGMLRARYTELSSPFVTESQQDALLQGMVELVKIGKEKLAHGHLKQTKSKVALQAQIENHKVFFQKLVADMLLIQAYSAKILPSLLQNRETFWAEQVTEVKILEEKSRQCGMKLQSLLQKWEEFDENYASLEKDLEILISTLPSVSLVEETEERLVERISFYQQIKRNIGGKHARLYQTLNEGKQLVASVSCPELEGQIAKLEEQWLSLNKKIDHELHRLQALLKHLLSYNRDSDQLTKWLESSQHTLNYWKEQSLNVSQDLDTIRSNINNFFEFSKEVDEKSSLKTAVISIGNQLLHLKETDTATLRASLAQFEQKWTMLITQLPDIQEKLHQLQMEKLPSRKAITEMISWMNNVEHQTSDEDSVHSPSSASQVKHLLQKHKEFRMEMDYKQWIVDFVNQSLLQLSTCDVESKRYERTEFAEHLGEMNRQWHRVHGMLNRKIQHLEQLLESITESENKIQILNNWLEAQEERLKTLQKPESVISVQKLLLDCQDIENQLAIKSKALDELKQSYLTLESGAVPLLEDTASRIDELFQKRSSVLTQVNQLKTSMQSVLQEWKIYDQLYDEVNMMTIRFWYCMEHSKPVVLSLETLRCQVENLQSLQDEAESSEGSWEKLQEVIGKLKGLCPSVAEIIEEKCQNTHKRWTQVNQAIADQLQKAQSLLQLWKAYSNAHGEAAARLKQQEAKFQQLANISMSGNNLAEILPPALQDIKELQHDVQKTKEAFLQNSSVLDRLPQPAESSTHMLLPGPLHSLQRAAYLEKMLLVKANEFEFVLSQFKDFGVRLESLKGLIMHEEENLDRLHQQEKENPDSFLNHVLALTAQSPDIEHLNEVSLKLPLSDVAVKTLQNMNRQWIRATATALERCSELQGIGLNEKFLYCCEKWIQLLEKIEEALKVDVANSLPELLEQQKTYKMLEAEVSINQTIADSYVTQSLQLLDTTEIENRPEFITEFSKLTDRWQNAVQGVRQRKGDVDGLVRQWQDFTTSVENLFRFLTDTSHLLSAVKGQERFSLYQTRSLIHELKNKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKDCMEEINLFSENKLQLKQMGDQLIKASNKSRAAEIDDKLNKINDRWQHLFDVIGSRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKQFRAVRTTEGEEETESRVPGSTRPQRSFLSRVVRAALPLQLLLLLLLLLACLLPSSEEDYSCTQANNFARSFYPMLRYTNGPPPT

SEQ ID NO: 82875 - protein, 285 aa, Homo sapiens
  Payload ID: 16495
  Gene Symbol: SYNE2
  Gene Name: spectrin repeat containing, nuclear envelope 2
  Uniprot ID: Q8WXH0
  ENSP ID: ENSP00000344528
MASSPELPTEDEQGSWGIDDLHISLQAEQEDTQKKAFTCWINSQLARHTSPSVISDLFTDIKKGHVLLDLLEVLSGQQLPRDKGSNTFQCRINIEHALTFLRNRSIKLINIHVTDIIDGNPSIILGLIWTIILHFHIEKLAQTLSCNYNQPSLDDVSVVDSSPASSPPAKKCSKVQARWQMSARKALLLWAQEQCATYESVNVTDFKSSWRNGMAFLAIIHALRPDLIDMKSVKHRSNKDNLREAFRIAEQELKIPRLLEPEDAWRSSALYRIYMPGTVSCASYL

SEQ ID NO: 82876 - protein, 6824 aa, Homo sapiens
  Payload ID: 16495
  Gene Symbol: SYNE2
  Gene Name: spectrin repeat containing, nuclear envelope 2
  ENSP ID: ENSP00000349969
MASSPELPTEDEQGSWGIDDLHISLQAEQEDTQKKAFTCWINSQLARHTSPSVISDLFTDIKKGHVLLDLLEVLSGQQLPRDKGSNTFQCRINIEHALTFLRNRSIKLINIHVTDIIDGNPSIILGLIWTIILHFHIEKLAQTLSCNYNQPSLDDVSVVDSSPASSPPAKKCSKVQARWQMSARKALLLWAQEQCATYESVNVTDFKSSWRNGMAFLAIIHALRPDLIDMKSVKHRSNKDNLREAFRIAEQELKIPRLLEPEDVDVVDPDEKSIMTYVAQFLQYSKDAPGTGEEAQGKVKDAMGWLTLQKEKLQKLLKDSENDTYFKKYNSLLSFMESFNEEKKSFLDVLSIKRDLDELDKDHLQLREAWDGLDHQINAWKIKLNYALPPPLHQTEAWLQEVEELMDEDLSASQDHSQAVTLIQEKMTLFKSLMDRFEHHSNILLTFENKDENHLPLVPPNKLEEMKRRINNILEKKFILLLEFHYYKCLVLGLVDEVKSKLDIWNIKYGSRESVELLLEDWHKFIEEKEFLARLDTSFQKCGEIYKNLAGECQNINKQYMMVKSDVCMYRKNIYNVKSTLQKVLACWATYVENLRLLRACFEETKKEEIKEVPFETLAQWNLEHATLNEAGNFLVEVSNDVVGSSISKELRRLNKRWRKLVSKTQLEMNLPLMIKKQDQPTFDNSGNILSKEEKATVEFSTDMSVELPENYNQNIKAGEKHEKENEEFTGQLKVAKDVEKLIGQVEIWEAEAKSVLDQDDVDTSMEESLKHLIAKGSMFDELMARSEDMLQMDIQNISSQESFQHVLTTGLQAKIQEAKEKVQINVVKLIAALKNLTDVSPDLDIRLKMEESQKELESYMMRAQQLLGQRESPGELISKHKEALIISNTKSLAKYLKAVEELKNNVTEDIKMSLEEKSRDVCAKWESLHHELSLYVQQLKIDIEKGKLSDNILKLEKQINKEKKLIRRGRTKGLIKEHEACFSEEGCLYQLNHHMEVLRELCEELPSQKSQQEVKRLLKDYEQKIERLLKCASEIHMTLQPTAGGTSKNEGTITTSENRGGDPHSEAPFAKSDNQPSTEKAMEPTMKFSLASVLRPLQEESIMEKDYSASINSLLERYDTYRDILEHHLQNNKFRITSDFSSEEDRSSSCLQAKLTDLQVIKNETDARWKEFEIISLKLENHVNDIKKPFVIKERDTLKERERELQMTLNTRMESLETALRLVLPVEKASLLLCGSDLPLHKMAIQGFHLIDADRIYQHLRNIQDSIAKQIEICNRLEEPGNFVLKELHPFDLHAMQNIILKYKTQFEGMNHRVQRSEDTLKALEDFLASLRTAKLSAEPVTDLSASDTQVAQENTLTVKNKEGEIHLMKDKAKHLDKCLKMLDMSFKDAERGDDTSCENLLDAFSIKLSETHGYGVQEEFTEENKLLEACIFKNNELLKNIQDVQSQISKIGLKDPTVPAVKHRKKSLIRLDKVLDEYEEEKRHLQEMANSLPHFKDGREKTVNQQCQNTVVLWENTKALVTECLEQCGRVLELLKQYQNFKSILTTLIQKEESVISLQASYMGKENLKKRIAEIEIVKEEFNEHLEVVDKINQVCKNLQFYLNKMKTFEEPPFEKEANIIVDRWLDINEKTEDYYENLGRALALWDKLFNLKNVIDEWTEKALQKMELHQLTEEDRERLKEELQVHEQKTSEFSRRVAEIQFLLQSSEIPLELQVMESSILNKMEHVQKCLTGESNCHALSGSTAELREDLDQAKTQIGMTESLLKALSPSDSLEIFTKLEEIQQQILQQKHSMILLENQIGCLTPELSELKKQYESVSDLFNTKKSVLQDHFSKLLNDQCKNFNDWFSNIKVNLKECFESSETKKSVEQKLQKLSDFLTLEGRNSKIKQVDSVLKHVKKHLPKAHVKELISWLVGQEFELEKMESICQARAKELEDSLQQLLRLQDDHRNLRKWLTNQEEKWKGMEEPGEKTELFCQALARKREQFESVAQLNNSLKEYGFTEEEEIIMEATCLMDRYQTLLRQLSEIEEEDKLLPTEDQSFNDLAHDVIHWIKEIKESLMVLNSSEGKMPLEERIQKIKEIILLKPEGDARIETIMKQAESSEAPLVQKTLTDISNQWDNTLHLASTYLSHQEKLLLEGEKYLQSKEDLRLMLIELKKKQEAGFALQHGLQEKKAQLKIYKKFLKKAQDLTSLLKELKSQGNYLLECTKNPSFSEEPWLEIKHLHESLLQQLQDSVQNLDGHVREHDSYQVCVTDLNTTLDNFSKEFVSFSDKPVDQIAVEEKLQKLQELENRLSLQDGTLKKILALAKSVKQNTSSVGQKIIKDDIKSLQCKQKDLENRLASAKQEMECCLNSILKSKRSTEKKGKFTLPGREKQATSDVQESTQESAAVEKLEEDWEINKNFVENVMAVSKNCHHSMYIFESIVKNFISDEMQDSAVEMAMSKQLSLNAQESMKNTEDERKVNELQNQPLELDTMLRNEQLEEIEKLYTQLEAKKAAIKPLEQTECLNKTETGALVLHNIGYSAQHLDNLLQALITLKKNKESQYCVLRDFQEYLAAVESSMKALLTDKESLKVGPLDSVTYLDKIKKFIASIEKEKDSLGNLKIKWENLSNHVTDMDKKLLESQIKQLEHGWEQVEQQIQKKYSQQVVEYDEFTTLMNKVQDTEISLQQQQQHLQLRLKSPEERAGNQSMIALTTDLQATKHGFSVLKGQAELQMKRIWGEKEKKNLEDGINNLKKQWETLEPLHLEAENQIKKCDIRNKMKETILWAKNLLGELNPSIPLLPDDILSQIRKCKVTHDGILARQQSVESLAEEVKDKVPSLTTYEGSDLNNTLEDLRNQYQMLVLKSTQRSQQLEFKLEERSNFFAIIRKFQLMVQESETLIIPRVETAATEAELKHHHVTLEASQKELQEIDSGISTHLQELTNIYEELNVFERLFLEDQLKNLKIRTNRIQRFIQNTCNEVEHKIKFCRQFHEKTSALQEEADSIQRNELLLNQEVNKGVKEEIYNLKDRLTAIKCCILQVLKLKKVFDYIGLNWDFSQLDQLQTQVFEKEKELEEKIKQLDTFEEEHGKYQALLSKMRAIDLQIKKMTEVVLKAPDSSPESRRLNAQILSQRIEKAKCLCDEIIKKLNENKTFDDSFKEKEILQIKLNAEENDKLYKVLQNMVLELSPKELDEKNCQDKLETSLHVLNQIKSQLQQPLLINLEIKHIQNEKDNCEAFQEQVWAEMCSIKAVTAIEKQREENSSEASDVETKLREFEDLQMQLNTSIDLRTNVLNDAYENLTRYKEAVTRAVESITSLEAIIIPYRVDVGNPEESLEMPLRKQEELESTVAHIQDLTEKLGMISSPEAKLQLQYTLQELVSKNSAMKEAFKAQETEAERYLENYKCYRKMEEDIYTNLSKMETVLGQSMSSLPLSYREALERLEQSKALVSNLISTKEELMKLRQILRLLRLRCTENDGICLLKIVSALWEKWLSLLEAAKEWEMWCEELKQEWKFVSEEIEREAIILDNLQEELPEISKTKEAATTEELSELLDCLCQYGENVEKQQLLLTLLLQRIRSIQNVPESSGAVETVPAFQEITSMKERCNKLLQKVQKNKELVQTEIQERHSFTKEIIALKNFFQQTTTSFQNMAFQDHPEKSEQFEELQSILKKGKLTFENIMEKLRIKYSEMYTIVPAEIESQVEECRKALEDIDEKISNEVLKSSPSYAMRRKIEEINNGLHNVEKMLQQKSKNIEKAQEIQKKMWDELDLWHSKLNELDSEVQDIVEQDPGQAQEWMDNLMIPFQQYQQVSQRAECRTSQLNKATVKMEEYSDLLKSTEAWIENTSHLLANPADYDSLRTLSHHASTVQMALEDSEQKHNLLHSIFMDLEDLSIIFETDELTQSIQELSNQVTALQQKIMESLPQIQRMADDVVAIESEVKSMEKRVSKIKTILLSKEIFDFSPEEHLKHGEVILENIRPMKKTIAEIVSYQVELRLPQTGMKPLPVFQRTNQLLQDIKLLENVTQEQNELLKVVIKQTNEWDEEIENLKQILNNYSAQFSLEHMSPDQADKLPQLQGEIERMEKQILSLNQRKEDLLVDLKATVLNLHQHLKQEQEGVERDRLPAVTSEEGGVAERDASERKLNRRGSMSYLAAVEEEVEESSVKSDHDKDMEEDRASSSSGTIVQEAYGKISTSDNSMAQILTPDSLNTEQGPECSLRPNQTEEGTTPPIEADTLDSSDAQGGLEPRVEKTRPEPTEVLHACKTQVAELELWLQQANVAVEPETLNADMQQVLEQQLVGCQAMLTEIEHKVAFLLETCKDQGLGDNGATQHEAEALSLKLKTVKCNLEKVQMMLQEKHSEDQHPTILKKSSEPEHQEALQPVNLSELESIVTERPQFSRQKDFQQQQVLELKPMEQKDFIKFIEFNAKKMWPQYCQHDNDTTQESSARYPTTEELKTYTTQLEDLRQEASNLQTQENMTEEAYINLDKKLFELFLTLSQCLSSVEEMLEMPRLYREDGSGQQVHYETLALELKKLYLALSDKKGDLLKAMTWPGENTNLLLECFDNLQVCLEHTQAAAVCRSKSLKAGLDYNRSYQKADAYTVELENAESRVAKLRDEGERLHLPYALLQEVYKLEDVLDSMWGMLRARYTELSSPFVTESQQDALLQGMVELVKIGKEKLAHGHLKQTKSKVALQAQIENHKVFFQKLVADMLLIQAYSAKILPSLLQNRETFWAEQVTEVKILEEKSRQCGMKLQSLLQKWEEFDENYASLEKDLEILISTLPSVSLVEETEERLVERISFYQQIKRNIGGKHARLYQTLNEGKQLVASVSCPELEGQIAKLEEQWLSLNKKIDHELHRLQALLKHLLRSAFLGVYNRDSDQLTKWLESSQHTLNYWKEQSLNVSQDLDTIRSNINNFFEFSKEVDEKSSLKTAVISIGNQLLHLKETDTATLRASLAQFEQKWTMLITQLPDIQEKLHQLQMEKLPSRKAITEMISWMNNVEHQTSDEDSVHSPSSASQVKHLLQKHKEFRMEMDYKQWIVDFVNQSLLQLSTCDVESKRYERTEFAEHLGEMNRQWHRVHGMLNRKIQHLEQLLESITESENKIQILNNWLEAQEERLKTLQKPESVISVQKLLLDCQDIENQLAIKSKALDELKQSYLTLESGAVPLLEDTASRIDELFQKRSSVLTQVNQLKTSMQSVLQEWKIYDQLYDEVNMMTIRFWYCMEHSKPVVLSLETLRCQVENLQSLQDEAESSEGSWEKLQEVIGKLKGLCPSVAEIIEEKCQNTHKRWTQVNQAIADQLQKAQSLLQLWKAYSNAHGEAAARLKQQEAKFQQLANISMSGNNLAEILPPALQDIKELQHDVQKTKEAFLQNSSVLDRLPQPAESSTHMLLPGPLHSLQRAAYLEKMLLVKANEFENHVLALTAQSPDIEHLNEVSLKLPLSDVAVKTLQNMNRQWIRATATALERCSELQGIGLNEKFLYCCEKWIQLLEKIEEALKVDVANSLPELLEQQKTYKMLEAEVSINQTIADSYVTQSLQLLDTTEIENRPEFITEFSKLTDRWQNAVQGVRQRKGDVDGLNAHVARCGGASLKKQDLRYSLHTACGAALLCRSSHGANKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKVAIRKQEIEDRLNTWVVFNEKNKELCAWLVQMENKVLQTADISIEEMIEKLQKRTVGREEVPERWECETIVSGHGTEESCFLSIRKFHQGRGLHILTCQLIPQDCMEEINLFSENKLQLKQMGDQLIKASNKSRAAEIDDKLNKINDRWQHLFDVIGSSMADQTNSRWMFFQWPRGIQRTVTWPWDHLCSCASTGHTGPFHSSVLRCFEQHIEFGIYRRTYKVNKELGGDKNGQRCPIIYPHGLVQCIRLGEPLILKRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFERQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEGLEDEKEASENETDMEDPREIQTDSWRKRGESEEPSSPQSLCHLVAPGHERSGCETPVSVDSIPLEWDHTGDVGGSSSHEEDEEGPYYSALSGKSISDGHSWHVPDSPSCPEHHYKQMEGDRNVPPVPPASSTPYKPPYVSLNFTGSTAYVCAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKFLYPAVQSSENYRRRGGDREQGPRQHTATALLPLKGGPGSPTPAAAPPAAAAPGLPAALLRRRLQLHSGQQLCPVLLPHAEVHQWATPHIEGIAGHSATPPA

SEQ ID NO: 82877 - protein, 6907 aa, Homo sapiens
  Payload ID: 16495
  Gene Symbol: SYNE2
  Gene Name: spectrin repeat containing, nuclear envelope 2
  Uniprot ID: Q8WXH0
  ENSP ID: ENSP00000350719
MASSPELPTEDEQGSWGIDDLHISLQAEQEDTQKKAFTCWINSQLARHTSPSVISDLFTDIKKGHVLLDLLEVLSGQQLPRDKGSNTFQCRINIEHALTFLRNRSIKLINIHVTDIIDGNPSIILGLIWTIILHFHIEKLAQTLSCNYNQPSLDDVSVVDSSPASSPPAKKCSKVQARWQMSARKALLLWAQEQCATYESVNVTDFKSSWRNGMAFLAIIHALRPDLIDMKSVKHRSNKDNLREAFRIAEQELKIPRLLEPEDVDVVDPDEKSIMTYVAQFLQYSKDAPGTGEEAQGKVKDAMGWLTLQKEKLQKLLKDSENDTYFKKYNSLLSFMESFNEEKKSFLDVLSIKRDLDELDKDHLQLREAWDGLDHQINAWKIKLNYALPPPLHQTEAWLQEVEELMDEDLSASQDHSQAVTLIQEKMTLFKSLMDRFEHHSNILLTFENKDENHLPLVPPNKLEEMKRRINNILEKKFILLLEFHYYKCLVLGLVDEVKSKLDIWNIKYGSRESVELLLEDWHKFIEEKEFLARLDTSFQKCGEIYKNLAGECQNINKQYMMVKSDVCMYRKNIYNVKSTLQKVLACWATYVENLRLLRACFEETKKEEIKEVPFETLAQWNLEHATLNEAGNFLVEVSNDVVGSSISKELRRLNKRWRKLVSKTQLEMNLPLMIKKQDQPTFDNSGNILSKEEKATVEFSTDMSVELPENYNQNIKAGEKHEKENEEFTGQLKVAKDVEKLIGQVEIWEAEAKSVLDQDDVDTSMEESLKHLIAKGSMFDELMARSEDMLQMDIQNISSQESFQHVLTTGLQAKIQEAKEKVQINVVKLIAALKNLTDVSPDLDIRLKMEESQKELESYMMRAQQLLGQRESPGELISKHKEALIISNTKSLAKYLKAVEELKNNVTEDIKMSLEEKSRDVCAKWESLHHELSLYVQQLKIDIEKGKLSDNILKLEKQINKEKKLIRRGRTKGLIKEHEACFSEEGCLYQLNHHMEVLRELCEELPSQKSQQEVKRLLKDYEQKIERLLKCASEIHMTLQPTAGGTSKNEGTITTSENRGGDPHSEAPFAKSDNQPSTEKAMEPTMKFSLASVLRPLQEESIMEKDYSASINSLLERYDTYRDILEHHLQNNKFRITSDFSSEEDRSSSCLQAKLTDLQVIKNETDARWKEFEIISLKLENHVNDIKKPFVIKERDTLKERERELQMTLNTRMESLETALRLVLPVEKASLLLCGSDLPLHKMAIQGFHLIDADRIYQHLRNIQDSIAKQIEICNRLEEPGNFVLKELHPFDLHAMQNIILKYKTQFEGMNHRVQRSEDTLKALEDFLASLRTAKLSAEPVTDLSASDTQVAQENTLTVKNKEGEIHLMKDKAKHLDKCLKMLDMSFKDAERGDDTSCENLLDAFSIKLSETHGYGVQEEFTEENKLLEACIFKNNELLKNIQDVQSQISKIGLKDPTVPAVKHRKKSLIRLDKVLDEYEEEKRHLQEMANSLPHFKDGREKTVNQQCQNTVVLWENTKALVTECLEQCGRVLELLKQYQNFKSILTTLIQKEESVISLQASYMGKENLKKRIAEIEIVKEEFNEHLEVVDKINQVCKNLQFYLNKMKTFEEPPFEKEANIIVDRWLDINEKTEDYYENLGRALALWDKLFNLKNVIDEWTEKALQKMELHQLTEEDRERLKEELQVHEQKTSEFSRRVAEIQFLLQSSEIPLELQVMESSILNKMEHVQKCLTGESNCHALSGSTAELREDLDQAKTQIGMTESLLKALSPSDSLEIFTKLEEIQQQILQQKHSMILLENQIGCLTPELSELKKQYESVSDLFNTKKSVLQDHFSKLLNDQCKNFNDWFSNIKVNLKECFESSETKKSVEQKLQKLSDFLTLEGRNSKIKQVDSVLKHVKKHLPKAHVKELISWLVGQEFELEKMESICQARAKELEDSLQQLLRLQDDHRNLRKWLTNQEEKWKGMEEPGEKTELFCQALARKREQFESVAQLNNSLKEYGFTEEEEIIMEATCLMDRYQTLLRQLSEIEEEDKLLPTEDQSFNDLAHDVIHWIKEIKESLMVLNSSEGKMPLEERIQKIKEIILLKPEGDARIETIMKQAESSEAPLVQKTLTDISNQWDNTLHLASTYLSHQEKLLLEGEKYLQSKEDLRLMLIELKKKQEAGFALQHGLQEKKAQLKIYKKFLKKAQDLTSLLKELKSQGNYLLECTKNPSFSEEPWLEIKHLHESLLQQLQDSVQNLDGHVREHDSYQVCVTDLNTTLDNFSKEFVSFSDKPVDQIAVEEKLQKLQELENRLSLQDGTLKKILALAKSVKQNTSSVGQKIIKDDIKSLQCKQKDLENRLASAKQEMECCLNSILKSKRSTEKKGKFTLPGREKQATSDVQESTQESAAVEKLEEDWEINKDSAVEMAMSKQLSLNAQESMKNTEDERKVNELQNQPLELDTMLRNEQLEEIEKLYTQLEAKKAAIKPLEQTECLNKTETGALVLHNIGYSAQHLDNLLQALITLKKNKESQYCVLRDFQEYLAAVESSMKALLTDKESLKVGPLDSVTYLDKIKKFIASIEKEKDSLGNLKIKWENLSNHVTDMDKKLLESQIKQLEHGWEQVEQQIQKKYSQQVVEYDEFTTLMNKVQDTEISLQQQQQHLQLRLKSPEERAGNQSMIALTTDLQATKHGFSVLKGQAELQMKRIWGEKEKKNLEDGINNLKKQWETLEPLHLEAENQIKKCDIRNKMKETILWAKNLLGELNPSIPLLPDDILSQIRKCKVTHDGILARQQSVESLAEEVKDKVPSLTTYEGSDLNNTLEDLRNQYQMLVLKSTQRSQQLEFKLEERSNFFAIIRKFQLMVQESETLIIPRVETAATEAELKHHHVTLEASQKELQEIDSGISTHLQELTNIYEELNVFERLFLEDQLKNLKIRTNRIQRFIQNTCNEVEHKIKFCRQFHEKTSALQEEADSIQRNELLLNQEVNKGVKEEIYNLKDRLTAIKCCILQVLKLKKVFDYIGLNWDFSQLDQLQTQVFEKEKELEEKIKQLDTFEEEHGKYQALLSKMRAIDLQIKKMTEVVLKAPDSSPESRRLNAQILSQRIEKAKCLCDEIIKKLNENKTFDDSFKEKEILQIKLNAEENDKLYKVLQNMVLELSPKELDEKNCQDKLETSLHVLNQIKSQLQQPLLINLEIKHIQNEKDNCEAFQEQVWAEMCSIKAVTAIEKQREENSSEASDVETKLREFEDLQMQLNTSIDLRTNVLNDAYENLTRYKEAVTRAVESITSLEAIIIPYRVDVGNPEESLEMPLRKQEELESTVAHIQDLTEKLGMISSPEAKLQLQYTLQELVSKNSAMKEAFKAQETEAERYLENYKCYRKMEEDIYTNLSKMETVLGQSMSSLPLSYREALERLEQSKALVSNLISTKEELMKLRQILRLLRLRCTENDGICLLKIVSALWEKWLSLLEAAKEWEMWCEELKQEWKFVSEEIEREAIILDNLQEELPEISKTKEAATTEELSELLDCLCQYGENVEKQQLLLTLLLQRIRSIQNVPESSGAVETVPAFQEITSMKERCNKLLQKVQKNKELVQTEIQERHSFTKEIIALKNFFQQTTTSFQNMAFQDHPEKSEQFEELQSILKKGKLTFENIMEKLRIKYSEMYTIVPAEIESQVEECRKALEDIDEKISNEVLKSSPSYAMRRKIEEINNGLHNVEKMLQQKSKNIEKAQEIQKKMWDELDLWHSKLNELDSEVQDIVEQDPGQAQEWMDNLMIPFQQYQQVSQRAECRTSQLNKATVKMEEYSDLLKSTEAWIENTSHLLANPADYDSLRTLSHHASTVQMALEDSEQKHNLLHSIFMDLEDLSIIFETDELTQSIQELSNQVTALQQKIMESLPQIQRMADDVVAIESEVKSMEKRVSKIKTILLSKEIFDFSPEEHLKHGEVILENIRPMKKTIAEIVSYQVELRLPQTGMKPLPVFQRTNQLLQDIKLLENVTQEQNELLKVVIKQTNEWDEEIENLKQILNNYSAQFSLEHMSPDQADKLPQLQGEIERMEKQILSLNQRKEDLLVDLKATVLNLHQHLKQEQEGVERDRLPAVTSEEGGVAERDASERKLNRRGSMSYLAAVEEEVEESSVKSDNGDEKAEPSPQSWSSLWKHDKDMEEDRASSSSGTIVQEAYGKISTSDNSMAQILTPDSLNTEQGPECSLRPNQTEEGTTPPIEADTLDSSDAQGGLEPRVEKTRPEPTEVLHACKTQVAELELWLQQANVAVEPETLNADMQQVLEQQLVGCQAMLTEIEHKVAFLLETCKDQGLGDNGATQHEAEALSLKLKTVKCNLEKVQMMLQEKHSEDQHPTILKKSSEPEHQEALQPVNLSELESIVTERPQFSRQKDFQQQQVLELKPMEQKDFIKFIEFNAKKMWPQYCQHDNDTTQESSASNQASSPENDVPDSILSPQGQNGDKWQYLHHELSSKIKLPLPQLVEPQVSTNMGILPSVTMYNFRYPTTEELKTYTTQLEDLRQEASNLQTQENMTEEAYINLDKKLFELFLTLSQCLSSVEEMLEMPRLYREDGSGQQVHYETLALELKKLYLALSDKKGDLLKAMTWPGENTNLLLECFDNLQVCLEHTQAAAVCRSKSLKAGLDYNRSYQNEIKRLYHQLIKSKTSLQQSLNEISGQSVAEQLQKADAYTVELENAESRVAKLRDEGERLHLPYALLQEVYKLEDVLDSMWGMLRARYTELSSPFVTESQQDALLQGMVELVKIGKEKLAHGHLKQTKSKVALQAQIENHKVFFQKLVADMLLIQAYSAKILPSLLQNRETFWAEQVTEVKILEEKSRQCGMKLQSLLQKWEEFDENYASLEKDLEILISTLPSVSLVEETEERLVERISFYQQIKRNIGGKHARLYQTLNEGKQLVASVSCPELEGQIAKLEEQWLSLNKKIDHELHRLQALLKHLLSYNRDSDQLTKWLESSQHTLNYWKEQSLNVSQDLDTIRSNINNFFEFSKEVDEKSSLKTAVISIGNQLLHLKETDTATLRASLAQFEQKWTMLITQLPDIQEKLHQLQMEKLPSRKAITEMISWMNNVEHQTSDEDSVHSPSSASQVKHLLQKHKEFRMEMDYKQWIVDFVNQSLLQLSTCDVESKRYERTEFAEHLGEMNRQWHRVHGMLNRKIQHLEQLLESITESENKIQILNNWLEAQEERLKTLQKPESVISVQKLLLDCQDIENQLAIKSKALDELKQSYLTLESGAVPLLEDTASRIDELFQKRSSVLTQVNQLKTSMQSVLQEWKIYDQLYDEVNMMTIRFWYCMEHSKPVVLSLETLRCQVENLQSLQDEAESSEGSWEKLQEVIGKLKGLCPSVAEIIEEKCQNTHKRWTQVNQAIADQLQKAQSLLQLWKAYSNAHGEAAARLKQQEAKFQQLANISMSGNNLAEILPPALQDIKELQHDVQKTKEAFLQNSSVLDRLPQPAESSTHMLLPGPLHSLQRAAYLEKMLLVKANEFEFVLSQFKDFGVRLESLKGLIMHEEENLDRLHQQEKENPDSFLNHVLALTAQSPDIEHLNEVSLKLPLSDVAVKTLQNMNRQWIRATATALERCSELQGIGLNEKFLYCCEKWIQLLEKIEEALKVDVANSLPELLEQQKTYKMLEAEVSINQTIADSYVTQSLQLLDTTEIENRPEFITEFSKLTDRWQNAVQGVRQRKGDVDGLVRQWQDFTTSVENLFRFLTDTSHLLSAVKGQERFSLYQTRSLIHELKNKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKDCMEEINLFSENKLQLKQMGDQLIKASNKSRAAEIDDKLNKINDRWQHLFDVIGSRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSDVEIPENPEAYLKMTTKTLKASSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKFRAVRTTEGEEETESRVPGSTRPQRSFLSRVVRAALPLQLLLLLLLLLACLLPSSEEDYSCTQANNFARSFYPMLRYTNGPPPT

SEQ ID NO: 82878 - protein, 3270 aa, Homo sapiens
  Payload ID: 16495
  Gene Symbol: SYNE2
  Gene Name: spectrin repeat containing, nuclear envelope 2
  Uniprot ID: Q8WXH0
  ENSP ID: ENSP00000378249
MEKLRIKYSEMYTIVPAEIESQVEECRKALEDIDEKISNEVLKSSPSYAMRRKIEEINNGLHNVEKMLQQKSKNIEKAQEIQKKMWDELDLWHSKLNELDSEVQDIVEQDPGQAQEWMDNLMIPFQQYQQVSQRAECRTSQLNKATVKMEEYSDLLKSTEAWIENTSHLLANPADYDSLRTLSHHASTVQDSKCFRSGPRPNIYVSYYVTVIQMALEDSEQKHNLLHSIFMDLEDLSIIFETDELTQSIQELSNQVTALQQKIMESLPQIQRMADDVVAIESEVKSMEKRVSKIKTILLSKEIFDFSPEEHLKHGEVILENIRPMKKTIAEIVSYQVELRLPQTGMKPLPVFQRTNQLLQDIKLLENVTQEQNELLKVVIKQTNEWDEEIENLKQILNNYSAQFSLEHMSPDQADKLPQLQGEIERMEKQILSLNQRKEDLLVDLKATVLNLHQHLKQEQEGVERDRLPAVTSEEGGVAERDASERKLNRRGSMSYLAAVEEEVEESSVKSDNGDEKAEPSPQSWSSLWKHDKDMEEDRASSSSGTIVQEAYGKISTSDNSMAQILTPDSLNTEQGPECSLRPNQTEEGTTPPIEADTLDSSDAQGGLEPRVEKTRPEPTEVLHACKTQVAELELWLQQANVAVEPETLNADMQQVLEQQLVGCQAMLTEIEHKVAFLLETCKDQGLGDNGATQHEAEALSLKLKTVKCNLEKVQMMLQEKHSEDQHPTILKKSSEPEHQEALQPVNLSELESIVTERPQFSRQKDFQQQQVLELKPMEQKDFIKFIEFNAKKMWPQYCQHDNDTTQESSASNQASSPENDVPDSILSPQGQNGDKWQYLHHELSSKIKLPLPQLVEPQVSTNMGILPSVTMYNFRYPTTEELKTYTTQLEDLRQEASNLQTQENMTEEAYINLDKKLFELFLTLSQCLSSVEEMLEMPRLYREDGSGQQVHYETLALELKKLYLALSDKKGDLLKAMTWPGENTNLLLECFDNLQVCLEHTQAAAVCRSKSLKAGLDYNRSYQNEIKRLYHQLIKSKTSLQQSLNEISGQSVAEQLQKADAYTVELENAESRVAKLRDEGERLHLPYALLQEVYKLEDVLDSMWGMLRARYTELSSPFVTESQQDALLQGMVELVKIGKEKLAHGHLKQTKSKVALQAQIENHKVFFQKLVADMLLIQAYSAKILPSLLQNRETFWAEQVTEVKILEEKSRQCGMKLQSLLQKWEEFDENYASLEKDLEILISTLPSVSLVEETEERLVERISFYQQIKRNIGGKHARLYQTLNEGKQLVASVSCPELEGQIAKLEEQWLSLNKKIDHELHRLQALLKHLLSYNRDSDQLTKWLESSQHTLNYWKEQSLNVSQDLDTIRSNINNFFEFSKEVDEKSSLKTAVISIGNQLLHLKETDTATLRASLAQFEQKWTMLITQLPDIQEKLHQLQMEKLPSRKAITEMISWMNNVEHQTSDEDSVHSPSSASQVKHLLQKHKEFRMEMDYKQWIVDFVNQSLLQLSTCDVESKRYERTEFAEHLGEMNRQWHRVHGMLNRKIQHLEQLLESITESENKIQILNNWLEAQEERLKTLQKPESVISVQKLLLDCQDIENQLAIKSKALDELKQSYLTLESGAVPLLEDTASRIDELFQKRSSVLTQVNQLKTSMQSVLQEWKIYDQLYDEVNMMTIRFWYCMEHSKPVVLSLETLRCQVENLQSLQDEAESSEGSWEKLQEVIGKLKGLCPSVAEIIEEKCQNTHKRWTQVNQAIADQLQKAQSLLQLWKAYSNAHGEAAARLKQQEAKFQQLANISMSGNNLAEILPPALQDIKELQHDVQKTKEAFLQNSSVLDRLPQPAESSTHMLLPGPLHSLQRAAYLEKMLLVKANEFEFVLSQFKDFGVRLESLKGLIMHEEENLDRLHQQEKENPDSFLNHVLALTAQSPDIEHLNEVSLKLPLSDVAVKTLQNMNRQWIRATATALERCSELQGIGLNEKFLYCCEKWIQLLEKIEEALKVDVANSLPELLEQQKTYKMLEAEVSINQTIADSYVTQSLQLLDTTEIENRPEFITEFSKLTDRWQNAVQGVRQRKGDVDGLVRQWQDFTTSVENLFRFLTDTSHLLSAVKGQERFSLYQTRSLIHELKNKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKDCMEEINLFSENKLQLKQMGDQLIKASNKSRAAEIDDKLNKINDRWQHLFDVIGSRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKQFRAVRTTEGEEETESRVPGSTRPQRSFLSRVVRAALPLQLLLLLLLLLACLLPSSEEDYSCTQANNFARSFYPMLRYTNGPPPT

SEQ ID NO: 82879 - protein, 556 aa, Homo sapiens
  Payload ID: 16495
  Gene Symbol: SYNE2
  Gene Name: spectrin repeat containing, nuclear envelope 2
  Uniprot ID: Q8WXH0
  ENSP ID: ENSP00000391937
MEDPREIQTDSWRKRGESEEPSSPQSLCHLVAPGHERSGCETPVSVDSIPLEWDHTGDVGGSSSHEEDEEGPYYSALSDVEIPENPEAYLKMTTKTLKASSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQGSKTRPRSDVLFFKDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKQFRAVRTTEGEEETESRVPGSTRPQRSFLSRVVRAALPLQLLLLLLLLLACLLPSSEEDYSCTQANNFARSFYPMLRYTNGPPPT

SEQ ID NO: 82880 - protein, 429 aa, Homo sapiens
  Payload ID: 16495
  Gene Symbol: SYNE2
  Gene Name: spectrin repeat containing, nuclear envelope 2
  Uniprot ID: Q8WXH0
  ENSP ID: ENSP00000396794
MEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQGSKTRPRSDVLFFKDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKFRAVRTTEGEEETESRVPGSTRPQRSFLSRVVRAALPLQLLLLLLLLLACLLPSSEEDYSCTQANNFARSFYPMLRYTNGPPPT

SEQ ID NO: 82881 - protein, 668 aa, Homo sapiens
  Payload ID: 16495
  Gene Symbol: SYNE2
  Gene Name: spectrin repeat containing, nuclear envelope 2
  ENSP ID: ENSP00000450605
MVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKQFRAVRTTEGEEETESRVPGSTRPQRSFLSRVVRAALPLQLLLLLLLLLACLLPSSEEDYSCTQANNFARSFYPMLRYTNGPPPT

SEQ ID NO: 82882 - protein, 40 aa, Homo sapiens
  Payload ID: 16495
  Gene Symbol: SYNE2
  Gene Name: spectrin repeat containing, nuclear envelope 2
  ENSP ID: ENSP00000450789
MKRRPLRMKQTWKTPEKSRLILGVNGERARNRHLLSPCVI

SEQ ID NO: 82883 - protein, 3541 aa, Homo sapiens
  Payload ID: 16495
  Gene Symbol: SYNE2
  Gene Name: spectrin repeat containing, nuclear envelope 2
  ENSP ID: ENSP00000450831
MEEDIYTNLSKMETVLGQSMSSLPLSYREALERLEQSKALVSNLISTKEELMKLRQILRLLRLRCTENDGICLLKIVSALWEKWLSLLEAAKEWEMWCEELKQEWKFVSEEIEREAIILDNLQEELPEISKTKEAATTEELSELLDCLCQYGENVEKQQLLLTLLLQRIRSIQNVPESSGAVETVPAFQEITSMKERCNKLLQKVQKNKELVQTEIQERHSFTKEIIALKNFFQQTTTSFQNMAFQDHPEKSEQFEELQSILKKGKLTFENIMEKLRIKYSEMYTIVPAEIESQVEECRKALEDIDEKISNEVLKSSPSYAMRRKIEEINNGLHNVEKMLQQKSKNIEKAQEIQKKMWDELDLWHSKLNELDSEVQDIVEQDPGQAQEWMDNLMIPFQQYQQVSQRAECRTSQLNKATVKMEEYSDLLKSTEAWIENTSHLLANPADYDSLRTLSHHASTVQMALEDSEQKHNLLHSIFMDLEDLSIIFETDELTQSIQELSNQVTALQQKIMESLPQIQRMADDVVAIESEVKSMEKRVSKIKTILLSKEIFDFSPEEHLKHGEVILENIRPMKKTIAEIVSYQVELRLPQTGMKPLPVFQRTNQLLQDIKLLENVTQEQNELLKVVIKQTNEWDEEIENLKQILNNYSAQFSLEHMSPDQADKLPQLQGEIERMEKQILSLNQRKEDLLVDLKATVLNLHQHLKQEQEGVERDRLPAVTSEEGGVAERDASERKLNRRGSMSYLAAVEEEVEESSVKSDNGDEKAEPSPQSWSSLWKHDKDMEEDRASSSSGTIVQEAYGKISTSDNSMAQILTPDSLNTEQGPECSLRPNQTEEGTTPPIEADTLDSSDAQGGLEPRVEKTRPEPTEVLHACKTQVAELELWLQQANVAVEPETLNADMQQVLEQQLVGCQAMLTEIEHKVAFLLETCKDQGLGDNGATQHEAEALSLKLKTVKCNLEKVQMMLQEKHSEDQHPTILKKSSEPEHQEALQPVNLSELESIVTERPQFSRQKDFQQQQVLELKPMEQKDFIKFIEFNAKKMWPQYCQHDNDTTQESSASNQASSPENDVPDSILSPQGQNGDKWQYLHHELSSKIKLPLPQLVEPQVSTNMGILPSVTMYNFRYPTTEELKTYTTQLEDLRQEASNLQTQENMTEEAYINLDKKLFELFLTLSQCLSSVEEMLEMPRLYREDGSGQQVHYETLALELKKLYLALSDKKGDLLKAMTWPGENTNLLLECFDNLQVCLEHTQAAAVCRSKSLKAGLDYNRSYQNEIKRLYHQLIKSKTSLQQSLNEISGQSVAEQLQKADAYTVELENAESRVAKLRDEGERLHLPYALLQEVYKLEDVLDSMWGMLRARYTELSSPFVTESQQDALLQGMVELVKIGKEKLAHGHLKQTKSKVALQAQIENHKVFFQKLVADMLLIQAYSAKILPSLLQNRETFWAEQVTEVKILEEKSRQCGMKLQSLLQKWEEFDENYASLEKDLEILISTLPSVSLVEETEERLVERISFYQQIKRNIGGKHARLYQTLNEGKQLVASVSCPELEGQIAKLEEQWLSLNKKIDHELHRLQALLKHLLSYNRDSDQLTKWLESSQHTLNYWKEQSLNVSQDLDTIRSNINNFFEFSKEVDEKSSLKTAVISIGNQLLHLKETDTATLRASLAQFEQKWTMLITQLPDIQEKLHQLQMEKLPSRKAITEMISWMNNVEHQTSDEDSVHSPSSASQVKHLLQKHKEFRMEMDYKQWIVDFVNQSLLQLSTCDVESKRYERTEFAEHLGEMNRQWHRVHGMLNRKIQHLEQLLESITESENKIQILNNWLEAQEERLKTLQKPESVISVQKLLLDCQDIENQLAIKSKALDELKQSYLTLESGAVPLLEDTASRIDELFQKRSSVLTQVNQLKTSMQSVLQEWKIYDQLYDEVNMMTIRFWYCMEHSKPVVLSLETLRCQVENLQSLQDEAESSEGSWEKLQEVIGKLKGLCPSVAEIIEEKCQNTHKRWTQVNQAIADQLQKAQSLLQLWKAYSNAHGEAAARLKQQEAKFQQLANISMSGNNLAEILPPALQDIKELQHDVQKTKEAFLQNSSVLDRLPQPAESSTHMLLPGPLHSLQRAAYLEKMLLVKANEFEFVLSQFKDFGVRLESLKGLIMHEEENLDRLHQQEKENPDSFLNHVLALTAQSPDIEHLNEVSLKLPLSDVAVKTLQNMNRQWIRATATALERCSELQGIGLNEKFLYCCEKWIQLLEKIEEALKVDVANSLPELLEQQKTYKMLEAEVSINQTIADSYVTQSLQLLDTTEIENRPEFITEFSKLTDRWQNAVQGVRQRKGDVDGLVRQWQDFTTSVENLFRFLTDTSHLLSAVKGQERFSLYQTRSLIHELKNKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKDCMEEINLFSENKLQLKQMGDQLIKASNKSRAAEIDDKLNKINDRWQHLFDVIGSRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSDVEIPENPEAYLKMTTKTLKASSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKFRAVRTTEGEEETESRVPGSTRPQRSFLSRVVRAALPLQLLLLLLLLLACLLPSSEEDYSCTQANNFARSFYPMLRYTNGPPPT

SEQ ID NO: 82884 - protein, 763 aa, Homo sapiens
  Payload ID: 16495
  Gene Symbol: SYNE2
  Gene Name: spectrin repeat containing, nuclear envelope 2
  Uniprot ID: Q8WXH0
  ENSP ID: ENSP00000451009
MSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKQFRAVRTTEGEEETESRVPGSTRPQRSFLSRVVRAALPLQLLLLLLLLLACLLPSSEEDYSCTQANNFARSFYPMLRYTNGPPPT

SEQ ID NO: 82885 - protein, 570 aa, Homo sapiens
  Payload ID: 16495
  Gene Symbol: SYNE2
  Gene Name: spectrin repeat containing, nuclear envelope 2
  ENSP ID: ENSP00000451184
MSGNNLAEILPPALQDIKELQHDVQKTKEAFLQNSSVLDRLPQPAESSTHMLLPGPLHSLQRAAYLEKMLLVKANEFEFVLSQFKDFGVRLESLKGLIMHEEENLDRLHQQEKENPDSFLNHVLALTAQSPDIEHLNEVSLKLPLSDVAVKTLQNMNRQWIRATATALERCSELQGIGLNEKFLYCCEKWIQLLEKIEEALKVDVANSLPELLEQQKTYKMLEAEVSINQTIADSYVTQSLQLLDTTEIENRPEFITEFSKLTDRWQNAVQGVRQRKGDVDGLVRQWQDFTTSVENLFRFLTDTSHLLSAVKGQERFSLYQTRSLIHELKNKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKGEEAEGDLCFYSAVGQKHEQPSHLVGSN

SEQ ID NO: 82886 - protein, 172 aa, Homo sapiens
  Payload ID: 16495
  Gene Symbol: SYNE2
  Gene Name: spectrin repeat containing, nuclear envelope 2
  ENSP ID: ENSP00000451520
MSYLAAVEEEVEESSVKSDNGDEKAEPSPQSWSSLWKHDKDMEEDRASSSSGTIVQEAYGKISTSDNSMAQILTPDSLNTEQGPECSLRPNQTEEGTTPPIEADTLDSSDAQGGLEPRVEKTRPEPTEVLHACKTQVAELELWLQQANVAVEPETLNADMQQVLEQQLVGCQ

SEQ ID NO: 82887 - protein, 1113 aa, Homo sapiens
  Payload ID: 16495
  Gene Symbol: SYNE2
  Gene Name: spectrin repeat containing, nuclear envelope 2
  ENSP ID: ENSP00000451972
MLITQLPDIQEKLHQLQMEKLPSRKAITEMISWMNNVEHQTSDEDSVHSPSSASQVKHLLQKHKEFRMEMDYKQWIVDFVNQSLLQLSTCDVESKRYERTEFAEHLGEMNRQWHRVHGMLNRKIQHLEQLLESITESENKIQILNNWLEAQEERLKTLQKPESVISVQKLLLDCQDIENQLAIKSKALDELKQSYLTLESGAVPLLEDTASRIDELFQKRSSVLTQVNQLKTSMQSVLQEWKIYDQLYDEVNMMTIRFWYCMEHSKPVVLSLETLRCQVENLQSLQDEAESSEGSWEKLQEVIGKLKGLCPSVAEIIEEKCQNTHKRWTQVNQAIADQLQKAQSLLQLWKAYSNAHGEAAARLKQQEAKFQQLANISMSGNNLAEILPPALQDIKELQHDVQKTKEAFLQNSSVLDRLPQPAESSTHMLLPGPLHSLQRAAYLEKMLLVKANEFEFVLSQFKDFGVRLESLKGLIMHEEENLDRLHQQEKENPDSFLNHVLALTAQSPDIEHLNEVSLKLPLSDVAVKTLQNMNRQWIRATATALERCSELQGIGLNEKFLYCCEKWIQLLEKIEEALKVDVANSLPELLEQQKTYKMLEAEVSINQTIADSYVTQSLQLLDTTEIENRPEFITEFSKLTDRWQNAVQGVRQRKGDVDGLVRQWQDFTTSVENLFRFLTDTSHLLSAVKGQERFSLYQTRSLIHELKNKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKDCMEEINLFSENKLQLKQMGDQLIKASNKSRAAEIDDKLNKINDRWQHLFDVIGSRVKKLKETFAFIQQLDKNMSNLRTWLARIESELSKPVVYDVCDDQEIQKRLAEQQPTHGVQQKYYLMMTKNAMFIREEVFQFFPMTMHFLFINVIFPKLGNCITIIIKGQDSRDPTSLQATTALAGLYQLGRQGSTARY

SEQ ID NO: 82888 - protein, 162 aa, Homo sapiens
  Payload ID: 16495
  Gene Symbol: SYNE2
  Gene Name: spectrin repeat containing, nuclear envelope 2
  ENSP ID: ENSP00000452298
MSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFEAFQRQIHERLTQ

SEQ ID NO: 82889 - protein, 214 aa, Homo sapiens
  Payload ID: 16495
  Gene Symbol: SYNE2
  Gene Name: spectrin repeat containing, nuclear envelope 2
  ENSP ID: ENSP00000452434
MLTEIEHKVAFLLETCKDQGLGDNGATQHEAEALSLKLKTVKCNLEKVQMMLQEKHSEDQHPTILKKSSEPEHQEALQPVNLSELESIVTERPQFSRQKDFQQQQVLELKPMEQKDFIKFIEFNAKKMWPQYCQHDNDTTQESSASNQASSPENDVPDSILSPQGQNGDKWQYLHHELSSKIKLPLPQLVEPQVSLYLHGANSLFIFENPTSIH

SEQ ID NO: 82890 - protein, 6818 aa, Homo sapiens
  Payload ID: 16495
  Gene Symbol: SYNE2
  Gene Name: spectrin repeat containing, nuclear envelope 2
  ENSP ID: ENSP00000452570
MASSPELPTEDEQGSWGIDDLHISLQAEQEDTQKKAFTCWINSQLARHTSPSVISDLFTDIKKGHVLLDLLEVLSGQQLPRDKGSNTFQCRINIEHALTFLRNRSIKLINIHVTDIIDGNPSIILGLIWTIILHFHIEKLAQTLSCNYNQPSLDDVSVVDSSPASSPPAKKCSKVQARWQMSARKALLLWAQEQCATYESVNVTDFKSSWRNGMAFLAIIHALRPDLIDMKSVKHRSNKDNLREAFRIAEQELKIPRLLEPEDVDVVDPDEKSIMTYVAQFLQYSKDAPGTGEEAQGKVKDAMGWLTLQKEKLQKLLKDSENDTYFKKYNSLLSFMESFNEEKKSFLDVLSIKRDLDELDKDHLQLREAWDGLDHQINAWKIKLNYALPPPLHQTEAWLQEVEELMDEDLSASQDHSQAVTLIQEKMTLFKSLMDRFEHHSNILLTFENKDENHLPLVPPNKLEEMKRRINNILEKKFILLLEFHYYKCLVLGLVDEVKSKLDIWNIKYGSRESVELLLEDWHKFIEEKEFLARLDTSFQKCGEIYKNLAGECQNINKQYMMVKSDVCMYRKNIYNVKSTLQKVLACWATYVENLRLLRACFEETKKEEIKEVPFETLAQWNLEHATLNEAGNFLVEVSNDVVGSSISKELRRLNKRWRKLVSKTQLEMNLPLMIKKQDQPTFDNSGNILSKEEKATVEFSTDMSVELPENYNQNIKAGEKHEKENEEFTGQLKVAKDVEKLIGQVEIWEAEAKSVLDQDDVDTSMEESLKHLIAKGSMFDELMARSEDMLQMDIQNISSQESFQHVLTTGLQAKIQEAKEKVQINVVKLIAALKNLTDVSPDLDIRLKMEESQKELESYMMRAQQLLGQRESPGELISKHKEALIISNTKSLAKYLKAVEELKNNVTEDIKMSLEEKSRDVCAKWESLHHELSLYVQQLKIDIEKGKLSDNILKLEKQINKEKKLIRRGRTKGLIKEHEACFSEEGCLYQLNHHMEVLRELCEELPSQKSQQEVKRLLKDYEQKIERLLKCASEIHMTLQPTAGGTSKNEGTITTSENRGGDPHSEAPFAKSDNQPSTEKAMEPTMKFSLASVLRPLQEESIMEKDYSASINSLLERYDTYRDILEHHLQNNKFRITSDFSSEEDRSSSCLQAKLTDLQVIKNETDARWKEFEIISLKLENHVNDIKKPFVIKERDTLKERERELQMTLNTRMESLETALRLVLPVEKASLLLCGSDLPLHKMAIQGFHLIDADRIYQHLRNIQDSIAKQIEICNRLEEPGNFVLKELHPFDLHAMQNIILKYKTQFEGMNHRVQRSEDTLKALEDFLASLRTAKLSAEPVTDLSASDTQVAQENTLTVKNKEGEIHLMKDKAKHLDKCLKMLDMSFKDAERGDDTSCENLLDAFSIKLSETHGYGVQEEFTEENKLLEACIFKNNELLKNIQDVQSQISKIGLKDPTVPAVKHRKKSLIRLDKVLDEYEEEKRHLQEMANSLPHFKDGREKTVNQQCQNTVVLWENTKALVTECLEQCGRVLELLKQYQNFKSILTTLIQKEESVISLQASYMGKENLKKRIAEIEIVKEEFNEHLEVVDKINQVCKNLQFYLNKMKTFEEPPFEKEANIIVDRWLDINEKTEDYYENLGRALALWDKLFNLKNVIDEWTEKALQKMELHQLTEEDRERLKEELQVHEQKTSEFSRRVAEIQFLLQSSEIPLELQVMESSILNKMEHVQKCLTGESNCHALSGSTAELREDLDQAKTQIGMTESLLKALSPSDSLEIFTKLEEIQQQILQQKHSMILLENQIGCLTPELSELKKQYESVSDLFNTKKSVLQDHFSKLLNDQCKNFNDWFSNIKVNLKECFESSETKKSVEQKLQKLSDFLTLEGRNSKIKQVDSVLKHVKKHLPKAHVKELISWLVGQEFELEKMESICQARAKELEDSLQQLLRLQDDHRNLRKWLTNQEEKWKGMEEPGEKTELFCQALARKREQFESVAQLNNSLKEYGFTEEEEIIMEATCLMDRYQTLLRQLSEIEEEDKLLPTEDQSFNDLAHDVIHWIKEIKESLMVLNSSEGKMPLEERIQKIKEIILLKPEGDARIETIMKQAESSEAPLVQKTLTDISNQWDNTLHLASTYLSHQEKLLLEGEKYLQSKEDLRLMLIELKKKQEAGFALQHGLQEKKAQLKIYKKFLKKAQDLTSLLKELKSQGNYLLECTKNPSFSEEPWLEIKHLHESLLQQLQDSVQNLDGHVREHDSYQVCVTDLNTTLDNFSKEFVSFSDKPVDQIAVEEKLQKLQELENRLSLQDGTLKKILALAKSVKQNTSSVGQKIIKDDIKSLQCKQKDLENRLASAKQEMECCLNSILKSKRSTEKKGKFTLPGREKQATSDVQESTQESAAVEKLEEDWEINKNFVENVMAVSKNCHHSMYIFESIVKNFISDEMQDSAVEMAMSKQLSLNAQESMKNTEDERKVNELQNQPLELDTMLRNEQLEEIEKLYTQLEAKKAAIKPLEQTECLNKTETGALVLHNIGYSAQHLDNLLQALITLKKNKESQYCVLRDFQEYLAAVESSMKALLTDKESLKVGPLDSVTYLDKIKKFIASIEKEKDSLGNLKIKWENLSNHVTDMDKKLLESQIKQLEHGWEQVEQQIQKKYSQQVVEYDEFTTLMNKVQDTEISLQQQQQHLQLRLKSPEERAGNQSMIALTTDLQATKHGFSVLKGQAELQMKRIWGEKEKKNLEDGINNLKKQWETLEPLHLEAENQIKKCDIRNKMKETILWAKNLLGELNPSIPLLPDDILSQIRKCKVTHDGILARQQSVESLAEEVKDKVPSLTTYEGSDLNNTLEDLRNQYQMLVLKSTQRSQQLEFKLEERSNFFAIIRKFQLMVQESETLIIPRVETAATEAELKHHHVTLEASQKELQEIDSGISTHLQELTNIYEELNVFERLFLEDQLKNLKIRTNRIQRFIQNTCNEVEHKIKFCRQFHEKTSALQEEADSIQRNELLLNQEVNKGVKEEIYNLKDRLTAIKCCILQVLKLKKVFDYIGLNWDFSQLDQLQTQVFEKEKELEEKIKQLDTFEEEHGKYQALLSKMRAIDLQIKKMTEVVLKAPDSSPESRRLNAQILSQRIEKAKCLCDEIIKKLNENKTFDDSFKEKEILQIKLNAEENDKLYKVLQNMVLELSPKELDEKNCQDKLETSLHVLNQIKSQLQQPLLINLEIKHIQNEKDNCEAFQEQVWAEMCSIKAVTAIEKQREENSSEASDVETKLREFEDLQMQLNTSIDLRTNVLNDAYENLTRYKEAVTRAVESITSLEAIIIPYRVDVGNPEESLEMPLRKQEELESTVAHIQDLTEKLGMISSPEAKLQLQYTLQELVSKNSAMKEAFKAQETEAERYLENYKCYRKMEEDIYTNLSKMETVLGQSMSSLPLSYREALERLEQSKALVSNLISTKEELMKLRQILRLLRLRCTENDGICLLKIVSALWEKWLSLLEAAKEWEMWCEELKQEWKFVSEEIEREAIILDNLQEELPEISKTKEAATTEELSELLDCLCQYGENVEKQQLLLTLLLQRIRSIQNVPESSGAVETVPAFQEITSMKERCNKLLQKVQKNKELVQTEIQERHSFTKEIIALKNFFQQTTTSFQNMAFQDHPEKSEQFEELQSILKKGKLTFENIMEKLRIKYSEMYTIVPAEIESQVEECRKALEDIDEKISNEVLKSSPSYAMRRKIEEINNGLHNVEKMLQQKSKNIEKAQEIQKKMWDELDLWHSKLNELDSEVQDIVEQDPGQAQEWMDNLMIPFQQYQQVSQRAECRTSQLNKATVKMEEYSDLLKSTEAWIENTSHLLANPADYDSLRTLSHHASTVQMALEDSEQKHNLLHSIFMDLEDLSIIFETDELTQSIQELSNQVTALQQKIMESLPQIQRMADDVVAIESEVKSMEKRVSKIKTILLSKEIFDFSPEEHLKHGEVILENIRPMKKTIAEIVSYQVELRLPQTGMKPLPVFQRTNQLLQDIKLLENVTQEQNELLKVVIKQTNEWDEEIENLKQILNNYSAQFSLEHMSPDQADKLPQLQGEIERMEKQILSLNQRKEDLLVDLKATVLNLHQHLKQEQEGVERDRLPAVTSEEGGVAERDASERKLNRRGSMSYLAAVEEEVEESSVKSDHDKDMEEDRASSSSGTIVQEAYGKISTSDNSMAQILTPDSLNTEQGPECSLRPNQTEEGTTPPIEADTLDSSDAQGGLEPRVEKTRPEPTEVLHACKTQVAELELWLQQANVAVEPETLNADMQQVLEQQLVGCQAMLTEIEHKVAFLLETCKDQGLGDNGATQHEAEALSLKLKTVKCNLEKVQMMLQEKHSEDQHPTILKKSSEPEHQEALQPVNLSELESIVTERPQFSRQKDFQQQQVLELKPMEQKDFIKFIEFNAKKMWPQYCQHDNDTTQESSARYPTTEELKTYTTQLEDLRQEASNLQTQENMTEEAYINLDKKLFELFLTLSQCLSSVEEMLEMPRLYREDGSGQQVHYETLALELKKLYLALSDKKGDLLKAMTWPGENTNLLLECFDNLQVCLEHTQAAAVCRSKSLKAGLDYNRSYQKADAYTVELENAESRVAKLRDEGERLHLPYALLQEVYKLEDVLDSMWGMLRARYTELSSPFVTESQQDALLQGMVELVKIGKEKLAHGHLKQTKSKVALQAQIENHKVFFQKLVADMLLIQAYSAKILPSLLQNRETFWAEQVTEVKILEEKSRQCGMKLQSLLQKWEEFDENYASLEKDLEILISTLPSVSLVEETEERLVERISFYQQIKRNIGGKHARLYQTLNEGKQLVASVSCPELEGQIAKLEEQWLSLNKKIDHELHRLQALLKHLLSYNRDSDQLTKWLESSQHTLNYWKEQSLNVSQDLDTIRSNINNFFEFSKEVDEKSSLKTAVISIGNQLLHLKETDTATLRASLAQFEQKWTMLITQLPDIQEKLHQLQMEKLPSRKAITEMISWMNNVEHQTSDEDSVHSPSSASQVKHLLQKHKEFRMEMDYKQWIVDFVNQSLLQLSTCDVESKRYERTEFAEHLGEMNRQWHRVHGMLNRKIQHLEQLLESITESENKIQILNNWLEAQEERLKTLQKPESVISVQKLLLDCQDIENQLAIKSKALDELKQSYLTLESGAVPLLEDTASRIDELFQKRSSVLTQVNQLKTSMQSVLQEWKIYDQLYDEVNMMTIRFWYCMEHSKPVVLSLETLRCQVENLQSLQDEAESSEGSWEKLQEVIGKLKGLCPSVAEIIEEKCQNTHKRWTQVNQAIADQLQKAQSLLQLWKAYSNAHGEAAARLKQQEAKFQQLANISMSGNNLAEILPPALQDIKELQHDVQKTKEAFLQNSSVLDRLPQPAESSTHMLLPGPLHSLQRAAYLEKMLLVKANEFENHVLALTAQSPDIEHLNEVSLKLPLSDVAVKTLQNMNRQWIRATATALERCSELQGIGLNEKFLYCCEKWIQLLEKIEEALKVDVANSLPELLEQQKTYKMLEAEVSINQTIADSYVTQSLQLLDTTEIENRPEFITEFSKLTDRWQNAVQGVRQRKGDVDGLNAHVARCGGASLKKQDLRYSLHTACGAALLCRSSHGANKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKVAIRKQEIEDRLNTWVVFNEKNKELCAWLVQMENKVLQTADISIEEMIEKLQKRTVGREEVPERWECETIVSGHGTEESCFLSIRKFHQGRGLHILTCQLIPQDCMEEINLFSENKLQLKQMGDQLIKASNKSRAAEIDDKLNKINDRWQHLFDVIGSSMADQTNSRWMFFQWPRGIQRTVTWPWDHLCSCASTGHTGPFHSSVLRCFEQHIEFGIYRRTYKVNKELGGDKNGQRCPIIYPHGLVQCIRLGEPLILKRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFERQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEGLEDEKEASENETDMEDPREIQTDSWRKRGESEEPSSPQSLCHLVAPGHERSGCETPVSVDSIPLEWDHTGDVGGSSSHEEDEEGPYYSALSGKSISDGHSWHVPDSPSCPEHHYKQMEGDRNVPPVPPASSTPYKPPYVSLNFTGSTAYVCAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKFLYPAVQSSENYRRRGGDREQGPRQHTATALLPLKGGPGSPTPAAAPPAAAAPGLPAALLRRRLQLHSGQQLCPVLLPHAEVHQWATPHIEGIAGHSATPPA

SEQ ID NO: 82891 - protein, 975 aa, Homo sapiens
  Payload ID: 16496
  Gene Symbol: SYNE3
  Gene Name: spectrin repeat containing, nuclear envelope family member 3
  Uniprot ID: Q6ZMZ3
  ENSP ID: ENSP00000334308
MTQQPQDDFDRSVEDAQAWMKAVQDQLQVNDNTQGPRAALEARLWETEKICQLEPEGRVRVDLVLRMAEALLACCPGDQKPGILARLKDIKAQWEETVTYMTHCHSRIEWVWLHWSEYLLARDEFYRWFQKMMVTLEPHIELQLGLKEKQWQLSHAQVLLHNVDNQAVLLDRLLEEAASLFNRIGDPSVDEDAQKRMKAEYDAVKAKAQKRVDLLEQVAREHEEYQAGVDEFQLWLKAVVEKVNGCLGRNCKLPITQRLSTLQDIAKDFPRGEESLETLEEQSAGVIRNTSPLGAEKITGELEEMRKVLEKLRALWEEEEERLRGLLRSRGAWEQQIKQLEAELSEFRMVLQRLAQEGLQPAAKAGTEDELVAHWRRYSATRAALASEEPRVDRLQAQLKELIVFPHNLKPLSDSVIATIQEYQSLKVKSARLRNAAAVELWQHFQRPLQDLQLWKALAQRLLEVTASLPDLPSLHTFLPQIEAALMESSRLKELLTMLQLKKDLLIGIFGQERATALLEQVAGSMRDRDLLHNSLLQRKSKLQSLLAQHKDFGAAFEPLQRKLLDLQVRVQAEKGLQRDLPGKQAQLSRLQGLQEEGLDLGAQMEAARPLVQENPNHQHKMDQLSSDFQALQRSLEDLVDRCRQSVQEHCTFSHQLLELRQWIVVTTQKLEAHRGEAGPGDAESQEAEFERLVAEFPEKEAQLSLVEAQGWLVMEKSSPEGAAVVQEELRELAESWRALRLLEESLLSLIRNWHLQRMEVDSGKKMVFTNNIPKSGFLINPMDPIPRHRRRANLLQEEEGSHEDFSQLLRNFGQWLQVENSKLVRIIAMRTSTAEDLRTRKSKLQELEARVPEGQHLFENLLRLGPARGTSDELEDLRYQWMLYKSKLKDSGHLLTQSSPGEPTGFQKTRRWRGLGSLFRRACCVALPLQLLLLLFLLLLFLLPIREEDRSCTLANNFARSFTLMLRYNGPPPT

SEQ ID NO: 82892 - protein, 970 aa, Homo sapiens
  Payload ID: 16496
  Gene Symbol: SYNE3
  Gene Name: spectrin repeat containing, nuclear envelope family member 3
  Uniprot ID: Q6ZMZ3
  ENSP ID: ENSP00000450562
MTQQPQDDFDRSVEDAQAWMKAVQDQLQVNDNTQGPRAALEARLWETEKICQLEPEGRVRVDLVLRMAEALLACCPGDQKPGILARLKDIKAQWEETVTYMTHCHSRIEWVWLHWSEYLLARDEFYRWFQKMMVTLEPHIELQLGLKEKQWQLSHAQVLLHNVDNQAVLLDRLLEEAASLFNRIGDPSVDEDAQKRMKAEYDAVKAKAQKRVDLLEQVAREHEEYQAGVDEFQLWLKAVVEKVNGCLGRNCKLPITQRLSTLQDIAKDFPRGEESLETLEEQSAGVIRNTSPLGAEKITGELEEMRKVLEKLRALWEEEEERLRGLLRSRGAWEQQIKQLEAELSEFRMVLQRLAQEGLQPAAKAGTEDELVAHWRRYSATRAALASEEPRVDRLQAQLKELIVFPHNLKPLSDSVIATIQEYQSLKVKSARLRNAAAVELWQHFQRPLQDLQLWKALAQRLLEVTASLPDLPSLHTFLPQIEAALMESSRLKELLTMLQLKKDLLIGIFGQERATALLEQVAGSMRDRDLLHNSLLQRKSKLQSLLAQHKDFGAAFEPLQRKLLDLQVRVQAEKGLQRDLPGKQAQLSRLQGLQEEGLDLGAQMEAARPLVQENPNHQHKMDQLSSDFQALQRSLEDLVDRCRQSVQEHCTFSHQLLELRQWIVVTTQKLEAHRGEAGPGDAESQEAEFERLVAEFPEKEAQLSLVEAQGWLVMEKSSPEGAAVVQEELRELAESWRALRLLEESLLSLIRNWHLQRMEVDSGKKMVFTNNIPKSGFLINPMDPIPRHRRREEEGSHEDFSQLLRNFGQWLQVENSKLVRIIAMRTSTAEDLRTRKSKLQELEARVPEGQHLFENLLRLGPARGTSDELEDLRYQWMLYKSKLKDSGHLLTQSSPGEPTGFQKTRRWRGLGSLFRRACCVALPLQLLLLLFLLLLFLLPIREEDRSCTLANNFARSFTLMLRYNGPPPT

SEQ ID NO: 82893 - protein, 596 aa, Homo sapiens
  Payload ID: 16496
  Gene Symbol: SYNE3
  Gene Name: spectrin repeat containing, nuclear envelope family member 3
  Uniprot ID: Q6ZMZ3
  ENSP ID: ENSP00000450774
MTQQPQDDFDRSVEDAQAWMKAVQDQLQVNDNTQGPRAALEARLWETEKICQLEPEGRVRVDLVLRMAEALLACCPGDQKPGILARLKDIKAQWEETVTYMTHCHSRIEWVWLHWSEYLLARDEFYRWFQKMMVTLEPHIELQLGLKEKQWQLSHAQVLLHNVDNQAVLLDRLLEEAASLFNRIGDPSVDEDAQKRMKAEYDAVKAKAQKRVDLLEQVAREHEEYQAGVDEFQLWLKAVVEKVNGCLGRNCKLPITQRLSTLQDIAKDFPRGEESLETLEEQSAGVIRNTSPLGAEKITGELEEMRKVLEKLRALWEEEEERLRGLLRSRGAWEQQIKQLEAELSEFRMVLQRLAQEGLQPAAKAGTEDELVAHWRRYSATRAALASEEPRVDRLQAQLKELIVFPHNLKPLSDSVIATIQEYQSLKVKSARLRNAAAVELWQHFQRPLQDLQLWKALAQRLLEVTASLPDLPSLHTFLPQIEAALMESSRLKELLTMLQLKKDLLIGIFGQERATALLEQVAGSMRDRDLLHNSLLQRKSKLQSLLAQHKDFGAAFEPLQRKLLDLQVRVQAEKGLQRDLPGKQAQLSRLQVRGL

SEQ ID NO: 82894 - protein, 732 aa, Homo sapiens
  Payload ID: 16496
  Gene Symbol: SYNE3
  Gene Name: spectrin repeat containing, nuclear envelope family member 3
  ENSP ID: ENSP00000452154
MQQLYSFSLPVFPSPLYPLQDIAKDFPRGEESLETLEEQSAGVIRNTSPLGAEKITGELEEMRKVLEKLRALWEEEEERLRGLLRSRGAWEQQIKQLEAELSEFRMVLQRLAQEGLQPAAKAGTEDELVAHWRRYSATRAALASEEPRVDRLQAQLKELIVFPHNLKPLSDSVIATIQEYQSLKVKSARLRNAAAVELWQHFQRPLQDLQLWKALAQRLLEVTASLPDLPSLHTFLPQIEAALMESSRLKELLTMLQLKKDLLIGIFGQERATALLEQVAGSMRDRDLLHNSLLQRKSKLQSLLAQHKDFGAAFEPLQRKLLDLQVRVQAEKGLQRDLPGKQAQLSRLQGLQEEGLDLGAQMEAARPLVQENPNHQHKMDQLSSDFQALQRSLEDLVDRCRQSVQEHCTFSHQLLELRQWIVVTTQKLEAHRGEAGPGDAESQEAEFERLVAEFPEKEAQLSLVEAQGWLVMEKSSPEGAAVVQEELRELAESWRALRLLEESLLSLIRNWHLQRMEVDSGKKMVFTNNIPKSGFLINPMDPIPRHRRRANLLQEEEGSHEDFSQLLRNFGQWLQVENSKLVRIIAMRTSTAEDLRTRKSKLQELEARVPEGQHLFENLLRLGPARGTSDELEDLRYQWMLYKSKLKDSGHLLTQSSPGEPTGFQKTRRWRGLGSLFRRACCVALPLQLLLLLFLLLLFLLPIREEDRSCTLANNFARSFTLMLRYNGPPPT

SEQ ID NO: 82895 - protein, 404 aa, Homo sapiens
  Payload ID: 16497
  Gene Symbol: SYNE4
  Gene Name: spectrin repeat containing, nuclear envelope family member 4
  Uniprot ID: Q8N205
  ENSP ID: ENSP00000316130
MALSLPLGPRLGSEPLNHPPGAPREADIVGCTVCPASGEESTSPEQAQTLGQDSLGPPEHFQGGPRGNEPAAHPPRWSTPSSYEDPAGGKHCEHPISGLEVLEAEQNSLHLCLLGLGRRLQDLEQGLGHWALAQSGMVQLQALQVDLRGAAERVEALLAFGEGLAQRSEPRAWAALEQILRALGAYRDSIFRRLWQLQAQLVSYSLVFEEANTLDQDLEVEGDSDWPGPGGVWGPWAPSSLPTSTELEWDPAGDIGGLGPLGQKTARTLGVPCELCGQRGPQGRGQGLEEADTSHSRQDMLESGLGHQKRLARHQRHSLLRKPQDKKRQASPHLQDVRLEGNPGAPDPASRQPLTFLLILFLLFLLLVGAMFLLPASGGPCCSHARIPRTPYLVLSYVNGLPPV

SEQ ID NO: 82896 - protein, 291 aa, Homo sapiens
  Payload ID: 16497
  Gene Symbol: SYNE4
  Gene Name: spectrin repeat containing, nuclear envelope family member 4
  Uniprot ID: Q8N205
  ENSP ID: ENSP00000343152
MALSLPLGPRLGSEPLNHPPGAPREADIVGCTVCPASGEESTSPEQAQTLGQDSLGPPEHFQGGPRGNEPAAHPPRWSTPSSYEDPAGGKHCEVFEEANTLDQDLEVEGDSDWPGPGGVWGPWAPSSLPTSTELEWDPAGDIGGLGPLGQKTARTLGVPCELCGQRGPQGRGQGLEEADTSHSRQDMLESGLGHQKRLARHQRHSLLRKPQDKKRQASPHLQDVRLEGNPGAPDPASRQPLTFLLILFLLFLLLVGAMFLLPASGGPCCSHARIPRTPYLVLSYVNGLPPV

SEQ ID NO: 82897 - protein, 118 aa, Homo sapiens
  Payload ID: 16497
  Gene Symbol: SYNE4
  Gene Name: spectrin repeat containing, nuclear envelope family member 4
  ENSP ID: ENSP00000380572
MHRLPRVRRGEHEEADTSHSRQDMLESGLGHQKRLARHQRHSLLRKPQGPRSCIQAASDLPPYPLPPLPPPGGCHVSPARVRRPLLLSCPNTQDTLPGAQLCQWSSPSLMCVINGHCQ

SEQ ID NO: 82898 - protein, 354 aa, Homo sapiens
  Payload ID: 16497
  Gene Symbol: SYNE4
  Gene Name: spectrin repeat containing, nuclear envelope family member 4
  ENSP ID: ENSP00000422716
MALSLPLGPRLGSEPLNHPPGAPREADIVGCTVCPASGEESTSPEQAQTLGQDSLGPPEHFQGGPRGNEPAAHPPRWSTPSSYEDPAGGKHCEHPISGLEVLEAEQNSLHLCLLGLGRRLQDLEQGLGHWALAQSGMVQLQALQVDLRGAAERVEALLAFGEGLAQRSEPRAWAALEQILRALGAYRDSIFRRLWQLQAQLVSYSLVFEEANTLDQDLEVEGDSDWPGPGSRHLSLPTGHAGVWPRPPETLSTSPKTLPAPEASGQEEASISSSPGCEAGGESRGPRSCIQAASDLPPYPLPPLPPPGGCHVSPARVRRPLLLSCPNTQDTLPGAQLCQWSSPSLMCVINGHCQ

SEQ ID NO: 82899 - protein, 151 aa, Homo sapiens
  Payload ID: 16497
  Gene Symbol: SYNE4
  Gene Name: spectrin repeat containing, nuclear envelope family member 4
  ENSP ID: ENSP00000425550
  MOD_RES (1)..(1): Any amino acid
XEPLNHPPGAPREADIVGCTVCPASGEESTSPEQAQTLGQDSLGPPEHFQGGPRGNEPAAHPPRWSTPSSYEDPAGGKHCEGPRSCIQAASDLPPYPLPPLPPPGGCHVSPARVRRPLLLSCPNTQDTLPGAQLCQWSSPSLMCVINGHCQ

SEQ ID NO: 82900 - protein, 2419 aa, Homo sapiens
  Payload ID: 16498
  Gene Symbol: SPTA1
  Gene Name: spectrin, alpha, erythrocytic 1
  Uniprot ID: P02549
  ENSP ID: ENSP00000357129
MEQFPKETVVESSGPKVLETAEEIQERRQEVLTRYQSFKERVAERGQKLEDSYHLQVFKRDADDLGKWIMEKVNILTDKSYEDPTNIQGKYQKHQSLEAEVQTKSRLMSELEKTREERFTMGHSAHEETKAHIEELRHLWDLLLELTLEKGDQLLRALKFQQYVQECADILEWIGDKEAIATSVELGEDWERTEVLHKKFEDFQVELVAKEGRVVEVNQYANECAEENHPDLPLIQSKQNEVNAAWERLRGLALQRQKALSNAANLQRFKRDVTEAIQWIKEKEPVLTSEDYGKDLVASEGLFHSHKGLERNLAVMSDKVKELCAKAEKLTLSHPSDAPQIQEMKEDLVSSWEHIRALATSRYEKLQATYWYHRFSSDFDELSGWMNEKTAAINADELPTDVAGGEVLLDRHQQHKHEIDSYDDRFQSADETGQDLVNANHEASDEVREKMEILDNNWTALLELWDERHRQYEQCLDFHLFYRDSEQVDSWMSRQEAFLENEDLGNSLGSAEALLQKHEDFEEAFTAQEEKIITVDKTATKLIGDDHYDSENIKAIRDGLLARRDALREKAATRRRLLKESLLLQKLYEDSDDLKNWINKKKKLADDEDYKDIQNLKSRVQKQQVFEKELAVNKTQLENIQKTGQEMIEGGHYASDNVTTRLSEVASLWEELLEATKQKGTQLHEANQQLQFENNAEDLQRWLEDVEWQVTSEDYGKGLAEVQNRLRKHGLLESAVAARQDQVDILTDLAAYFEEIGHPDSKDIRARQESLVCRFEALKEPLATRKKKLLDLLHLQLICRDTEDEEAWIQETEPSATSTYLGKDLIASKKLLNRHRVILENIASHEPRIQEITERGNKMVEEGHFAAEDVASRVKSLNQNMESLRARAARRQNDLEANVQFQQYLADLHEAETWIREKEPIVDNTNYGADEEAAGALLKKHEAFLLDLNSFGDSMKALRNQANACQQQQAAPVEGVAGEQRVMALYDFQARSPREVTMKKGDVLTLLSSINKDWWKVEAADHQGIVPAVYVRRLAHDEFPMLPQRRREEPGNITQRQEQIENQYRSLLDRAEERRRRLLQRYNEFLLAYEAGDMLEWIQEKKAENTGVELDDVWELQKKFDEFQKDLNTNEPRLRDINKVADDLLFEGLLTPEGAQIRQELNSRWGSLQRLADEQRQLLGSAHAVEVFHREADDTKEQIEKKCQALSAADPGSDLFSVQALQRRHEGFERDLVPLGDKVTILGETAERLSESHPDATEDLQRQKMELNEAWEDLQGRTKDRKESLNEAQKFYLFLSKARDLQNWISSIGGMVSSQELAEDLTGIEILLERHQEHRADMEAEAPTFQALEDFSAELIDSGHHASPEIEKKLQAVKLERDDLEKAWEKRKKILDQCLELQMFQGNCDQVESWMVARENSLRSDDKSSLDSLEALMKKRDDLDKAITAQEGKITDLEHFAESLIADEHYAKEEIATRLQRVLDRWKALKAQLIDERTKLGDYANLKQFYRDLEELEEWISEMLPTACDESYKDATNIQRKYLKHQTFAHEVDGRSEQVHGVINLGNSLIECSACDGNEEAMKEQLEQLKEHWDHLLERTNDKGKKLNEASRQQRFNTSIRDFEFWLSEAETLLAMKDQARDLASAGNLLKKHQLLEREMLAREDALKDLNTLAEDLLSSGTFNVDQIVKKKDNVNKRFLNVQELAAAHHEKLKEAYALFQFFQDLDDEESWIEEKLIRVSSQDYGRDLQGVQNLLKKHKRLEGELVAHEPAIQNVLDMAEKLKDKAAVGQEEIQLRLAQFVEHWEKLKELAKARGLKLEESLEYLQFMQNAEEEEAWINEKNALAVRGDCGDTLAATQSLLMKHEALENDFAVHETRVQNVCAQGEDILNKVLQEESQNKEISSKIEALNEKTPSLAKAIAAWKLQLEDDYAFQEFNWKADVVEAWIADKETSLKTNGNGADLGDFLTLLAKQDTLDASLQSFQQERLPEITDLKDKLISAQHNQSKAIEERYAALLKRWEQLLEASAVHRQKLLEKQLPLQKAEDLFVEFAHKASALNNWCEKMEENLSEPVHCVSLNEIRQLQKDHEDFLASLARAQADFKCLLELDQQIKALGVPSSPYTWLTVEVLERTWKHLSDIIEEREQELQKEEARQVKNFEMCQEFEQNASTFLQWILETRAYFLDGSLLKETGTLESQLEANKRKQKEIQAMKRQLTKIVDLGDNLEDALILDIKYSTIGLAQQWDQLYQLGLRMQHNLEQQIQAKDIKGVSEETLKEFSTIYKHFDENLTGRLTHKEFRSCLRGLNYYLPMVEEDEHEPKFEKFLDAVDPGRKGYVSLEDYTAFLIDKESENIKSSDEIENAFQALAEGKSYITKEDMKQALTPEQVSFCATHMQQYMDPRGRSHLSGYDYVGFTNSYFGN

SEQ ID NO: 82901 - protein, 124 aa, Homo sapiens
  Payload ID: 16498
  Gene Symbol: SPTA1
  Gene Name: spectrin, alpha, erythrocytic 1
  ENSP ID: ENSP00000476485
MEQFPKETVVESSGPKVLETAEEIQERRQEVLTRYQSFKERVAEENHPDLPLIQSKQNEVNAAWERLRGLALQRQKALSNAANLQRFKRDVTEAIQWIKEKEPVLTSEDYGKDLVASEGLFHSH

SEQ ID NO: 82902 - protein, 2430 aa, Homo sapiens
  Payload ID: 16498
  Gene Symbol: SPTA1
  Gene Name: spectrin, alpha, erythrocytic 1
  ENSP ID: ENSP00000482595
MEQFPKETVVESSGPKVLETAEEIQERRQEVLTRYQSFKERVAERGQKLEDSYHLQVFKRDADDLGKWIMEKVNILTDKSYEDPTNIQGKYQKHQSLEAEVQTKSRLMSELEKTREERFTMGHSAHEETKAHIEELRHLWDLLLELTLEKGDQLLRALKFQQYVQECADILEWIGDKEAIATSVELGEDWERTEVLHKKFEDFQVELVAKEGRVVEVNQYANECAEENHPDLPLIQSKQNEVNAAWERLRGLALQRQKALSNAANLQRFKRDVTEAIQWIKEKEPVLTSEDYGKDLVASEGLFHSHKGLERNLAVMSDKVKELCAKAEKLTLSHPSDAPQIQEMKEDLVSSWEHIRALATSRYEKLQATYWYHRFSSDFDELSGWMNEKTAAINADELPTDVAGGEVLLDRHQQHKHEIDSYDDRFQSADETGQDLVNANHEASDEVREKMEILDNNWTALLELWDERHRQYEQCLDFHLFYRDSEQVDSWMSRQEAFLENEDLGNSLGSAEALLQKHEDFEEAFTAQEEKIITVDKTATKLIGDDHYDSENIKAIRDGLLARRDALREKAATRRRLLKESLLLQKLYEDSDDLKNWINKKKKLADDEDYKDIQNLKSRVQKQQVFEKELAVNKTQLENIQKTGQEMIEGGHYASDNVTTRLSEVASLWEELLEATKQKGTQLHEANQQLQFENNAEDLQRWLEDVEWQVTSEDYGKGLAEVQNRLRKHGLLESAVAARQDQVDILTDLAAYFEEIGHPDSKDIRARQESLVCRFEALKEPLATRKKKLLDLLHLQLICRDTEDEEAWIQETEPSATSTYLGKDLIASKKLLNRHRVILENIASHEPRIQEITERGNKMVEEGHFAAEDVASRVKSLNQNMESLRARAARRQNDLEANVQFQQYLADLHEAETWIREKEPIVDNTNYGADEEAAGALLKKHEAFLLDLNSFGDSMKALRNQANACQQQQAAPVEGVAGEQRVMALYDFQARSPREVTMKKGDVLTLLSSINKDWWKVEAADHQGIVPAVYVRRLAHDEFPMLPQRRREEPGNITQRQEQIENQYRSLLDRAEERRRRLLQRYNEFLLAYEAGDMLEWIQEKKAENTGVELDDVWELQKKFDEFQKDLNTNEPRLRDINKVADDLLFEGLLTPEGAQIRQELNSRWGSLQRLADEQRQLLGSAHAVEVFHREADDTKEQIEKKCQALSAADPGSDLFSVQALQRRHEGFERDLVPLGDKVTILGETAERLSESHPDATEDLQRQKMELNEAWEDLQGRTKDRKESLNEAQKFYLFLSKARDLQNWISSIGGMVSSQELAEDLTGIEILLERHQEHRADMEAEAPTFQALEDFSAELIDSGHHASPEIEKKLQAVKLERDDLEKAWEKRKKILDQCLELQMFQGNCDQVESWMVARENSLRSDDKSSLDSLEALMKKRDDLDKAITAQEGKITDLEHFAESLIADEHYAKEEIATRLQRVLDRWKALKAQLIDERTKLGDYANLKQFYRDLEELEEWISEMLPTACDESYKDATNIQRKYLKHQTFAHEVDGRSEQVHGVINLGNSLIECSACDGNEEAMKEQLEQLKEHWDHLLERTNDKGKKLNEASRQQRFNTSIRDFEFWLSEAETLLAMKDQARDLASAGNLLKKHQLLEREMLAREDALKDLNTLAEDLLSSGTFNVDQIVKKKDNVNKRFLNVQELAAAHHEKLKEAYALFQFFQDLDDEESWIEEKLIRVSSQDYGRDLQGVQNLLKKHKRLEGELVAHEPAIQNVLDMAEKLKDKAAVGQEEIQLRLAQFVEHWEKLKELAKARGLKLEESLEYLQFMQNAEEEEAWINEKNALAVRGDCGDTLAATQSLLMKHEALENDFAVHETRVQNVCAQGEDILNKVLQEESQNKEISSKIEALNEKTPSLAKAIAAWKLQLEDDYAFQEFNWKADVVEAWIADKETSLKTNGNGADLGDFLTLLAKQDTLDASLQSFQQERLPEITDLKDKLISAQHNQSKAIEERYAALLKRWEQLLEASAVHRQKLLEKQLPLQKAEDLFVEFAHKASALNNWCEKMEENLSEPVHCVSLNEIRQLQKDHEDFLASLARAQADFKCLLELDQQIKALGVPSSPYTWLTVEVLERTWKHLSDIIEEREQELQKEEARQVKNFEMCQEFEQNASTFLQWILETRAYFLDGSLLKETGTLESQLEANKRKQKEIQAMKRQLTKIVDLGDNLEDALILDIKYSTIGLAQQWDQLYQLGLRMQHNLEQQIQAKDIKGVSEETLKEFSTIYKHFDENLTGRLTHKEFRSCLRGLNYYLPMVEEDEHEPKFEKFLDAVDPGRKGYVSLEDYTAFLIDKESENIKSSDEIENAFQALAEGKSYITKEDMKQALTPEQVSFCATHMQQYMDPRVEAISLAMTTLASPIPTLATNKQLLVDRRKS

SEQ ID NO: 82903 - protein, 2452 aa, Homo sapiens
  Payload ID: 16499
  Gene Symbol: SPTAN1
  Gene Name: spectrin, alpha, non-erythrocytic 1
  Uniprot ID: Q13813
  ENSP ID: ENSP00000350882
MDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 82904 - protein, 2472 aa, Homo sapiens
  Payload ID: 16499
  Gene Symbol: SPTAN1
  Gene Name: spectrin, alpha, non-erythrocytic 1
  Uniprot ID: Q13813
  ENSP ID: ENSP00000361816
MDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 82905 - protein, 2477 aa, Homo sapiens
  Payload ID: 16499
  Gene Symbol: SPTAN1
  Gene Name: spectrin, alpha, non-erythrocytic 1
  Uniprot ID: Q13813
  ENSP ID: ENSP00000361824
MDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQLSKLLSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 82906 - protein, 2457 aa, Homo sapiens
  Payload ID: 16499
  Gene Symbol: SPTAN1
  Gene Name: spectrin, alpha, non-erythrocytic 1
  ENSP ID: ENSP00000486308
MDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQLSKLLSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 82907 - protein, 153 aa, Homo sapiens
  Payload ID: 16499
  Gene Symbol: SPTAN1
  Gene Name: spectrin, alpha, non-erythrocytic 1
  ENSP ID: ENSP00000486547
MLSSFRKRRVQKMDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREK

SEQ ID NO: 82908 - protein, 68 aa, Homo sapiens
  Payload ID: 16499
  Gene Symbol: SPTAN1
  Gene Name: spectrin, alpha, non-erythrocytic 1
  ENSP ID: ENSP00000486605
  MOD_RES (1)..(1): Any amino acid
XEAILDTVDPNRDGHVSLQEYMAFMISRETENVKSSEEIESAFRALSSEGKPYVTKEELYQVWASGGG

SEQ ID NO: 82909 - protein, 2498 aa, Homo sapiens
  Payload ID: 16499
  Gene Symbol: SPTAN1
  Gene Name: spectrin, alpha, non-erythrocytic 1
  ENSP ID: ENSP00000487444
MDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQKLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDSLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGITIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLIQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQLSKLLSKHQKHQAFEAELHANADRIRGVIDMGNSLIERGACAGSEDAVKARLAALADQWQFLVQKSAEKSQKLKEANKQQNFNTGIKDFDFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETDFTVHKDRVNDVCTNGQDLIKKNNHHEENISSKMKGLNGKVSDLEKAAAQRKAKLDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGIAYRRVIRVYQYEVGDDLSGRSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQEFKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPYVDGKGRELPTAFDYVEFTRSLFVN

SEQ ID NO: 82910 - protein, 2106 aa, Homo sapiens
  Payload ID: 16500
  Gene Symbol: SPTB
  Gene Name: spectrin, beta, erythrocytic
  Uniprot ID: P11277
  ENSP ID: ENSP00000374370
MTSATEFENVGNQPPYSRINARWDAPDDELDNDNSSARLFERSRIKALADEREVVQKKTFTKWVNSHLARVSCRITDLYKDLRDGRMLIKLLEVLSGEMLPKPTKGKMRIHCLENVDKALQFLKEQRVHLENMGSHDIVDGNHRLVLGLIWTIILRFQIQDIVVQTQEGRETRSAKDALLLWCQMKTAGYPHVNVTNFTSSWKDGLAFNALIHKHRPDLIDFDKLKDSNARHNLEHAFNVAERQLGIIPLLDPEDVFTENPDEKSIITYVVAFYHYFSKMKVLAVEGKRVGKVIDHAIETEKMIEKYSGLASDLLTWIEQTITVLNSRKFANSLTGVQQQLQAFSTYRTVEKPPKFQEKGNLEVLLFTIQSRMRANNQKVYTPHDGKLVSDINRAWESLEEAEYRRELALRNELIRQEKLEQLARRFDRKAAMRETWLSENQRLVAQDNFGYDLAAVEAAKKKHEAIETDTAAYEERVRALEDLAQELEKENYHDQKRITARKDNILRLWSYLQELLQSRRQRLETTLALQKLFQDMLHSIDWMDEIKAHLLSAEFGKHLLEVEDLLQKHKLMEADIAIQGDKVKAITAATLKFTEGKGYQPCDPQVIQDRISHLEQCFEELSNMAAGRKAQLEQSKRLWKFFWEMDEAESWIKEKEQIYSSLDYGKDLTSVLILQRKHKAFEDELRGLDAHLEQIFQEAHGMVARKQFGHPQIEARIKEVSAQWDQLKDLAAFCKKNLQDAENFFQFQGDADDLKAWLQDAHRLLSGEDVGQDEGATRALGKKHKDFLEELEESRGVMEHLEQQAQGFPEEFRDSPDVTHRLQALRELYQQVVAQADLRQQRLQEALDLYTVFGETDACELWMGEKEKWLAEMEMPDTLEDLEVVQHRFDILDQEMKTLMTQIDGVNLAANSLVESGHPRSREVKQYQDHLNTRWQAFQTLVSERREAVDSALRVHNYCVDCEETSKWITDKTKVVESTKDLGRDLAGIIAIQRKLSGLERDVAAIQARVDALERESQQLMDSHPEQKEDIGQRQKHLEELWQGLQQSLQGQEDLLGEVSQLQAFLQDLDDFQAWLSITQKAVASEDMPESLPEAEQLLQQHAGIKDEIDGHQDSYQRVKESGEKVIQGQTDPEYLLLGQRLEGLDTGWNALGRMWESRSHTLAQCLGFQEFQKDAKQAEAILSNQEYTLAHLEPPDSLEAAEAGIRKFEDFLGSMENNRDKVLSPVDSGNKLVAEGNLYSDKIKEKVQLIEDRHRKNNEKAQEASVLLRDNLELQNFLQNCQELTLWINDKLLTSQDVSYDEARNLHNKWLKHQAFVAELASHEGWLENIDAEGKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERELHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTASRGGRRDSRGGSSFPPCGHRENVPGQSLVSFV

SEQ ID NO: 82911 - protein, 2137 aa, Homo sapiens
  Payload ID: 16500
  Gene Symbol: SPTB
  Gene Name: spectrin, beta, erythrocytic
  Uniprot ID: P11277
  ENSP ID: ENSP00000374371
MTSATEFENVGNQPPYSRINARWDAPDDELDNDNSSARLFERSRIKALADEREVVQKKTFTKWVNSHLARVSCRITDLYKDLRDGRMLIKLLEVLSGEMLPKPTKGKMRIHCLENVDKALQFLKEQRVHLENMGSHDIVDGNHRLVLGLIWTIILRFQIQDIVVQTQEGRETRSAKDALLLWCQMKTAGYPHVNVTNFTSSWKDGLAFNALIHKHRPDLIDFDKLKDSNARHNLEHAFNVAERQLGIIPLLDPEDVFTENPDEKSIITYVVAFYHYFSKMKVLAVEGKRVGKVIDHAIETEKMIEKYSGLASDLLTWIEQTITVLNSRKFANSLTGVQQQLQAFSTYRTVEKPPKFQEKGNLEVLLFTIQSRMRANNQKVYTPHDGKLVSDINRAWESLEEAEYRRELALRNELIRQEKLEQLARRFDRKAAMRETWLSENQRLVAQDNFGYDLAAVEAAKKKHEAIETDTAAYEERVRALEDLAQELEKENYHDQKRITARKDNILRLWSYLQELLQSRRQRLETTLALQKLFQDMLHSIDWMDEIKAHLLSAEFGKHLLEVEDLLQKHKLMEADIAIQGDKVKAITAATLKFTEGKGYQPCDPQVIQDRISHLEQCFEELSNMAAGRKAQLEQSKRLWKFFWEMDEAESWIKEKEQIYSSLDYGKDLTSVLILQRKHKAFEDELRGLDAHLEQIFQEAHGMVARKQFGHPQIEARIKEVSAQWDQLKDLAAFCKKNLQDAENFFQFQGDADDLKAWLQDAHRLLSGEDVGQDEGATRALGKKHKDFLEELEESRGVMEHLEQQAQGFPEEFRDSPDVTHRLQALRELYQQVVAQADLRQQRLQEALDLYTVFGETDACELWMGEKEKWLAEMEMPDTLEDLEVVQHRFDILDQEMKTLMTQIDGVNLAANSLVESGHPRSREVKQYQDHLNTRWQAFQTLVSERREAVDSALRVHNYCVDCEETSKWITDKTKVVESTKDLGRDLAGIIAIQRKLSGLERDVAAIQARVDALERESQQLMDSHPEQKEDIGQRQKHLEELWQGLQQSLQGQEDLLGEVSQLQAFLQDLDDFQAWLSITQKAVASEDMPESLPEAEQLLQQHAGIKDEIDGHQDSYQRVKESGEKVIQGQTDPEYLLLGQRLEGLDTGWNALGRMWESRSHTLAQCLGFQEFQKDAKQAEAILSNQEYTLAHLEPPDSLEAAEAGIRKFEDFLGSMENNRDKVLSPVDSGNKLVAEGNLYSDKIKEKVQLIEDRHRKNNEKAQEASVLLRDNLELQNFLQNCQELTLWINDKLLTSQDVSYDEARNLHNKWLKHQAFVAELASHEGWLENIDAEGKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERELHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTLELKERQIAERPAEETGPQEEEGETAGEAPVSHHAATERTSPVSLWSRLSSSWESLQPEPSHPY

SEQ ID NO: 82912 - protein, 2328 aa, Homo sapiens
  Payload ID: 16500
  Gene Symbol: SPTB
  Gene Name: spectrin, beta, erythrocytic
  Uniprot ID: P11277
  ENSP ID: ENSP00000374372
MTSATEFENVGNQPPYSRINARWDAPDDELDNDNSSARLFERSRIKALADEREVVQKKTFTKWVNSHLARVSCRITDLYKDLRDGRMLIKLLEVLSGEMLPKPTKGKMRIHCLENVDKALQFLKEQRVHLENMGSHDIVDGNHRLVLGLIWTIILRFQIQDIVVQTQEGRETRSAKDALLLWCQMKTAGYPHVNVTNFTSSWKDGLAFNALIHKHRPDLIDFDKLKDSNARHNLEHAFNVAERQLGIIPLLDPEDVFTENPDEKSIITYVVAFYHYFSKMKVLAVEGKRVGKVIDHAIETEKMIEKYSGLASDLLTWIEQTITVLNSRKFANSLTGVQQQLQAFSTYRTVEKPPKFQEKGNLEVLLFTIQSRMRANNQKVYTPHDGKLVSDINRAWESLEEAEYRRELALRNELIRQEKLEQLARRFDRKAAMRETWLSENQRLVAQDNFGYDLAAVEAAKKKHEAIETDTAAYEERVRALEDLAQELEKENYHDQKRITARKDNILRLWSYLQELLQSRRQRLETTLALQKLFQDMLHSIDWMDEIKAHLLSAEFGKHLLEVEDLLQKHKLMEADIAIQGDKVKAITAATLKFTEGKGYQPCDPQVIQDRISHLEQCFEELSNMAAGRKAQLEQSKRLWKFFWEMDEAESWIKEKEQIYSSLDYGKDLTSVLILQRKHKAFEDELRGLDAHLEQIFQEAHGMVARKQFGHPQIEARIKEVSAQWDQLKDLAAFCKKNLQDAENFFQFQGDADDLKAWLQDAHRLLSGEDVGQDEGATRALGKKHKDFLEELEESRGVMEHLEQQAQGFPEEFRDSPDVTHRLQALRELYQQVVAQADLRQQRLQEALDLYTVFGETDACELWMGEKEKWLAEMEMPDTLEDLEVVQHRFDILDQEMKTLMTQIDGVNLAANSLVESGHPRSREVKQYQDHLNTRWQAFQTLVSERREAVDSALRVHNYCVDCEETSKWITDKTKVVESTKDLGRDLAGIIAIQRKLSGLERDVAAIQARVDALERESQQLMDSHPEQKEDIGQRQKHLEELWQGLQQSLQGQEDLLGEVSQLQAFLQDLDDFQAWLSITQKAVASEDMPESLPEAEQLLQQHAGIKDEIDGHQDSYQRVKESGEKVIQGQTDPEYLLLGQRLEGLDTGWNALGRMWESRSHTLAQCLGFQEFQKDAKQAEAILSNQEYTLAHLEPPDSLEAAEAGIRKFEDFLGSMENNRDKVLSPVDSGNKLVAEGNLYSDKIKEKVQLIEDRHRKNNEKAQEASVLLRDNLELQNFLQNCQELTLWINDKLLTSQDVSYDEARNLHNKWLKHQAFVAELASHEGWLENIDAEGKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERELHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTLELKERQIAERPAEETGPQEEEGETAGEAPVSHHAATERTSPGEEEGTWPQNLQQPPPPGQHKDGQKSTGDERPTTEPLFKVLDTPLSEGDEPATLPAPRDHGQSVQMEGYLGRKHDLEGPNKKASNRSWNNLYCVLRNSELTFYKDAKNLALGMPYHGEEPLALRHAICEIAANYKKKKHVFKLRLSNGSEWLFHGKDEEEMLSWLQGVSTAINESQSIRVKAQSLPLPSLSGPDASLGKKDKEKRFSFFPKKK

SEQ ID NO: 82913 - protein, 1028 aa, Homo sapiens
  Payload ID: 16500
  Gene Symbol: SPTB
  Gene Name: spectrin, beta, erythrocytic
  ENSP ID: ENSP00000451324
GKQLMDEKPQFTALVSQKLEALHRLWDELQATTKEKTQHLSAARSSDLRLQTHADLNKWISAMEDQLRSDDPGKDLTSVNRMLAKLKRVEDQVNVRKEELGELFAQVPSMGEEGGDADLSIEKRFLDLLEPLGRRKKQLESSRAKLQISRDLEDETLWVEERLPLAQSADYGTNLQTVQLFMKKNQTLQNEILGHTPRVEDVLQRGQQLVEAAEIDCQDLEERLGHLQSSWDRLREAAAGRLQRLRDANEAQQYYLDADEAEAWIGEQELYVISDEIPKDEEGAIVMLKRHLRQQRAVEDYGRNIKQLASRAQGLLSAGHPEGEQIIRLQGQVDKHYAGLKDVAEERKRKLENMYHLFQLKRETDDLEQWISEKELVASSPEMGQDFDHVTLLRDKFRDFARETGAIGQERVDNVNAFIERLIDAGHSEAATIAEWKDGLNEMWADLLELIDTRMQLLAASYDLHRYFYTGAEILGLIDEKHRELPEDVGLDASTAESFHRVHTAFERELHLLGVQVQQFQDVATRLQTAYAGEKAEAIQNKEQEVSAAWQALLDACAGRRTQLVDTADKFRFFSMARDLLSWMESIIRQIETQERPRDVSSVELLMKYHQGINAEIETRSKNFSACLELGESLLQRQHQASEEIREKLQQVMSRRKEMNEKWEARWERLRMLLEVCQFSRDASVAEAWLIAQEPYLASGDFGHTVDSVEKLIKRHEAFEKSTASWAERFAALEKPTTLELKERQIAERPAEETGPQEEEGETAGEAPVSHHAATERTSPGEEEGTWPQNLQQPPPPGQHKDGQKSTGDERPTTEPLFKVLDTPLSEGDEPATLPAPRDHGQSVQMEGYLGRKHDLEGPNKKASNSKGEEGEERRETEEEDEEEEETESVAVEMQQHASHVSWNNLYCVLRNSELTFYKDAKNLALGMPYHGEEPLALRHAICEIAANYKKKKHVFKLRLSNGSEWLFHGKDEEEMLSWLQGVSTAINESQSIRVKAQSLPLPSLSGPDASLGKKDKEKRFSFFPKKK

SEQ ID NO: 82914 - protein, 2328 aa, Homo sapiens; identical to SEQ ID NO: 82912
  Payload ID: 16500
  Gene Symbol: SPTB
  Gene Name: spectrin, beta, erythrocytic
  Uniprot ID: P11277
  ENSP ID: ENSP00000451752

SEQ ID NO: 82915 - protein, 2155 aa, Homo sapiens
  Payload ID: 16501
  Gene Symbol: SPTBN1
  Gene Name: spectrin, beta, non-erythrocytic 1
  Uniprot ID: Q01082
  ENSP ID: ENSP00000334156
MELQRTSSISGPLSPAYTGQVPYNYNQLEGRFKQLQDEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEEIKEKLLQLTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRVSYRSQTYQNYKNFNSRRTASDQPWSGL

SEQ ID NO: 82916 - protein, 2364 aa, Homo sapiens
  Payload ID: 16501
  Gene Symbol: SPTBN1
  Gene Name: spectrin, beta, non-erythrocytic 1
  Uniprot ID: Q01082
  ENSP ID: ENSP00000349259
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEEIKEKLLQLTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRMAETVDTSEMVNGATEQRTSSKESSPIPSPTSDRKAKTALPAQSAATLPARTQETPSAQMEGFLNRKHEWEAHNKKASSRSWHNVYCVINNQEMGFYKDAKTAASGIPYHSEVPVSLKEAVCEVALDYKKKKHVFKLRLNDGNEYLFQAKDDEEMNTWIQAISSAISSDKHEVSASTQSTPASSRAQTLPTSVVTITSESSPGKREKDKEKDKEKRFSLFGKKK

SEQ ID NO: 82917 - protein, 690 aa, Homo sapiens
  Payload ID: 16501
  Gene Symbol: SPTBN1
  Gene Name: spectrin, beta, non-erythrocytic 1
  ENSP ID: ENSP00000374630
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGR

SEQ ID NO: 82918 - protein, 2366 aa, Homo sapiens [sequence omitted]

SEQ ID NO: 82919 - protein, 2390 aa, Homo sapiens
  Payload ID: 16502
  Gene Symbol: SPTBN2
  Gene Name: spectrin, beta, non-erythrocytic 2
  Uniprot ID: O15020
  ENSP ID: ENSP00000311489
MSSTLSPTDFDSLEIQGQYSDINNRWDLPDSDWDNDSSSARLFERSRIKALADEREAVQKKTFTKWVNSHLARVTCRVGDLYSDLRDGRNLLRLLEVLSGEILPKPTKGRMRIHCLENVDKALQFLKEQKVHLENMGSHDIVDGNHRLTLGLVWTIILRFQIQDISVETEDNKEKKSAKDALLLWCQMKTAGYPNVNVHNFTTSWRDGLAFNAIVHKHRPDLLDFESLKKCNAHYNLQNAFNLAEKELGLTKLLDPEDVNVDQPDEKSIITYVATYYHYFSKMKALAVEGKRIGKVLDHAMEAERLVEKYESLASELLQWIEQTIVTLNDRQLANSLSGVQNQLQSFNSYRTVEKPPKFTEKGNLEVLLFTIQSKLRANNQKVYTPREGRLISDINKAWERLEKAEHERELALRTELIRQEKLEQLAARFDRKAAMRETWLSENQRLVSQDNFGLELAAVEAAVRKHEAIETDIVAYSGRVQAVDAVAAELAAERYHDIKRIAARQHNVARLWDFLRQMVAARRERLLLNLELQKVFQDLLYLMDWMEEMKGRLQSQDLGRHLAGVEDLLQLHELVEADIAVQAERVRAVSASALRFCNPGKEYRPCDPQLVSERVAKLEQSYEALCELAAARRARLEESRRLWRFLWEVGEAEAWVREQQHLLASADTGRDLTGALRLLNKHTALRGEMSGRLGPLKLTLEQGQQLVAEGHPGASQASARAAELQAQWERLEALAEERAQRLAQAASLYQFQADANDMEAWLVDALRLVSSPELGHDEFSTQALARQHRALEEEIRSHRPTLDALREQAAALPPTLSRTPEVQSRVPTLERHYEELQARAGERARALEAALALYTMLSEAGACGLWVEEKEQWLNGLALPERLEDLEVVQQRFETLEPEMNTLAAQITAVNDIAEQLLKANPPGKDRIVNTQEQLNHRWQQFRRLADGKKAALTSALSIQNYHLECTETQAWMREKTKVIESTQGLGNDLAGVLALQRKLAGTERDLEAIAARVGELTREANALAAGHPAQAVAINARLREVQTGWEDLRATMRRREESLGEARRLQDFLRSLDDFQAWLGRTQTAVASEEGPATLPEAEALLAQHAALRGEVERAQSEYSRLRALGEEVTRDQADPQCLFLRQRLEALGTGWEELGRMWESRQGRLAQAHGFQGFLRDARQAEGVLSSQEYVLSHTEMPGTLQAADAAIKKLEDFMSTMDANGERIHGLLEAGRQLVSEGNIHADKIREKADSIERRHKKNQDAAQQFLGRLRDNREQQHFLQDCHELKLWIDEKMLTAQDVSYDEARNLHTKWQKHQAFMAELAANKDWLDKVDKEGRELTLEKPELKALVSEKLRDLHRRWDELETTTQAKARSLFDANRAELFAQSCCALESWLESLQAQLHSDDYGKDLTSVNILLKKQQMLEWEMAVREKEVEAIQAQAKALAQEDQGAGEVERTSRAVEEKFRALCQPMRERCRRLQASREQHQFHRDVEDEILWVTERLPMASSMEHGKDLPSVQLLMKKNQTLQKEIQGHEPRIADLRERQRALGAAAAGPELAELQEMWKRLGHELELRGKRLEDALRAQQFYRDAAEAEAWMGEQELHMMGQEKAKDELSAQAEVKKHQVLEQALADYAQTIHQLAASSQDMIDHEHPESTRISIRQAQVDKLYAGLKELAGERRERLQEHLRLCQLRRELDDLEQWIQEREVVAASHELGQDYEHVTMLRDKFREFSRDTSTIGQERVDSANALANGLIAGGHAARATVAEWKDSLNEAWADLLELLDTRGQVLAAAYELQRFLHGARQALARVQHKQQQLPDGTGRDLNAAEALQRRHCAYEHDIQALSPQVQQVQDDGHRLQKAYAGDKAEEIGRHMQAVAEAWAQLQGSSAARRQLLLDTTDKFRFFKAVRELMLWMDEVNLQMDAQERPRDVSSADLVIKNQQGIKAEIEARADRFSSCIDMGKELLARSHYAAEEISEKLSQLQARRQETAEKWQEKMDWLQLVLEVLVFGRDAGMAEAWLCSQEPLVRSAELGCTVDEVESLIKRHEAFQKSAVAWEERFCALEKLTALEEREKERKRKREEEERRKQPPAPEPTASVPPGDLVGGQTASDTTWDGTQPRPPPSTQAPSVNGVCTDGEPSQPLLGQQRLEHSSFPEGPGPGSGDEANGPRGERQTRTRGPAPSAMPQSRSTESAHAATLPPRGPEPSAQEQMEGMLCRKQEMEAFGKKAANRSWQNVYCVLRRGSLGFYKDAKAASAGVPYHGEVPVSLARAQGSVAFDYRKRKHVFKLGLQDGKEYLFQAKDEAEMSSWLRVVNAAIATASSASGEPEEPVVPSTTRGMTRAMTMPPVSPVGAEGPVVLRSKDGREREREKRFSFFKKNK

SEQ ID NO: 82920 - protein, 2390 aa, Homo sapiens; identical to SEQ ID NO: 82919
  Payload ID: 16502
  Gene Symbol: SPTBN2
  Gene Name: spectrin, beta, non-erythrocytic 2
  Uniprot ID: O15020
  ENSP ID: ENSP00000432568

SEQ ID NO: 82921 - protein, 2365 aa, Homo sapiens
  Payload ID: 16502
  Gene Symbol: SPTBN2
  Gene Name: spectrin, beta, non-erythrocytic 2
  Uniprot ID: O15020
  ENSP ID: ENSP00000433593
MSSTLSPTDFDSLEIQGQYSDINNRWDLPDSDWDNDSSSARLFERSRIKALADEREAVQKKTFTKWVNSHLARVTCRVGDLYSDLRDGRNLLRLLEVLSGEILPKPTKGRMRIHCLENVDKALQFLKEQKVHLENMGSHDIVDGNHRLTLGLVWTIILRFQIQDISVETEDNKEKKSAKDALLLWCQMKTAGYPNVNVHNFTTSWRDGLAFNAIVHKHRPDLLDFESLKKCNAHYNLQNAFNLAEKELGLTKLLDPEDVNVDQPDEKSIITYVATYYHYFSKMKALAVEGKRIGKVLDHAMEAERLVEKYESLASELLQWIEQTIVTLNDRQLANSLSGVQNQLQSFNSYRTVEKPPKFTEKGNLEVLLFTIQSKLRANNQKVYTPREGRLISDINKAWERLEKAEHERELALRTELIRQEKLEQLAARFDRKAAMRETWLSENQRLVSQDNFGLELAAVEAAVRKHEAIETDIVAYSGRVQAVDAVAAELAAERYHDIKRIAARQHNVARLWDFLRQMVAARRERLLLNLELQKVFQDLLYLMDWMEEMKGRLQSQDLGRHLAGVEDLLQLHELVEADIAVQAERVRAVSASALRFCNPGKEYRPCDPQLVSERVAKLEQSYEALCELAAARRARLEESRRLWRFLWEVGEAEAWVREQQHLLASADTGRDLTGALRLLNKHTALRGEMSGRLGPLKLTLEQGQQLVAEGHPGASQASARAAELQAQWERLEALAEERAQRLAQAASLYQFQADANDMEAWLVDALRLVSSPELGHDEFSTQALARQHRALEEEIRSHRPTLDALREQAAALPPTLSRTPEVQSRVPTLERHYEELQARAGERARALEAALALYTMLSEAGACGLWVEEKEQWLNGLALPERLEDLEVVQQRFETLEPEMNTLAAQITAVNDIAEQLLKANPPGKDRIVNTQEQLNHRWQQFRRLADGKKAALTSALSIQNYHLECTETQAWMREKTKVIESTQGLGNDLAGVLALQRKLAGTERDLEAIAARVGELTREANALAAGHPAQAVAINARLREVQTGWEDLRATMRRREESLGEARRLQDFLRSLDDFQAWLGRTQTAVASEEGPATLPEAEALLAQHAALRGEVERAQSEYSRLRALGEEVTRDQADPQCLFLRQRLEALGTGWEELGRMWESRQGRLAQAHGFQGFLRDARQAEGVLSSQEYVLSHTEMPGTLQAADAAIKKLEDFMSTMDANGERIHGLLEAGRQLVSEGNIHADKIREKADSIERRHKKNQDAAQQFLGRLRDNREQQHFLQDCHELKLWIDEKMLTAQDVSYDEARNLHTKWQKHQAFMAELAANKDWLDKVDKEGRELTLEKPELKALVSEKLRDLHRRWDELETTTQAKARSLFDANRAELFAQSCCALESWLESLQAQLHSDDYGKDLTSVNILLKKQQMLEWEMAVREKEVEAIQAQAKALAQEDQGAGEVERTSRAVEEKFRALCQPMRERCRRLQASREQHQFHRDVEDEILWVTERLPMASSMEHGKDLPSVQLLMKKNQTLQKEIQGHEPRIADLRERQRALGAAAAGPELAELQEMWKRLGHELELRGKRLEDALRAQQFYRDAAEAEAWMGEQELHMMGQEKAKDELSAQAEVKKHQVLEQALADYAQTIHQLAASSQDMIDHEHPESTRISIRQAQVDKLYAGLKELAGERRERLQEHLRLCQLRRELDDLEQWIQEREVVAASHELGQDYEHVTMLRDKFREFSRDTSTIGQERVDSANALANGLIAGGHAARATVAEWKDSLNEAWADLLELLDTRGQVLAAAYELQRFLHGARQALARVQHKQQQLPDGTGRDLNAAEALQRRHCAYEHDIQALSPQVQQVQDDGHRLQKAYAGDKAEEIGRHMQAVAEAWAQLQGSSAARRQLLLDTTDKFRFFKAVRELMLWMDEVNLQMDAQERPRDVSSADLVIKNQQGIKAEIEARADRFSSCIDMGKELLARSHYAAEEISEKLSQLQARRQETAEKWQEKMDWLQLVLEVLVFGRDAGMAEAWLCSQEPLVRSAELGCTVDEVESLIKRHEAFQKSAVAWEERFCALEKLTALEEREKERKRKREEEERRKQPPAPEPTASVPPGDLVGGQTASDTTWDGTQPRPPPSTQAPSVNGVCTDGEPSQPLLGQQRLEHSSFPEGPGPGSGDEANGPRGERQTRTRGPAPSAMPQSRSTESAHAATLPPRGPEPSAQEQMEGMLCRKQEMEAFGKKAANRSWQNVYCVLRRGSLGFYKDAKAASAGVPYHGEVPVSLARAQGSVAFDYRKRKHVFKLGLQDGKEYLFQAKDEVSCPSCSSLSVPFQKLPAADSPSFPVLPLFPGLVLCGKTGCVRRPHQAALPV

SEQ ID NO: 82922 - protein, 117 aa, Homo sapiens
  Payload ID: 16502
  Gene Symbol: SPTBN2
  Gene Name: spectrin, beta, non-erythrocytic 2
  ENSP ID: ENSP00000433631
MSSTLSPTDFDSLEIQGQYSDINNRWDLPDSDWDNDSSSARLFERSRIKALADEREAVQKKTFTKWVNSHLARVTCRVGDLYSDLRDGRNLLRLLEVLSGEILPKPTKGRMRIHCLE

SEQ ID NO: 82923 - protein, 934 aa, Homo sapiens
  Payload ID: 16502
  Gene Symbol: SPTBN2
  Gene Name: spectrin, beta, non-erythrocytic 2
  ENSP ID: ENSP00000480692
MSSTLSPTDFDSLEIQGQYSDINNRWDLPDSDWDNDSSSARLFERSRIKALADEREAVQKKTFTKWVNSHLARVTCRVGDLYSDLRDGRNLLRLLEVLSGEILPKPTKGRMRIHCLENVDKALQFLKEQKVHLENMGSHDIVDGNHRLTLGLVWTIILRFQIQDISVETEDNKEKKSAKDALLLWCQMKTAGYPNVNVHNFTTSWRDGLAFNAIVHKHRPDLLDFESLKKCNAHYNLQNAFNLAEKELGLTKLLDPEDVNVDQPDEKSIITYVATYYHYFSKMKALAVEGKRIGKVLDHAMEAERLVEKYESLASELLQWIEQTIVTLNDRQLANSLSGVQNQLQSFNSYRTVEKPPKFTEKGNLEVLLFTIQSKLRANNQKVYTPREGRLISDINKAWERLEKAEHERELALRTELIRQEKLEQLAARFDRKAAMRETWLSENQRLVSQDNFGLELAAVEAAVRKHEAIETDIVAYSGRVQAVDAVAAELAAERYHDIKRIAARQHNVARLWDFLRQMVAARRERLLLNLELQKVFQDLLYLMDWMEEMKGRLQSQDLGRHLAGVEDLLQLHELVEADIAVQAERVRAVSASALRFCNPGKEYRPCDPQLVSERVAKLTALEEREKERKRKREEEERRKQPPAPEPTASVPPGDLVGGQTASDTTWDGTQPRPPPSTQAPSVNGVCTDGEPSQPLLGQQRLEHSSFPEGPGPGSGDEANGPRGERQTRTRGPAPSAMPQSRSTESAHAATLPPRGPEPSAQEQMEGMLCRKQEMEAFGKKAANRSWQNVYCVLRRGSLGFYKDAKAASAGVPYHGEVPVSLARAQGSVAFDYRKRKHVFKLGLQDGKEYLFQAKDEAEMSSWLRVVNAAIATASSASGEPEEPVVPSTTRGMTRAMTMPPVSPVGAEGPVVLRSKDGREREREKRFSFFKKNK

SEQ ID NO: 82924 - protein, 934 aa, Homo sapiens; identical to SEQ ID NO: 82923
  Payload ID: 16502
  Gene Symbol: SPTBN2
  Gene Name: spectrin, beta, non-erythrocytic 2
  ENSP ID: ENSP00000482000

SEQ ID NO: 82925 - protein, 2564 aa, Homo sapiens
  Payload ID: 16503
  Gene Symbol: SPTBN4
  Gene Name: spectrin, beta, non-erythrocytic 4
  Uniprot ID: Q9H254
  ENSP ID: ENSP00000263373
MAQVPGEVDNMEGLPAPNNNPAARWESPDRGWEREQPAASTAAASLFECSRIKALADEREAVQKKTFTKWVNSHLARVGCHIGDLYVDLRDGFVLTRLLEVLSGEQLPRPTRGRMRIHSLENVDKALQFLKEQRVHLENVGSHDIVDGNHRLTLGLVWTIILRFQIQVIKIETEDNRETRSAKDALLLWCQMKTAGYPEVNIQNFTTSWRDGLAFNALIHRHRPDLVDFSKLTKSNANYNLQRAFRTAEQHLGLARLLDPEDVNMEAPDEKSIITYVVSFYHYFSKMKALAVEGKRIGKVLDQVLEVGKIIERYEELAAELLAWIHRTVGLISNQKFANSLSGVQQQLQAFTAYCTLEKPVKFQEKGNLEVLLFSIQSKLRACNRRLFVPREGCGIWDIDKAWGELEKAEHEREAALRAELIRQEKLELLAQRFDHKVAMRESWLNENQRLVSQDNFGYELPAVEAAMKKHEAIEADIAAYEERVQGVAELAQALAAEGYYDIRRVAAQRDSVLRQWALLTGLVGARRTRLEQNLALQKVFQEMVYMVDWMEEMQAQLLSRECGQHLVEADDLLQKHGLLEGDIAAQSERVEALNAAALRFSQLQGYQPCDPQVICNRVNHVHGCLAELQEQAARRRAELEASRSLWALLQELEEAESWARDKERLLEAAGGGGAAGAAGAAGTAGGAHDLSSTARLLAQHKILQGELGGRRALLQQALRCGEELVAAGGAVGPGADTVHLVGLAERAASARRRWQRLEEAAARRERRLQEARALHQFGADLDGLLDWLRDAYRLAAAGDFGHDEASSRRLARQHRALTGEVEAHRGPVSGLRRQLATLGGASGAGPLVVALQVRVVEAEQLFAEVTEVAALRRQWLRDALAVYRMFGEVHACELWIGEKEQWLLSMRVPDSLDDVEVVQHRFESLDQEMNSLMGRVLDVNHTVQELVEGGHPSSDEVRSCQDHLNSRWNRIVELVEQRKEEMSAVLLVENHVLEVAEVRAQVREKRRAVESAPRAGGALQWRLSGLEAALQALEPRQAALLEEAALLAERFPAQAARLHQGAEELGAEWGALASAAQACGEAVAAAGRLQRFLHDLDAFLDWLVRAQEAAGGSEGPLPNSLEEADALLARHAALKEEVDQREEDYARIVAASEALLAADGAELGPGLALDEWLPHLELGWHKLLGLWEARREALVQAHIYQLFLRDLRQALVVLRNQEMALSGAELPGTVESVEEALKQHRDFLTTMELSQQKMQVAVQAAEGLLRQGNIYGEQAQEAVTRLLEKNQENQLRAQQWMQKLHDQLELQHFLRDCHELDGWIHEKMLMARDGTREDNHKLHKRWLRHQAFMAELAQNKEWLEKIEREGQQLMQEKPELAASVRKKLGEIRQCWAELESTTQAKARQLFEASKADQLVQSFAELDKKLLHMESQLQDVDPGGDLATVNSQLKKLQSMESQVEEWYREVGELQAQTAALPLEPASKELVGERQNAVGERLVRLLEPLQERRRLLLASKELHQVAHDLDDELAWVQERLPLAMQTERGNGLQAVQQHIKKNQGLRREIQAHGPRLEEVLERAGALASLRSPEAEAVRRGLEQLQSAWAGLREAAERRQQVLDAAFQVEQYYFDVAEVEAWLGEQELLMMSEDKGKDEQSTLQLLKKHLQLEQGVENYEESIAQLSRQCRALLEMGHPDSEQISRRQSQVDRLYVALKELGEERRVALEQQYWLYQLSRQVSELEHWIAEKEVVAGSPELGQDFEHVSVLQEKFSEFASETGMAGRERLAAVNQMVDELIECGHTAAATMAEWKDGLNEAWAELLELMGTRAQLLAASRELHKFFSDARELQGQIEEKRRRLPRLTTPPEPRPSASSMQRTLRAFEHDLQLLVSQVRQLQEGAAQLRTVYAGEHAEAIASREQEVLQGWKELLSACEDARLHVSSTADALRFHSQVRDLLSWMDGIASQIGAADKPRDVSSVEVLMNYHQGLKTELEARVPELTTCQELGRSLLLNKSAMADEIQAQLDKLGTRKEEVSEKWDRHWEWLQQMLEVHQFAQEAVVADAWLTAQEPLLQSRELGSSVDEVEQLIRRHEAFRKAAAAWEERFSSLRRLTTIEKIKAEQSKQPPTPLLGRKFFGDPTELAAKAAPLLRPGGYERGLEPLARRASDTLSAEVRTRVGYVRQELKPERLQPRIDRLPEIPGRVEPAALPAAPEDAAETPATPAAAEQVRPRPERQESADRAEELPRRRRPERQESVDQSEEAARRRRPERQESAEHEAAHSLTLGRYEQMERRRERRERRLERQESSEQEMPIRGDLVKGKATLADIVEQLQEKEAGPGLPAGPSLPQPRELPPGRLPNGLELPERTPRPDRPRARDRPKPRRRPRPREGGEGGGSRRSRSAPAQGGSAPAPPPPPTHTVQHEGFLLRKRELDANRKSSNRSWVSLYCVLSKGELGFYKDSKGPASGSTHGGEPLLSLHKATSEVASDYKKKKHVFKLQTQDGSEFLLQAKDEEEMNGWLEAVASSVAEHAEIARWGQTLPTTSSTDEGNPKREGGDRRASGRRK

SEQ ID NO: 82926 - protein, 2564 aa, Homo sapiens
  Payload ID: 16503
  Gene Symbol: SPTBN4
  Gene Name: spectrin, beta, non-erythrocytic 4
  ENSP ID: ENSP00000340345
MAQVPGEVDNMEGLPAPNNNPAARWESPDRGWEREQPAASTAAASLFECSRIKALADEREAVQKKTFTKWVNSHLARVGCHIGDLYVDLRDGFVLTRLLEVLSGEQLPRPTRGRMRIHSLENVDKALQFLKEQRVHLENVGSHDIVDGNHRLTLGLVWTIILRFQIQVIKIETEDNRETRSAKDALLLWCQMKTAGYPEVNIQNFTTSWRDGLAFNALIHRHRPDLVDFSKLTKSNANYNLQRAFRTAEQHLGLARLLDPEDVNMEAPDEKSIITYVVSFYHYFSKMKALAVEGKRIGKVLDQVLEVGKIIERYEELAAELLAWIHRTVGLISNQKFANSLSGVQQQLQAFTAYCTLEKPVKFQEKGNLEVLLFSIQSKLRACNRRLFVPREGCGIWDIDKAWGELEKAEHEREAALRAELIRQEKLELLAQRFDHKVAMRESWLNENQRLVSQDNFGYELPAVEAAMKKHEAIEADIAAYEERVQGVAELAQALAAEGYYDIRRVAAQRDSVLRQWALLTGLVGARRTRLEQNLALQKVFQEMVYMVDWMEEMQAQLLSRECGQHLVEADDLLQKHGLLEGDIAAQSERVEALNAAALRFSQLQGYQPCDPQVICNRVNHVHGCLAELQEQAARRRAELEASRSLWALLQELEEAESWARDKERLLEAAGGGGAAGAAGAAGTAGGAHDLSSTARLLAQHKILQGELGGRRALLQQALRCGEELVAAGGAVGPGADTVHLVGLAERAASARRRWQRLEEAAARRERRLQEARALHQFGADLDGLLDWLRDAYRLAAAGDFGHDEASSRRLARQHRALTGEVEAHRGPVSGLRRQLATLGGASGAGPLVVALQVRVVEAEQLFAEVTEVAALRRQWLRDALAVYRMFGEVHACELWIGEKEQWLLSMRVPDSLDDVEVVQHRFESLDQEMNSLMGRVLDVNHTVQELVEGGHPSSDEVRSCQDHLNSRWNRIVELVEQRKEEMSAVLLVENHVLEVAEVRAQVREKRRAVESAPRAGGALQWRLSGLEAALQALEPRQAALLEEAALLAERFPAQAARLHQGAEELGAEWGALASAAQACGEAVAAAGRLQRFLHDLDAFLDWLVRAQEAAGGSEGPLPNSLEEADALLARHAALKEEVDQREEDYARIVAASEALLAADGAELGPGLALDEWLPHLELGWHKLLGLWEARREALVQAHIYQLFLRDLRQALVVLRNQEMALSGAELPGTVESVEEALKQHRDFLTTMELSQQKMQVAVQAAEGLLRQGNIYGEQAQEAVTRLLEKNQENQLRAQQWMQKLHDQLELQHFLRDCHELDGWIHEKMLMARDGTREDNHKLHKRWLRHQAFMAELAQNKEWLEKIEREGQQLMQEKPELAASVRKKLGEIRQCWAELESTTQAKARQLFEASKADQLVQSFAELDKKLLHMESQLQDVDPGGDLATVNSQLKKLQSMESQVEEWYREVGELQAQTAALPLEPASKELVGERQNAVGERLVRLLEPLQERRRLLLASKELHQVAHDWTTSWAWVQERLPLAMQTERGNGLQAVQQHIKKNQGLRREIQAHGPRLEEVLERAGALASLRSPEAEAVRRGLEQLQSAWAGLREAAERRQQVLDAAFQVEQYYFDVAEVEAWLGEQELLMMSEDKGKDEQSTLQLLKKHLQLEQGVENYEESIAQLSRQCRALLEMGHPDSEQISRRQSQVDRLYVALKELGEERRVALEQQYWLYQLSRQVSELEHWIAEKEVVAGSPELGQDFEHVSVLQEKFSEFASETGMAGRERLAAVNQMVDELIECGHTAAATMAEWKDGLNEAWAELLELMGTRAQLLAASRELHKFFSDARELQGQIEEKRRRLPRLTTPPEPRPSASSMQRTLRAFEHDLQLLVSQVRQLQEGAAQLRTVYAGEHAEAIASREQEVLQGWKELLSACEDARLHVSSTADALRFHSQVRDLLSWMDGIASQIGAADKPRDVSSVEVLMNYHQGLKTELEARVPELTTCQELGRSLLLNKSAMADEIQAQLDKLGTRKEEVSEKWDRHWEWLQQMLEVHQFAQEAVVADAWLTAQEPLLQSRELGSSVDEVEQLIRRHEAFRKAAAAWEERFSSLRRLTTIEKIKAEQSKQPPTPLLGRKFFGDPTELAAKAAPLLRPGGYERGLEPLARRASDTLSAEVRTRVGYVRQELKPERLQPRIDRLPEIPGRVEPAALPAAPEDAAETPATPAAAEQVRPRPERQESADRAEELPRRRRPERQESVDQSEEAARRRRPERQESAEHEAAHSLTLGRYEQMERRRERRERRLERQESSEQEMPIRGDLVKGKATLADIVEQLQEKEAGPGLPAGPSLPQPRELPPGRLPNGLELPERTPRPDRPRARDRPKPRRRPRPREGGEGGGSRRSRSAPAQGGSAPAPPPPPTHTVQHEGFLLRKRELDANRKSSNRSWVSLYCVLSKGELGFYKDSKGPASGSTHGGEPLLSLHKATSEVASDYKKKKHVFKLQTQDGSEFLLQAKDEEEMNGWLEAVASSVAEHAEIARWGQTLPTTSSTDEGNPKREGGDRRASGRRK

SEQ ID NO: 82927 - protein, 678 aa, Homo sapiens
  Payload ID: 16503
  Gene Symbol: SPTBN4
  Gene Name: spectrin, beta, non-erythrocytic 4
  Uniprot ID: Q9H254
  ENSP ID: ENSP00000375877
MLMARDGTREDNHKLHKRWLRHQAFMAELAQNKEWLEKIEREGQQLMQEKPELAASVRKKLGEIRQCWAELESTTQAKARQLFEASKADQLVQSFAELDKKLLHMESQLQDVDPGGDLATVNSQLKKLQSMESQVEEWYREVGELQAQTAALPLEPASKELVGERQNAVGERLVRLLEPLQERRRLLLASKELHQVAHDLDDELAWVQERLPLAMQTERGNGLQAVQQHIKKNQGLRREIQAHGPRLEEVLERAGALASLRSPEAEAVRRGLEQLQSAWAGLREAAERRQQVLDAAFQVEQYYFDVAEVEAWLGEQELLMMSEDKGKDEQSTLQLLKKHLQLEQGVENYEESIAQLSRQCRALLEMGHPDSEQISRRQSQVDRLYVALKELGEERRVALEQQYWLYQLSRQVSELEHWIAEKEVVAGSPELGQDFEHVSVLQEKFSEFASETGMAGRERLAAVNQMVDELIECGHTAAATMAEWKDGLNEAWAELLELMGTRAQLLAASRELHKFFSDARELQGQIEEKRRRLPRLTTPPEPRPSASSMQRTLRAFEHDLQLLVSQVRQLQEGAAQLRTVYAGEHAEAIASREQEVLQGWKELLSACEDARLHVSSTADALRFHSQVRDLLSWMDGIASQIGAADKPRCPSSLLGLPASPWWPTPATPSPLTAPFSME

SEQ ID NO: 82928 - protein, 2564 aa, Homo sapiens; identical to SEQ ID NO: 82926
  Payload ID: 16503
  Gene Symbol: SPTBN4
  Gene Name: spectrin, beta, non-erythrocytic 4
  ENSP ID: ENSP00000375879

SEQ ID NO: 82929 - protein, 2564 aa, Homo sapiens; identical to SEQ ID NO: 82925
  Payload ID: 16503
  Gene Symbol: SPTBN4
  Gene Name: spectrin, beta, non-erythrocytic 4
  Uniprot ID: Q9H254
  ENSP ID: ENSP00000469242

SEQ ID NO: 82930 - protein, 2002 aa, Homo sapiens
  Payload ID: 16503
  Gene Symbol: SPTBN4
  Gene Name: spectrin, beta, non-erythrocytic 4
  ENSP ID: ENSP00000470693
MAQVPGEVDNMEGLPAPNNNPAARWESPDRGWEREQPAASTAAASLFECSRIKALADEREAVQKKTFTKWVNSHLARVGCHIGDLYVDLRDGFVLTRLLEVLSGEQLPRPTRGRMRIHSLENVDKALQFLKEQRVHLENVGSHDIVDGNHRLTLGLVWTIILRFQIQVIKIETEDNRETRSAKDALLLWCQMKTAGYPEVNIQNFTTSWRDGLAFNALIHRHRPDLVDFSKLTKSNANYNLQRAFRTAEQHLGLARLLDPEDVNMEAPDEKSIITYVVSFYHYFSKMKALAVEGKRIGKVLDQVLEVGKIIERYEELAAELLAWIHRTVGLISNQKFANSLSGVQQQLQAFTAYCTLEKPVKFQEKGNLEVLLFSIQSKLRACNRRLFVPREGCGIWDIDKAWGELEKAEHEREAALRAELIRQEKLELLAQRFDHKVAMRESWLNENQRLVSQDNFGYELPAVEAAMKKHEAIEADIAAYEERVQGVAELAQALAAEGYYDIRRVAAQRDSVLRQWALLTGLVGARRTRLEQNLALQKVFQEMVYMVDWMEEMQAQLLSRECGQHLVEADDLLQKHGLLEGDIAAQSERVEALNAAALRFSQLQGYQPCDPQVICNRVNHVHGCLAELQEQAARRRAELEASRSLWALLQELEEAESWARDKERLLEAAGGGGAAGAAGAAGTAGGAHDLSSTARLLAQHKILQGELGGRRALLQQALRCGEELVAAGGAVGPGADTVHLVGLAERAASARRRWQRLEEAAARRERRLQEARALHQFGADLDGLLDWLRDAYRLAAAGDFGHDEASSRRLARQHRALTGEVEAHRGPVSGLRRQLATLGGASGAGPLVVALQVRVVEAEQLFAEVTEVAALRRQWLRDALAVYRMFGEVHACELWIGEKEQWLLSMRVPDSLDDVEVVQHRFESLDQEMNSLMGRVLDVNHTVQELVEGGHPSSDEVRSCQDHLNSRWNRIVELVEQRKEEMSAVLLVENHVLEVAEVRAQVREKRRAVESAPRAGGALQWRLSGLEAALQALEPRQAALLEEAALLAERFPAQAARLHQGAEELGAEWGALASAAQACGEAVAAAGRLQRFLHDLDAFLDWLVRAQEAAGGSEGPLPNSLEEADALLARHAALKEEVDQREEDYARIVAASEALLAADGAELGPGLALDEWLPHLELGWHKLLGLWEARREALVQAHIYQLFLRDLRQALVVLRNQEMALSGAELPGTVESVEEALKQHRDFLTTMELSQQKMQVAVQAAEGLLRQGNIYGEQAQEAVTRLLEKNQENQLRAQQWMQKLHDQLELQHFLRDCHELDGWIHEKMLMARDGTREDNHKLHKRWLRHQAFMAELAQNKEWLEKIEREGQQLMQEKPELAASVRKKLGEIRQCWAELESTTQAKARQLFEASKADQLVQSFAELDKKLLHMESQLQDVDPGGDLATVNSQLKKLQSMESQVEEWYREVGELQAQTAALPLEPASKELVGERQNAVGERLVRLLEPLQERRRLLLASKELHQVAHDLDDELAWVQERLPLAMQTERGNGLQAVQQHIKKNQGLRREIQAHGPRLEEVLERAGALASLRSPEAEAVRRGLEQLQSAWAGLREAAERRQQVLDAAFQVEQYYFDVAEVEAWLGEQELLMMSEDKGKDEQSTLQLLKKHLQLEQGVENYEESIAQLSRQCRALLEMGHPDSEQISRRQSQVDRLYVALKELGEERRVALEQQYWLYQLSRQVSELEHWIAEKEVVAGSPELGQDFEHVSVLQEKFSEFASETGMAGRERLAAVNQMVDELIECGHTAAATMAEWKDGLNEAWAELLELMGTRAQLLAASRELHKFFSDARELQGQIEEKRRRLPRLTTPPEPRPSASSMQRTLRAFEHDLQLLVSQVRQLQEGAAQLRTVYAGEHAEAIASREQEVLQGWKELLSACEDARLHVSSTADALRFHSQVRDLLSWMDGIASQIGAADKPRCPSSLLGLPASPWWPTPATPSPLTAPFSME

SEQ ID NO: 82931 - protein, 701 aa, Homo sapiens
  Payload ID: 16503
  Gene Symbol: SPTBN4
  Gene Name: spectrin, beta, non-erythrocytic 4
  ENSP ID: ENSP00000472136
PCDPQVICNRVNHVHGCLAELQEQAARRRAELEASRSLWALLQELEEAESWARDKERLLEAAGGGGAAGAAGAAGTAGGAHDLSSTARLLAQHKILQGELGGRRALLQQALRCGEELVAAGGAVGPGADTVHLVGLAERAASARRRWQRLEEAAARRERRLQEARALHQFGADLDGLLDWLRDAYRLAAAGDFGHDEASSRRLARQHRALTGEVEAHRGPVSGLRRQLATLGGASGAGPLVVALQVRVVEAEQLFAEVTEVAALRRQWLRDALAVYRMFGEVHACELWIGEKEQWLLSMRVPDSLDDVEVVQHRFESLDQEMNSLMGRVLDVNHTVQELVEGGHPSSDEVRSCQDHLNSRWNRIVELVEQRKEEMSAVLLVENHVLEVAEVRAQVREKRRAVESAPRAGGALQWRLSGLEAALQALEPRQAALLEEAALLAERFPAQAARLHQGAEELGAEWGALASAAQACGEAVAAAGRLQRFLHDLDAFLDWLVRAQEAAGGSEGPLPNSLEEADALLARHAALKEEVDQREEDYARIVAASEALLAADGAELGPGLALDEWLPHLELGWHKLLGLWEARREALVQAHIYQLFLRDLRQALVVLRNQEMALSGAELPGTVESVEEALKQHRDFLTTMELSQQKMQVAVQAAEGLLRQGNIYGEQAQEAVTRLLEKCLIIHPALLHPPWEPPDLPRSSS

SEQ ID NO: 82932 - protein, 3674 aa, Homo sapiens
  Payload ID: 16504
  Gene Symbol: SPTBN5
  Gene Name: spectrin, beta, non-erythrocytic 5
  Uniprot ID: Q9NRC6
  ENSP ID: ENSP00000317790
MAGQPHSPRELLGAAGHRSRRPSTELRVPPSPSLTMDSQYETGHIRKLQARHMQMQEKTFTKWINNVFQCGQAGIKIRNLYTELADGIHLLRLLELISGEALPPPSRGRLRVHFLENSSRALAFLRAKVPVPLIGPENIVDGDQTLILGLIWVIILRFQISHISLDKEEFGASAALLSTKEALLVWCQRKTASYTNVNITDFSRSWSDGLGFNALIHAHRPDLLDYGSLRPDRPLHNLAFAFLVAEQELGIAQLLDPEDVAAAQPDERSIMTYVSLYYHYCSRLHQGQTVQRRLTKILLQLQETELLQTQYEQLVADLLRWIAEKQMQLEARDFPDSLPAMRQLLAAFTIFRTQEKPPRLQQRGAAEALLFRLQTALQAQNRRPFLPHEGLGLAELSQCWAGLEWAEAARSQALQQRLLQLQRLETLARRFQHKAALRESFLKDAEQVLDQARAPPASLATVEAAVQRLGMLEAGILPQEGRFQALAEIADILRQEQYHSWADVARRQEEVTVRWQRLLQHLQGQRKQVADMQAVLSLLQEVEAASHQLEELQEPARSTACGQQLAEVVELLQRHDLLEAQVSAHGAHVSHLAQQTAELDSSLGTSVEVLQAKARTLAQLQQSLVALVRARRALLEQTLQRAEFLRNCEEEEAWLKECGQRVGNAALGRDLSQIAGALQKHKALEAEVHRHQAVCVDLVRRGRDLSARRPPTQPDPGERAEAVQGGWQLLQTRVVGRGARLQTALLVLQYFADAAEAASWLRERRSSLERASCGQDQAAAETLLRRHVRLERVLRAFAAELRRLEEQGRAASARASLFTVNSALSPPGESLRNPGPWSEASCHPGPGDAWKMALPAEPDPDFDPNTILQTQDHLSQDYESLRALAQLRRARLEEAMALFGFCSSCGELQLWLEKQTVLLQRVQPQADTLEVMQLKYENFLTALAVGKGLWAEVSSSAEQLRQRYPGNSTQIQRQQEELSQRWGQLEALKREKAVQLAHSVEVCSFLQECGPTQVQLRDVLLQLEALQPGSSEDTCHALQLAQKKTLVLERRVHFLQSVVVKVEEPGYAESQPLQGQVETLQGLLKQVQEQVAQRARRQAETQARQSFLQESQQLLLWAESVQAQLRSKEVSVDVASAQRLLREHQDLLEEIHLWQERLQQLDAQSQPMAALDCPDSQEVPNTLRVLGQQGQELKVLWEQRQQWLQEGLELQKFGREVDGFTATCANHQAWLHLDNLGEDVREALSLLQQHREFGRLLSTLGPRAEALRAHGEKLVQSQHPAAHTVREQLQSIQAQWTRLQGRSEQRRRQLLASLQLQEWKQDVAELMQWMEEKGLMAAHEPSGARRNILQTLKRHEAAESELLATRRHVEALQQVGRELLSRRPCGQEDIQTRLQGLRSKWEALNRKMTERGDELQQAGQQEQLLRQLQDAKEQLEQLEGALQSSETGQDLRSSQRLQKRHQQLESESRTLAAKMAALASMAHGMAASPAILEETQKHLRRLELLQGHLAIRGLQLQASVELHQFCHLSNMELSWVAEHMPHGSPTSYTECLNGAQSLHRKHKELQVEVKAHQGQVQRVLSSGRSLAASGHPQAQHIVEQCQELEGHWAELERACEARAQCLQQAVTFQQYFLDVSELEGWVEEKRPLVSSRDYGRDEAATLRLINKHQALQEELAIYWSSMEELDQTAQTLTGPEVPEQQRVVQERLREQLRALQELAATRDRELEGTLRLHEFLREAEDLQGWLASQKQAAKGGESLGEDPEHALHLCTKFAKFQHQVEMGSQRVAACRLLAESLLERGHSAGPMVRQRQQDLQTAWSELWELTQARGHALRDTETTLRVHRDLLEVLTQVQEKATSLPNNVARDLCGLEAQLRSHQGLERELVGTERQLQELLETAGRVQKLCPGPQAHAVQQRQQAVTQAWAVLQRRMEQRRAQLERARLLARFRTAVRDYASWAARVRQDLQVEESSQEPSSGPLKLSAHQWLRAELEAREKLWQQATQLGQQALLAAGTPTKEVQEELRALQDQRDQVYQTWARKQERLQAEQQEQLFLRECGRLEEILAAQEVSLKTSALGSSVEEVEQLIRKHEVFLKVLTAQDKKEAALRERLKTLRRPRVRDRLPILLQRRMRVKELAESRGHALHASLLMASFTQAATQAEDWIQAWAQQLKEPVPPGDLRDKLKPLLKHQAFEAEVQAHEEVMTSVAKKGEALLAQSHPRAGEVSQRLQGLRKHWEDLRQAMALRGQELEDRRNFLEFLQRVDLAEAWIQEKEVKMNVGDLGQDLEHCLQLRRRLREFRGNSAGDTVGDACIRSISDLSLQLKNRDPEEVKIICQRRSQLNNRWASFHGNLLRYQQQLEGALEIHVLSRELDNVTKRIQEKEALIQALDCGKDLESVQRLLRKHEELEREVHPIQAQVESLEREVGRLCQRSPEAAHGLRHRQQEVAESWWQLRSRAQKRREALDALHQAQKLQAMLQELLVSAQRLRAQMDTSPAPRSPVEARRMLEEHQECKAELDSWTDSISLARSTGQQLLTAGHPFSSDIRQVLAGLEQELSSLEGAWQEHQLQLQQALELQLFLSSVEKMERWLCSKEDSLASEGLWDPLAPMEPLLWKHKMLEWDLEVQAGKISALEATARGLHQGGHPEAQSALGRCQAMLLRKEALFRQAGTRRHRLEELRQLQAFLQDSQEVAAWLREKNLVALEEGLLDTAMLPAQLQKQQNFQAELDASMHQQQELQREGQRLLQGGHPASEAIQERLEELGALWGELQDNSQKKVAKLQKACEALRLRRSMEELENWLEPIEVELRAPTVGQALPGVGELLGTQRELEAAVDKKARQAEALLGQAQAFVREGHCLAQDVEEQARRLLQRFKSLREPLQERRTALEARSLLLKFFRDADEEMAWVQEKLPLAAAQDYGQSLSAVRHLQEQHQNLESEMSSHEALTRVVLGTGYKLVQAGHFAAHEVAARVQQLEKAMAHLRAEAARRRLLLQQAQEAQQFLTELLEAGSWLAERGHVLDSEDMGHSAEATQALLRRLEATKRDLEAFSPRIERLQQTAALLESRKNPESPKVLAQLQAVREAHAELLRRAEARGHGLQEQLQLHQLERETLLLDAWLTTKAATAESQDYGQDLEGVKVLEEKFDAFRKEVQSLGQAKVYALRKLAGTLERGAPRRYPHIQAQRSRIEAAWERLDQAIKARTENLAAAHEVHSFQQAAAELQGRMQEKTALMKGEDGGHSLSSVRTLQQQHRRLERELEAMEKEVARLQTEACRLGQLHPAAPGGLAKVQEAWATLQAKAQERGQWLAQAAQGHAFLGRCQELLAWAQERQELASSEELAEDVAGAEQLLGQHEELGQEIRECRLQAQDLRQEGQQLVDNSHFMSAEVTECLQELEGRLQELEEAWALRWQRCAESWGLQKLRQRLEQAEAWLACWEGLLLKPDYGHSVSDVELLLHRHQDLEKLLAAQEEKFAQMQKTEMEQELLLQPQELKPGRAGSSLTSFQWRPSGHQGLGAQLAETRDPQDAKGTPTMEGSLEFKQHLLPGGRQPSSSSWDSCRGNLQGSSLSLFLDERMAAEKVASIALLDLTGARCERLRGRHGRKHTFSLRLTSGAEILFAAPSEEQAESWWRALGSTAAQSLSPKLKAKPVSSLNECTTKDARPGCLLRSDP

SEQ ID NO: 82933 - protein, 313 aa, Homo sapiens
  Payload ID: 16505
  Gene Symbol: SPDYA
  Gene Name: speedy/RINGO cell cycle regulator family member A
  Uniprot ID: Q5MJ70
  ENSP ID: ENSP00000335628
MRHNQMCCETPPTVTVYVKSGSNRSHQPKKPITLKRPICKDNWQAFEKNTHNNNKSKRPKGPCLVIQRQDMTAFFKLFDDDLIQDFLWMDCCCKIADKYLLAMTFVYFKRAKFTISEHTRINFFIALYLANTVEEDEEETKYEIFPWALGKNWRKLFPNFLKLRDQLWDRIDYRAIVSRRCCEEVMAIAPTHYIWQRERSVHHSGAVRNYNRDEVQLPRGPSATPVDCSLCGKKRRYVRLGLSSSSSLSSHTAGVTEKHSQDSYNSLSMDIIGDPSQAYTGSEVVNDHQSNKGKKTNFLKKDKSMEWFTGSEE

SEQ ID NO: 82934 - protein, 313 aa, Homo sapiens; identical to SEQ ID NO: 82933
  Payload ID: 16505
  Gene Symbol: SPDYA
  Gene Name: speedy/RINGO cell cycle regulator family member A
  Uniprot ID: Q5MJ70
  ENSP ID: ENSP00000368898

SEQ ID NO: 82935 - protein, 57 aa, Homo sapiens
  Payload ID: 16505
  Gene Symbol: SPDYA
  Gene Name: speedy/RINGO cell cycle regulator family member A
  ENSP ID: ENSP00000395240
  MOD_RES (1)..(1): Any amino acid
XLANTVEEDEEETKYEIFPWALGKNWRKLFPNFLKLRDQLWDRIDYRAIVSRRCCEE

SEQ ID NO: 82936 - protein, 127 aa, Homo sapiens
  Payload ID: 16505
  Gene Symbol: SPDYA
  Gene Name: speedy/RINGO cell cycle regulator family member A
  ENSP ID: ENSP00000414086
MRHNQMCCETPPTVTVYVKSGSNRSHQPKKPITLKRPICKDNWQAFEKNTHNNNKSKRPKGPCLVIQRQDMTAFFKLFDDDLIQDFLWMDCCCKIADKYLLAMTFVYFKRAKFTISEHTRINFFIAL

SEQ ID NO: 82937 - protein, 293 aa, Homo sapiens
  Payload ID: 16506
  Gene Symbol: SPDYC
  Gene Name: speedy/RINGO cell cycle regulator family member C
  Uniprot ID: Q5MJ68
  ENSP ID: ENSP00000366390
MLWAIPELGSPCPISISYEMSDSQDPTTSPVVTTQVELGGCSRQGGGNGFLRFRQHQEVQAFLSLLEDSFVQEFLSKDPCFQISDKYLLAMVLVYFQRAHLKLSEYTHSSLFLALYLANDMEEDLEGPKCEIFPWALGKDWCLRVGKFLHQRDKLWARMGFRAVVSRQCCEEVMAKEPFHWAWTRDRRPHHGGVQRVCPQVPVRLPRGPGLSPPHCSPCGLPQHCSSHLLKPVSSKCPSLTSECHRPPSQNYLSRVKNAWGGDFLIVLPPQMQLEPGTYSLRIFPKPPARPGH

SEQ ID NO: 82938 - protein, 336 aa, Homo sapiens
  Payload ID: 16507
  Gene Symbol: SPDYE1
  Gene Name: speedy/RINGO cell cycle regulator family member E1
  Uniprot ID: Q8NFV5
  ENSP ID: ENSP00000258704
MQKHYTVAWFLYSAPGVDPSPPCRSLGWKRKREWSDESEEEPEKELAPEPEETWVVETLCGLKMKLKQQRVSPILLEHHKDFNSQLAPGVDPSPPHRSFCWKRKMEWWDKSEESEEEPRKVLAPEPEEIWVAEMLCGLKMKLKRRRVSLVLPEHHEAFNRLLEDPVIKRFLAWDKDLRVSDKYLLAMVIAYFSRAGFPSWQYQRLHFFLALYLANDMEEDDEDSKQNIFHFLYGKNRSRIPLLRKRRFQLYRSMNPRARKNRSHIPLVRKRRFQLRRCMNPRARKNRSQIVLFQKRRFHFFCSMSCRAWVSPEELEEIQAYDPEHWVWARDRARLS

SEQ ID NO: 82939 - protein, 285 aa, Homo sapiens
  Payload ID: 16508
  Gene Symbol: SPDYE16
  Gene Name: speedy/RINGO cell cycle regulator family member E16
  ENSP ID: ENSP00000487736
MQKHYTVAWFLYSAPGVDPSPPCRSLGWKRKKEWSDESEEEPEKELAPEPEETWVVEMLCGLKMKLKQQRVSPILPEHHKDFNSQLAPGVDPSPPHRSFCWKRKREWWDESEESLEEEPRKVLAPEPEEIWVAEMLCGLKMKLKRRRVSLVLPEHHEAFNRLLEDPVIKRFLAWDKDLRVSDKYLLAMVIAYFSRAGLPSWQYQRIHFFLALYLANDMEEDDEDPKQNIFYFLKNRSQIALFQKLRFQFFCSMSGRAWVSREELEEIQAYDPEHWVWARDRARLS

SEQ ID NO: 82940 - protein, 312 aa, Homo sapiens
  Payload ID: 16508
  Gene Symbol: SPDYE16
  Gene Name: speedy/RINGO cell cycle regulator family member E16
  Uniprot ID: A6NNV3
  ENSP ID: ENSP00000487772
MQKHYTVAWFLYSAPGVDPSPPCRSLGWKRKKEWSDESEEEPEKELAPEPEETWVVEMLCGLKMKLKQQRVSPILPEHHKDFNSQLAPGVDPSPPHRSFCWKRKREWWDESEESLEEEPRKVLAPEPEEIWVVEMLCGLKMKLKRRRVSLVLPEHHEAFNRLLEDPVIKRFLAWDKDLRVSDKYLLAMVIAYFSRAGLPSWQYQRIHFFLALYLANDMEEDDEDPKQNIFYFLYGKTRSRIPLVRNRRFQLCRCMNPRARKNRSQIALFQKLRFQFFCSMSGRAWVSREELEEIQAYDPEHWVWARDRARLS

SEQ ID NO: 82941 - protein, 312 aa, Homo sapiens
  Payload ID: 16508
  Gene Symbol: SPDYE16
  Gene Name: speedy/RINGO cell cycle regulator family member E16
  ENSP ID: ENSP00000487806
MQKHYTVAWFLYSAPGVDPSPPCRSLGWKRKKEWSDESEEEPEKELAPEPEETWVVEMLCGLKMKLKQQRVSPILPEHHKDFNSQLAPGVDPSPPHRSFCWKRKREWWDESEESLEEEPRKVLAPEPEEIWVAEMLCGLKMKLKRRRVSLVLPEHHEAFNRLLEDPVIKRFLAWDKDLRVSDKYLLAMVIAYFSRAGLPSWQYQRIHFFLALYLANDMEEDDEDPKQNIFYFLYGKTRSRIPLVRNRRFQLCRCLNPRARKNRSQIALFQKLRFQFFCSMSGRAWVSREELEEIQAYDPEHWVWARDRARLS

SEQ ID NO: 82942 - protein, 352 aa, Homo sapiens
  Payload ID: 16508
  Gene Symbol: SPDYE16
  Gene Name: speedy/RINGO cell cycle regulator family member E16
  ENSP ID: ENSP00000488034
MDRTETRFRKRGQIKGKITTSRQPHPQNEQSPQRSTSGYSLQEVVDDEVLGSSAPGVDPSPPCRSLGWKRKKEWSDESEEEPEKELAPEPEETWVVEMLCGLKMKLKQQRVSPILPEHHKDFNSQLAPGVDPSPPHRSFCWKRKREWWDESEESLEEEPRKVLAPEPEEIWVVEMLCGLKMKLKRRRVSLVLPEHHEAFNRLLEDPVIKRFLAWDKDLRVSDKYLLAMVIAYFSRAGLPSWQYQRIHFFLALYLANDMEEDDEDPKQNIFYFLYGKTRSRIPLVRNRRFQLCRCMNPRARKNRSQIALFQKLRFQFFCSMSGRAWVSREELEEIQAYDPEHWVWARDRARLS

SEQ ID NO: 82943 - protein, 352 aa, Homo sapiens
  Payload ID: 16508
  Gene Symbol: SPDYE16
  Gene Name: speedy/RINGO cell cycle regulator family member E16
  ENSP ID: ENSP00000488772
MDRTETRFRKRGQIKGKITTSRQPHPQNEQSPQRSTSGYSLQEVVDDEVLGSSAPGVDPSPPCRSLGWKRKKEWSDESEEEPEKELAPEPEETWVVEMLCGLKMKLKQQRVSPILPEHHKDFNSQLAPGVDPSPPHRSFCWKRKREWWDESEESLEEEPRKVLAPEPEEIWVAEMLCGLKMKLKRRRVSLVLPEHHEAFNRLLEDPVIKRFLAWDKDLRVSDKYLLAMVIAYFSRAGLPSWQYQRIHFFLALYLANDMEEDDEDPKQNIFYFLYGKTRSRIPLVRNRRFQLCRCLNPRARKNRSQIALFQKLRFQFFCSMSGRAWVSREELEEIQAYDPEHWVWARDRARLS

SEQ ID NO: 82944 - protein, 285 aa, Homo sapiens
  Payload ID: 16508
  Gene Symbol: SPDYE16
  Gene Name: speedy/RINGO cell cycle regulator family member E16
  ENSP ID: ENSP00000488825
MQKHYTVAWFLYSAPGVDPSPPCRSLGWKRKKEWSDESEEEPEKELAPEPEETWVVEMLCGLKMKLKQQRVSPILPEHHKDFNSQLAPGVDPSPPHRSFCWKRKREWWDESEESLEEEPRKVLAPEPEEIWVVEMLCGLKMKLKRRRVSLVLPEHHEAFNRLLEDPVIKRFLAWDKDLRVSDKYLLAMVIAYFSRAGLPSWQYQRIHFFLALYLANDMEEDDEDPKQNIFYFLKNRSQIALFQKLRFQFFCSMSGRAWVSREELEEIQAYDPEHWVWARDRARLS

SEQ ID NO: 82945 - protein, 258 aa, Homo sapiens
  Payload ID: 16509
  Gene Symbol: SPDYE2
  Gene Name: speedy/RINGO cell cycle regulator family member E2
  ENSP ID: ENSP00000342628
MEWWDESEESLEEEPRKVLAPEPEEIWVAEMLCGLKMKLKRRRVSLVLPEHHEAFNRLLEDPVIKRFLAWDKDLRVSDKYLLAMVIAYFSRAGFPSWQYQRIHFFLALYLANDMEEDDEDSKQNIFHFLYRKNRSRIPLLRKPWFQLGHSMNPRARKNRSRIPLLRKRRFQLYRSTNPRARKNRSRIPLLRKRRFQLYRSMNSRARKNRSQIVLFQKRRFHFFCSMSCRAWVSPEELEEIQAYDPEHWVWARDRAHLS

SEQ ID NO: 82946 - protein, 402 aa, Homo sapiens
  Payload ID: 16509
  Gene Symbol: SPDYE2
  Gene Name: speedy/RINGO cell cycle regulator family member E2
  Uniprot ID: Q495Y8
  ENSP ID: ENSP00000395689
MDRTETRFRKRGQITGKITTSRQPHPQNEQSPQRSTSGYPLQEVVDDEMLGPSAPGVDPSPPCRSLGWKRKREWSDESEEEPEKELAPEPEETWVVEMLCGLKMKLKQQRVSPILPEHHKDFNSQLAPGVDPSPPHRSFCWKRKMEWWDESEESLEEEPRKVLAPEPEEIWVAEMLCGLKMKLKRRRVSLVLPEHHEAFNRLLEDPVIKRFLAWDKDLRVSDKYLLAMVIAYFSRAGFPSWQYQRIHFFLALYLANDMEEDDEDSKQNIFHFLYRKNRSRIPLLRKPWFQLGHSMNPRARKNRSRIPLLRKRRFQLYRSTNPRARKNRSRIPLLRKRRFQLYRSMNSRARKNRSQIVLFQKRRFHFFCSMSCRAWVSPEELEEIQAYDPEHWVWARDRAHLS

SEQ ID NO: 82947 - protein, 402 aa, Homo sapiens; identical to SEQ ID NO: 82946
  Payload ID: 16509
  Gene Symbol: SPDYE2
  Gene Name: speedy/RINGO cell cycle regulator family member E2
  Uniprot ID: Q495Y8
  ENSP ID: ENSP00000421686

SEQ ID NO: 82948 - protein, 258 aa, Homo sapiens; identical to SEQ ID NO: 82945
  Payload ID: 16510
  Gene Symbol: SPDYE2B
  Gene Name: speedy/RINGO cell cycle regulator family member E2B
  Uniprot ID: A6NHP3
  ENSP ID: ENSP00000414338

SEQ ID NO: 82949 - protein, 402 aa, Homo sapiens
  Payload ID: 16510
  Gene Symbol: SPDYE2B
  Gene Name: speedy/RINGO cell cycle regulator family member E2B
  Uniprot ID: A6NHP3
  ENSP ID: ENSP00000424058
MDRTETRFRKRGQITGKITTSRQPHPQNEQSPQRSTSGYPLQEVVDDEMLGPSAPGVDPSPPCRSLGWKRKREWSDESEEEPEKELAPEPEETWVVEMLCGLKMKLKQQRVSSILPEHHKDFNSQLAPGVDPSPPHRSFCWKRKMEWWDESEESLEEEPRKVLAPEPEEIWVAEMLCGLKMKLKRRRVSLVLPEHHEAFNRLLEDPVIKRFLAWDKDLRVSDKYLLAMVIAYFSRAGFPSWQYQRIHFFLALYLANDMEEDDEDSKQNIFHFLYRKNRSRIPLLRKPWFQLGHSMNPRARKNRSRIPLLRKRRFQLYRSTNPRARKNRSRIPLLRKRRFQLYRSMNSRARKNRSQIVLFQKRRFHFFCSMSCRAWVSPEELEEIQAYDPEHWVWARDRAHLS

SEQ ID NO: 82950 - protein, 402 aa, Homo sapiens; identical to SEQ ID NO: 82949
  Payload ID: 16510
  Gene Symbol: SPDYE2B
  Gene Name: speedy/RINGO cell cycle regulator family member E2B
  Uniprot ID: A6NHP3
  ENSP ID: ENSP00000440393

SEQ ID NO: 82951 - protein, 549 aa, Homo sapiens
  Payload ID: 16511
  Gene Symbol: SPDYE3
  Gene Name: speedy/RINGO cell cycle regulator family member E3
  Uniprot ID: A6NKU9
  ENSP ID: ENSP00000329565
MTSHQPQPQEEQSPQRSTSGYPLQEVVDDEVSGPSAPGVDPSPPRRSLGCKRKRECLDESDDEPEKELAPEPEETWVAETLCGLKMKAKRRRVSLVLPEYYEAFNRLLAPGVDPSPPRRSLGCKRKRECLDESDDEPEKELAPEPEETWVAETLCGLKMKAKRRRVSLVLPEYYEAFNRLLAPGVDPSPPRRSLGCKRKRECLDESDDEPEKELAPEPEETWVAETLCGLKMKAKRRRVSLVLPEYYEAFNRLLAPGVDPSPPRRSLGCKRKRECLDESDDEPEKELAPEPEETWVAETLCGLKMKAKRRRVSLVLPEYYEAFNRLLAPGVDPSPPRRSLGCKRKRECLDESDDEPEKELAPEPEETWVAETLCGLKMKAKRRRVSLVLPEYYEAFNRLLEDPVIKRFLAWDKDLRVSDKYLLAMVIAYFSRAGLPSWQYQRIHFFLALYLANDMEEDDEAPKQKIFYFLYGKTHSHIPLRPKHWFQLCRPMNPRARKNCSQIALFQKRRFQFFCSMRCRAWVSPEELEEIQAYDPEHWVWARDRAHLS

SEQ ID NO: 82952 - protein, 237 aa, Homo sapiens
  Payload ID: 16512
  Gene Symbol: SPDYE4
  Gene Name: speedy/RINGO cell cycle regulator family member E4
  Uniprot ID: A6NLX3
  ENSP ID: ENSP00000329522
MASGQARPPFEEESPQPSTTVRSPEVVVDDEVPGPSAPWIDPSPQPQSLGLKRKSEWSDESEEELEEELELERAPEPEDTWVVETLCGLKMKLKRKRASSVLPEHHEAFNRLLGDPVVQKFLAWDKDLRVSDKYLLAMVIAYFSRAGLFSWQYQRIHFFLALYLASDMEEDNQAPKQDIFSFLYGKNYSQRPLFHKLRYQLLCSMRWRTWVSPEEMEEIQAYDPEHWVWARDRTLIS

SEQ ID NO: 82953 - protein, 91 aa, Homo sapiens
  Payload ID: 16512
  Gene Symbol: SPDYE4
  Gene Name: speedy/RINGO cell cycle regulator family member E4
  ENSP ID: ENSP00000462742
  MOD_RES (1)..(1): Any amino acid
XRAPEPEDTWVVETLCGLKMKLKRKRASSVLPEHHEAFNRLLGDPVVQKFLAWDKDLRVSDKYLLAMVIAYFSRAGLFSWQYQRIHFFLAL

SEQ ID NO: 82954 - protein, 41 aa, Homo sapiens
  Payload ID: 16512
  Gene Symbol: SPDYE4
  Gene Name: speedy/RINGO cell cycle regulator family member E4
  ENSP ID: ENSP00000464038
MASGQARPPFEEESPQPSTTVRSPEVVVDDEVPGPSGEPLG

SEQ ID NO: 82955 - protein, 402 aa, Homo sapiens
  Payload ID: 16513
  Gene Symbol: SPDYE5
  Gene Name: speedy/RINGO cell cycle regulator family member E5
  ENSP ID: ENSP00000485398
MDRTETRFRKRGQITEKITTSRQPQPQNEQSPQRSTSGYPLQEVVDDEVLGPSAPGVDPSPPCRSLGWKRKREWSDESAEEPEKELAPEPEETWVVEMLCGLKMKLKQQRVSPILPEHHKGFNSQLAPGVDPSPPHRSFCWKRKMEWWDESEESLEEEPRKVLAPEPEEIWVAEMLCGLKMKLKRRRVSLVLPEHHEAFNRLLEDPVIKRFLAWDKDLRVSDKYLLAMVIAYFSRAGFPSWQYQRIHFFLALYLANDMEEDDEDSKQNIFHFLYGKNRSRIPLLRKRWFQLGRSMNPRARKKRSRIPLLRKRRFQLGRSMNPRARKNRSRIPLLRKRRFQLGRSMNLRARKNRSQIVLFQKRRFQFFCSMSGRAWVSPEELEEIQAYDPEHWVWARDRAHLS

SEQ ID NO: 82956 - protein, 337 aa, Homo sapiens [sequence omitted]

SEQ ID NO: 82957 - protein, 402 aa, Homo sapiens; identical to SEQ ID NO: 82955
  Payload ID: 16513
  Gene Symbol: SPDYE5
  Gene Name: speedy/RINGO cell cycle regulator family member E5
  ENSP ID: ENSP00000485662

SEQ ID NO: 82958 - protein, 402 aa, Homo sapiens
  Payload ID: 16514
  Gene Symbol: SPDYE6
  Gene Name: speedy/RINGO cell cycle regulator family member E6
  ENSP ID: ENSP00000485230
MDRTETRFRKRGQITGKITTSRQPHPQNEQSPQRSTSGYPLQEVVDDEMLGPSAPGVDPSPPCRSLGWKRKREWSDESEEEPEKELAPEPEETWVVEMLCGLKMKLKQQRVSSILPEHHKDFNSQLAPGVDPSPPHRSFCWKRKMEWWDESEESLEEEPRKVLAPEPEEIWVAEMLCGLKMKLKRRRVSLVLPEHHEAFNRLLEDPVIKRFLAWDKDLRVSDKYLLAMVIAYFSRAGFPSWQYQRIHFFLALYLANDMEEDDEDSKQNIFHFLYRKNRSRIPLLRKRWFQLGHSMNPRARKNRSRIPLLRKRRFQLYRSTNPRARKNRSRIPLLRKHRFQLYRSMNSRARKNRSQIVLFQKRRFHFFCSMSCRAWVSPEELEEIQAYDPEHWVWARDRAHLS

SEQ ID NO: 82959 - protein, 3267 aa, Homo sapiens
  Payload ID: 16515
  Gene Symbol: SPEG
  Gene Name: SPEG complex locus
  Uniprot ID: Q15772
  ENSP ID: ENSP00000311684
MQKARGTRGEDAGTRAPPSPGVPPKRAKVGAGGGAPVAVAGAPVFLRPLKNAAVCAGSDVRLRVVVSGTPQPSLRWFRDGQLLPAPAPEPSCLWLRRCGAQDAGVYSCMAQNERGRASCEAVLTVLEVGDSETAEDDISDVQGTQRLELRDDGAFSTPTGGSDTLVGTSLDTPPTSVTGTSEEQVSWWGSGQTVLEQEAGSGGGTRRLPGSPRQAQATGAGPRHLGVEPLVRASRANLVGASWGSEDSLSVASDLYGSAFSLYRGRALSIHVSVPQSGLRREEPDLQPQLASEAPRRPAQPPPSKSALLPPPSPRVGKRSPPGPPAQPAATPTSPHRRTQEPVLPEDTTTEEKRGKKSKSSGPSLAGTAESRPQTPLSEASGRLSALGRSPRLVRAGSRILDKLQFFEERRRSLERSDSPPAPLRPWVPLRKARSLEQPKSERGAPWGTPGASQEELRAPGSVAERRRLFQQKAASLDERTRQRSPASDLELRFAQELGRIRRSTSREELVRSHESLRATLQRAPSPREPGEPPLFSRPSTPKTSRAVSPAAAQPPSPSSAEKPGDEPGRPRSRGPAGRTEPGEGPQQEVRRRDQFPLTRSRAIQECRSPVPPPAADPPEARTKAPPGRKREPPAQAVRFLPWATPGLEGAAVPQTLEKNRAGPEAEKRLRRGPEEDGPWGPWDRRGARSQGKGRRARPTSPELESSDDSYVSAGEEPLEAPVFEIPLQNVVVAPGADVLLKCIITANPPPQVSWHKDGSALRSEGRLLLRAEGERHTLLLREARAADAGSYMATATNELGQATCAASLTVRPGGSTSPFSSPITSDEEYLSPPEEFPEPGETWPRTPTMKPSPSQNRRSSDTGSKAPPTFKVSLMDQSVREGQDVIMSIRVQGEPKPVVSWLRNRQPVRPDQRRFAEEAEGGLCRLRILAAERGDAGFYTCKAVNEYGARQCEARLEVRAHPESRSLAVLAPLQDVDVGAGEMALFECLVAGPTDVEVDWLCRGRLLQPALLKCKMHFDGRKCKLLLTSVHEDDSGVYTCKLSTAKDELTCSARLTVRPSLAPLFTRLLEDVEVLEGRAARFDCKISGTPPPVVTWTHFGCPMEESENLRLRQDGGLHSLHIAHVGSEDEGLYAVSAVNTHGQAHCSAQLYVEEPRTAASGPSSKLEKMPSIPEEPEQGELERLSIPDFLRPLQDLEVGLAKEAMLECQVTGLPYPTISWFHNGHRIQSSDDRRMTQYRDVHRLVFPAVGPQHAGVYKSVIANKLGKAACYAHLYVTDVVPGPPDGAPQVVAVTGRMVTLTWNPPRSLDMAIDPDSLTYTVQHQVLGSDQWTALVTGLREPGWAATGLRKGVQHIFRVLSTTVKSSSKPSPPSEPVQLLEHGPTLEEAPAMLDKPDIVYVVEGQPASVTVTFNHVEAQVVWRSCRGALLEARAGVYELSQPDDDQYCLRICRVSRRDMGALTCTARNRHGTQTCSVTLELAEAPRFESIMEDVEVGAGETARFAVVVEGKPLPDIMWYKDEVLLTESSHVSFVYEENECSLVVLSTGAQDGGVYTCTAQNLAGEVSCKAELAVHSAQTAMEVEGVGEDEDHRGRRLSDFYDIHQEIGRGAFSYLRRIVERSSGLEFAAKFIPSQAKPKASARREARLLARLQHDCVLYFHEAFERRRGLVIVTELCTEELLERIARKPTVCESEIRAYMRQVLEGIHYLHQSHVLHLDVKPENLLVWDGAAGEQQVRICDFGNAQELTPGEPQYCQYGTPEFVAPEIVNQSPVSGVTDIWPVGVVAFLCLTGISPFVGENDRTTLMNIRNYNVAFEETTFLSLSREARGFLIKVLVQDRLRPTAEETLEHPWFKTQAKGAEVSTDHLKLFLSRRRWQRSQISYKCHLVLRPIPELLRAPPERVWVTMPRRPPPSGGLSSSSDSEEEELEELPSVPRPLQPEFSGSRVSLTDIPTEDEALGTPETGAATPMDWQEQGRAPSQDQEAPSPEALPSPGQEPAAGASPRRGELRRGSSAESALPRAGPRELGRGLHKAASVELPQRRSPSPGATRLARGGLGEGEYAQRLQALRQRLLRGGPEDGKVSGLRGPLLESLGGRARDPRMARAASSEAAPHHQPPLENRGLQKSSSFSQGEAEPRGRHRRAGAPLEIPVARLGARRLQESPSLSALSEAQPSSPARPSAPKPSTPKSAEPSATTPSDAPQPPAPQPAQDKAPEPRPEPVRASKPAPPPQALQTLALPLTPYAQIIQSLQLSGHAQGPSQGPAAPPSEPKPHAAVFARVASPPPGAPEKRVPSAGGPPVLAEKARVPTVPPRPGSSLSSSIENLESEAVFEAKFKRSRESPLSLGLRLLSRSRSEERGPFRGAEEEDGIYRPSPAGTPLELVRRPERSRSVQDLRAVGEPGLVRRLSLSLSQRLRRTPPAQRHPAWEARGGDGESSEGGSSARGSPVLAMRRRLSFTLERLSSRLQRSGSSEDSGGASGRSTPLFGRLRRATSEGESLRRLGLPHNQLAAQAGATTPSAESLGSEASATSGSSAPGESRSRLRWGFSRPRKDKGLSPPNLSASVQEELGHQYVRSESDFPPVFHIKLKDQVLLEGEAATLLCLPAACPAPHISWMKDKKSLRSEPSVIIVSCKDGRQLLSIPRAGKRHAGLYECSATNVLGSITSSCTVAVARVPGKLAPPEVPQTYQDTALVLWKPGDSRAPCTYTLERRVDGESVWHPVSSGIPDCYYNVTHLPVGVTVRFRVACANRAGQGPFSNSSEKVFVRGTQDSSAVPSAAHQEAPVTSRPARARPPDSPTSLAPPLAPAAPTPPSVTVSPSSPPTPPSQALSSLKAVGPPPQTPPRRHRGLQAARPAEPTLPSTHVTPSEPKPFVLDTGTPIPASTPQGVKPVSSSTPVYVVTSFVSAPPAPEPPAPEPPPEPTKVTVQSLSPAKEVVSSPGSSPRSSPRPEGTTLRQGPPQKPYTFLEEKARGRFGVVRACRENATGRTFVAKIVPYAAEGKRRVLQEYEVLRTLHHERIMSLHEAYITPRYLVLIAESCGNRELLCGLSDRFRYSEDDVATYMVQLLQGLDYLHGHHVLHLDIKPDNLLLAPDNALKIVDFGSAQPYNPQALRPLGHRTGTLEFMAPEMVKGEPIGSATDIWGAGVLTYIMLSGRSPFYEPDPQETEARIVGGRFDAFQLYPNTSQSATLFLRKVLSVHPWSRPSLQDCLAHPWLQDAYLMKLRRQTLTFTTNRLKEFLGEQRRRRAEAATRHKVLLRSYPGGP

SEQ ID NO: 82960 - protein, 113 aa, Homo sapiens
  Payload ID: 16515
  Gene Symbol: SPEG
  Gene Name: SPEG complex locus
  Uniprot ID: Q15772
  ENSP ID: ENSP00000379917
MKPSPSQNRRSSDTGSKAPPTFKVSLMDQSVREGQDVIMSIRVQGEPKPVVSWLRNRQPVRPDQRRFAEEAEGGLCRLRILAAERGDAGFYTCKAVNEYGARQCEARLEVRGE

SEQ ID NO: 82961 - protein, 113 aa, Homo sapiens; identical to SEQ ID NO: 82960
  Payload ID: 16515
  Gene Symbol: SPEG
  Gene Name: SPEG complex locus
  Uniprot ID: Q15772
  ENSP ID: ENSP00000379919

SEQ ID NO: 82962 - protein, 113 aa, Homo sapiens; identical to SEQ ID NO: 82960
  Payload ID: 16515
  Gene Symbol: SPEG
  Gene Name: SPEG complex locus
  Uniprot ID: Q15772
  ENSP ID: ENSP00000379920

SEQ ID NO: 82963 - protein, 858 aa, Homo sapiens
  Payload ID: 16515
  Gene Symbol: SPEG
  Gene Name: SPEG complex locus
  ENSP ID: ENSP00000379926
MKKLWVKKRFQKTGHSRRAFGRLTHDSETAEDDISDVQGTQRLELRDDGAFSTPTGGSDTLVGTSLDTPPTSVTGTSEEQVSWWGSGQTVLEQEAGSGGGTRRLPGSPRQAQATGAGPRHLGVEPLVRASRANLVGASWGSEDSLSVASDLYGSAFSLYRGRALSIHVSVPQSGLRREEPDLQPQLASEAPRRPAQPPPSKSALLPPPSPRVGKRSPPGPPAQPAATPTSPHRRTQEPVLPEDTTTEEKRGKKSKSSGPSLAGTAESRPQTPLSEASGRLSALGRSPRLVRAGSRILDKLQFFEERRRSLERSDSPPAPLRPWVPLRKARSLEQPKSERGAPWGTPGASQEELRAPGSVAERRRLFQQKAASLDERTRQRSPASDLELRFAQELGRIRRSTSREELVRSHESLRATLQRAPSPREPGEPPLFSRPSTPKTSRAVSPAAAQPPSPSSAEKPGDEPGRPRSRGPAGRTEPGEGPQQEVRRRDQFPLTRSRAIQECRSPVPPPAADPPEARTKAPPGRKREPPAQAVRFLPWATPGLEGAAVPQTLEKNRAGPEAEKRLRRGPEEDGPWGPWDRRGARSQGKGRRARPTSPELESSDDSYVSAGEEPLEAPVFEIPLQNVVVAPGADVLLKCIITANPPPQVSWHKDGSALRSEGRLLLRAEGERHTLLLREARAADAGSYMATATNELGQATCAASLTVRPGGSTSPFSSPITSDEEYLSPPEEFPEPGETWPRTPTMKPSPSQNRRSSDTGSKAPPTFKVSLMDQSVREGQDVIMSIRVQGEPKPVVSWLRNRQPVRPDQRRFAEEAEGGLCRLRILAAERGDAGFYTCKAVNEYGARQCEARLEVRGE

SEQ ID NO: 82964 - protein, 53 aa, Homo sapiens
  Payload ID: 16515
  Gene Symbol: SPEG
  Gene Name: SPEG complex locus
  ENSP ID: ENSP00000383902
MKKLWVKKRFQKTGHSRRAFGRLTHGAWTVGVLALAHAYSSSWSLSLCEASSS

SEQ ID NO: 82965 - protein, 43 aa, Homo sapiens
  Payload ID: 16515
  Gene Symbol: SPEG
  Gene Name: SPEG complex locus
  ENSP ID: ENSP00000387344
  MOD_RES (1)..(1): Any amino acid
XSRANLVGASWGSEDSLSVASDLYGSAFSLYRGRALSIHVVFG

SEQ ID NO: 82966 - protein, 343 aa, Homo sapiens
  Payload ID: 16515
  Gene Symbol: SPEG
  Gene Name: SPEG complex locus
  ENSP ID: ENSP00000390353
  MOD_RES (1)..(1): Any amino acid
XMLSGRSPFYEPDPQETEARIVGGRFDAFQLYPNTSQSATLFLRKVLSVHPWSRPSLQDCLAHPWLQDAYLMKLRRQTLTFTTNRLKEFLGEQRRRRAEAATRHKMSKAAPAKKPVAVAPAPGCTLDINDPQVQSAAIRIQASYRGHRSRKELREKGPPRVLEPLKDVVLIEGSAAKLTCRISAFPDPFIRWSKDGKELRDGPKYRYVFEDPDVVALVVRDGELADLGQYSINVTNPFGQCSDSARILVEVPTKIQKGPDNTKARKGTTVTLTAEILGEPAPDVGWTKDGEDIEEDDRVFFEIGSTTTTLTIRRATPQDSGKYEVYVENSLGMDQSFARVDVA

SEQ ID NO: 82967 - protein, 187 aa, Homo sapiens
  Payload ID: 16515
  Gene Symbol: SPEG
  Gene Name: SPEG complex locus
  ENSP ID: ENSP00000393134
MLLTFQRGPAGGENRPFPPGLWPTHPCEVFRSCRKQSYDSETAEDDISDVQGTQRLELRDDGAFSTPTGGSDTLVGTSLDTPPTSVTGTSEEQVSWWGSGQTVLEQEAGSGGGTRRLPGSPSSVPQSGLRREEPDLQPQLASEAPRRPAQPPPSKSALLPPPSPRVGKRSPPGPPAQPAATPTSPHR

SEQ ID NO: 82968 - protein, 53 aa, Homo sapiens; identical to SEQ ID NO: 82964
  Payload ID: 16515
  Gene Symbol: SPEG
  Gene Name: SPEG complex locus
  ENSP ID: ENSP00000397514

SEQ ID NO: 82969 - protein, 84 aa, Homo sapiens
  Payload ID: 16515
  Gene Symbol: SPEG
  Gene Name: SPEG complex locus
  ENSP ID: ENSP00000406530
MKKLWVKKRFQKTGHSRRAFGRLTHAKFSAPAESKVTTQRRLRMTSAMCREPSAWSFGMTGPSAPPRGVLTPWWAPPWTHPRPP

SEQ ID NO: 82970 - protein, 299 aa, Homo sapiens
  Payload ID: 16515
  Gene Symbol: SPEG
  Gene Name: SPEG complex locus
  ENSP ID: ENSP00000410986
MKKLWVKKRFQKTGHSRRAFGRLTHVFRSCRKQSYDSETAEDDISDVQGTQRLELRDDGAFSTPTGGSDTLVGTSLDTPPTSVTGTSEEQVSWWGSGQTVLEQEAGSGGGTRRLPGSPSSVPQSGLRREEPDLQPQLASEAPRRPAQPPPSKSALLPPPSPRVGKRSPPGPPAQPAATPTSPHRRTQEPVLPEDTTTEEKRGKKSKSSGPSLAGTAESRPQTPLSEASGRLSALGRSPRLVRAGSRILDKLQFFEERRRSLERSDSPPAPLRPWVPLRKARSLEQPKSERGAPWGTPGA

SEQ ID NO: 82971 - protein, 184 aa, Homo sapiens
  Payload ID: 16515
  Gene Symbol: SPEG
  Gene Name: SPEG complex locus
  ENSP ID: ENSP00000414549
  MOD_RES (1)..(1): Any amino acid
XETAEDDISDVQGTQRLELRDDGAFSTPTGTSEEQVSWWGSGQTVLEQEAGSGGGTRRLPGSPRQAQATGAGPRHLGVEPLVRASRANLVGASWGSEDSLSVASDLYGSAFSLYRGRALSIHVSVPQSGLRREEPDLQPQLASEAPRRPAQPPPSKSALLPPPSPRVGKRSPPGPPAQPAATPT

SEQ ID NO: 82972 - protein, 238 aa, Homo sapiens
  Payload ID: 16515
  Gene Symbol: SPEG
  Gene Name: SPEG complex locus
  ENSP ID: ENSP00000479190
MSKAAPAKKPVAVAPAPGCTLDINDPQVQSAAIRIQASYRGHRSRKELREKGPPRVLEPLKDVVLIEGSAAKLTCRISAFPDPFIRWSKDGKELRDGPKYRYVFEDPDVVALVVRDGELADLGQYSINVTNPFGQCSDSARILVEVPTKIQKGPDNTKARKGTTVTLTAEILGEPAPDVGWTKDGEDIEEDDRVFFEIGSTTTTLTIRRATPQDSGKYEVYVENSLGMDQSFARVDVA

SEQ ID NO: 82973 - protein, 3664 aa, Homo sapiens
  Payload ID: 16516
  Gene Symbol: SPEN
  Gene Name: spen family transcriptional repressor
  Uniprot ID: Q96T58
  ENSP ID: ENSP00000364912
MVRETRHLWVGNLPENVREEKIIEHFKRYGRVESVKILPKRGSEGGVAAFVDFVDIKSAQKAHNSVNKMGDRDLRTDYNEPGTIPSAARGLDDTVSIASRSREVSGFRGGGGGPAYGPPPSLHAREGRYERRLDGASDNRERAYEHSAYGHHERGTGGFDRTRHYDQDYYRDPRERTLQHGLYYASRSRSPNRFDAHDPRYEPRAREQFTLPSVVHRDIYRDDITREVRGRRPERNYQHSRSRSPHSSQSRNQSPQRLASQASRPTRSPSGSGSRSRSSSSDSISSSSSTSSDSSDSSSSSSDDSPARSVQSAAVPAPTSQLLSSLEKDEPRKSFGIKVQNLPVRSTDTSLKDGLFHEFKKFGKVTSVQIHGTSEERYGLVFFRQQEDQEKALTASKGKLFFGMQIEVTAWIGPETESENEFRPLDERIDEFHPKATRTLFIGNLEKTTTYHDLRNIFQRFGEIVDIDIKKVNGVPQYAFLQYCDIASVCKAIKKMDGEYLGNNRLKLGFGKSMPTNCVWLDGLSSNVSDQYLTRHFCRYGPVVKVVFDRLKGMALVLYNEIEYAQAAVKETKGRKIGGNKIKVDFANRESQLAFYHCMEKSGQDIRDFYEMLAERREERRASYDYNQDRTYYESVRTPGTYPEDSRRDYPARGREFYSEWETYQGDYYESRYYDDPREYRDYRNDPYEQDIREYSYRQRERERERERFESDRDRDHERRPIERSQSPVHLRRPQSPGASPSQAERLPSDSERRLYSRSSDRSGSCSSLSPPRYEKLDKSRLERYTKNEKTDKERTFDPERVERERRLIRKEKVEKDKTDKQKRKGKVHSPSSQSSETDQENEREQSPEKPRSCNKLSREKADKEGIAKNRLELMPCVVLTRVKEKEGKVIDHTPVEKLKAKLDNDTVKSSALDQKLQVSQTEPAKSDLSKLESVRMKVPKEKGLSSHVEVVEKEGRLKARKHLKPEQPADGVSAVDLEKLEARKRRFADSNLKAEKQKPEVKKSSPEMEDARVLSKKQPDVSSREVILLREGEAERKPVRKEILKRESKKIKLDRLNTVASPKDCQELASISVGSGSRPSSDLQARLGELAGESVENQEVQSKKPIPSKPQLKQLQVLDDQGPEREDVRKNYCSLRDETPERKSGQEKSHSVNTEEKIGIDIDHTQSYRKQMEQSRRKQQMEMEIAKSEKFGSPKKDVDEYERRSLVHEVGKPPQDVTDDSPPSKKKRMDHVDFDICTKRERNYRSSRQISEDSERTGGSPSVRHGSFHEDEDPIGSPRLLSVKGSPKVDEKVLPYSNITVREESLKFNPYDSSRREQMADMAKIKLSVLNSEDELNRWDSQMKQDAGRFDVSFPNSIIKRDSLRKRSVRDLEPGEVPSDSDEDGEHKSHSPRASALYESSRLSFLLRDREDKLRERDERLSSSLERNKFYSFALDKTITPDTKALLERAKSLSSSREENWSFLDWDSRFANFRNNKDKEKVDSAPRPIPSWYMKKKKIRTDSEGKMDDKKEDHKEEEQERQELFASRFLHSSIFEQDSKRLQHLERKEEDSDFISGRIYGKQTSEGANSTTDSIQEPVVLFHSRFMELTRMQQKEKEKDQKPKEVEKQEDTENHPKTPESAPENKDSELKTPPSVGPPSVTVVTLESAPSALEKTTGDKTVEAPLVTEEKTVEPATVSEEAKPASEPAPAPVEQLEQVDLPPGADPDKEAAMMPAGVEEGSSGDQPPYLDAKPPTPGASFSQAESNVDPEPDSTQPLSKPAQKSEEANEPKAEKPDATADAEPDANQKAEAAPESQPPASEDLEVDPPVAAKDKKPNKSKRSKTPVQAAAVSIVEKPVTRKSERIDREKLKRSNSPRGEAQKLLELKMEAEKITRTASKNSAADLEHPEPSLPLSRTRRRNVRSVYATMGDHENRSPVKEPVEQPRVTRKRLERELQEAAAVPTTPRRGRPPKTRRRADEEEENEAKEPAETLKPPEGWRSPRSQKTAAGGGPQGKKGKNEPKVDATRPEATTEVGPQIGVKESSMEPKAAEEEAGSEQKRDRKDAGTDKNPPETAPVEVVEKKPAPEKNSKSKRGRSRNSRLAVDKSASLKNVDAAVSPRGAAAQAGERESGVVAVSPEKSESPQKEDGLSSQLKSDPVDPDKEPEKEDVSASGPSPEATQLAKQMELEQAVEHIAKLAEASASAAYKADAPEGLAPEDRDKPAHQASETELAAAIGSIINDISGEPENFPAPPPYPGESQTDLQPPAGAQALQPSEEGMETDEAVSGILETEAATESSRPPVNAPDPSAGPTDTKEARGNSSETSHSVPEAKGSKEVEVTLVRKDKGRQKTTRSRRKRNTNKKVVAPVESHVPESNQAQGESPAANEGTTVQHPEAPQEEKQSEKPHSTPPQSCTSDLSKIPSTENSSQEISVEERTPTKASVPPDLPPPPQPAPVDEEPQARFRVHSIIESDPVTPPSDPSIPIPTLPSVTAAKLSPPVASGGIPHQSPPTKVTEWITRQEEPRAQSTPSPALPPDTKASDVDTSSSTLRKILMDPKYVSATSVTSTSVTTAIAEPVSAAPCLHEAPPPPVDSKKPLEEKTAPPVTNNSEIQASEVLVAADKEKVAPVIAPKITSVISRMPVSIDLENSQKITLAKPAPQTLTGLVSALTGLVNVSLVPVNALKGPVKGSVTTLKSLVSTPAGPVNVLKGPVNVLTGPVNVLTTPVNATVGTVNAAPGTVNAAASAVNATASAVTVTAGAVTAASGGVTATTGTVTMAGAVIAPSTKCKQRASANENSRFHPGSMPVIDDRPADAGSGAGLRVNTSEGVVLLSYSGQKTEGPQRISAKISQIPPASAMDIEFQQSVSKSQVKPDSVTASQPPSKGPQAPAGYANVATHSTLVLTAQTYNASPVISSVKADRPSLEKPEPIHLSVSTPVTQGGTVKVLTQGINTPPVLVHNQLVLTPSIVTTNKKLADPVTLKIETKVLQPANLGSTLTPHHPPALPSKLPTEVNHVPSGPSIPADRTVSHLAAAKLDAHSPRPSGPGPSSFPRASHPSSTASTALSTNATVMLAAGIPVPQFISSIHPEQSVIMPPHSITQTVSLSHLSQGEVRMNTPTLPSITYSIRPEALHSPRAPLQPQQIEVRAPQRASTPQPAPAGVPALASQHPPEEEVHYHLPVARATAPVQSEVLVMQSEYRLHPYTVPRDVRIMVHPHVTAVSEQPRAADGVVKVPPASKAPQQPGKEAAKTPDAKAAPTPTPAPVPVPVPLPAPAPAPHGEARILTVTPSNQLQGLPLTPPVVVTHGVQIVHSSGELFQEYRYGDIRTYHPPAQLTHTQFPAASSVGLPSRTKTAAQGPPPEGEPLQPPQPVQSTQPAQPAPPCPPSQLGQPGQPPSSKMPQVSQEAKGTQTGVEQPRLPAGPANRPPEPHTQVQRAQAETGPTSFPSPVSVSMKPDLPVSLPTQTAPKQPLFVPTTSGPSTPPGLVLPHTEFQPAPKQDSSPHLTSQRPVDMVQLLKKYPIVWQGLLALKNDTAAVQLHFVSGNNVLAHRSLPLSEGGPPLRIAQRMRLEATQLEGVARRMTVETDYCLLLALPCGRDQEDVVSQTESLKAAFITYLQAKQAAGIINVPNPGSNQPAYVLQIFPPCEFSESHLSRLAPDLLASISNISPHLMIVIASV

SEQ ID NO: 82974 - protein, 373 aa, Homo sapiens
  Payload ID: 16516
  Gene Symbol: SPEN
  Gene Name: spen family transcriptional repressor
  ENSP ID: ENSP00000388021
MNVDKFLIVCYLKKEVWGFESYSLSGTTCFQWNYFVWSLRFFFSCGSSKYHLTPLPIKKVDYPHKRGQNWGSYVHNSLPRFNWDYRSCFHTWKRASDNRERAYEHSAYGHHERGTGGFDRTRHYDQDYYRDPRERTLQHGLYYASRSRSPNRFDAHDPRYEPRAREQFTLPSVVHRDIYRDDITREVRGRRPERNYQHSRSRSPHSSQSRNQSPQRLASQASRPTRSPSGSGSRSRSSSSDSISSSSSTSSDSSDSSSSSSDDSPARSVQSAAVPAPTSQLLSSLEKDEPRKSFGIKVQNLPVRSTDTSLKDGLFHEFKKFGKVTSVQIHGTSEERYGLVFFRQQEDQEKALTASKGKLFFGMQIEVTAWIGP

SEQ ID NO: 82975 - protein, 297 aa, Homo sapiens
  Payload ID: 16516
  Gene Symbol: SPEN
  Gene Name: spen family transcriptional repressor
  ENSP ID: ENSP00000400914
  MOD_RES (1)..(1): Any amino acid
XQASRPTRSPSGSGSRSRSSSSDSISSSSSTSSDSDSSSSSSDDSPARSVQSAAVPAPTSQLLSSLEKDEPRKSFGIKVQNLPVRSTDTSLKDGLFHEFKKFGKVTSVQIHGTSEERYGLVFFRQQEDQEKALTASKGKLFFGMQIEVTAWIGPETESENEFRPLDERIDEFHPKATRTLFIGNLEKTTTYHDLRNIFQRFGEIVDIDIKKVNGVPQYAFLQYCDIASVCKAIKKMDGEYLGNNRLKLGFGKSMPTNCVWLDGLSSNVSDQYLTRHFCRYGPVVKVVFDRLKGMALV

SEQ ID NO: 82976 - protein, 294 aa, Homo sapiens
  Payload ID: 16517
  Gene Symbol: SPACA1
  Gene Name: sperm acrosome associated 1
  Uniprot ID: Q9HBV2
  ENSP ID: ENSP00000237201
MSPRGTGCSAGLLMTVGWLLLAGLQSARGTNVTAAVQDAGLAHEGEGEEETENNDSETAENYAPPETEDVSNRNVVKEVEFGMCTVTCGIGVREVILTNGCPGGESKCVVRVEECRGPTDCGWGKPISESLESVRLACIHTSPLNRFKYMWKLLRQDQQSIILVNDSAILEVRKESHPLAFECDTLDNNEIVATIKFTVYTSSELQMRRSSLPATDAALIFVLTIGVIICVFIIFLLIFIIINWAAVKAFWGAKASTPEVQSEQSSVRYKDSTSLDQLPTEMPGEDDALSEWNE

SEQ ID NO: 82977 - protein, 215 aa, Homo sapiens [sequence omitted]

SEQ ID NO: 82978 - protein, 112 aa, Homo sapiens
  Payload ID: 16518
  Gene Symbol: SPACA3
  Gene Name: sperm acrosome associated 3
  ENSP ID: ENSP00000378134
MVSALRGAPLIRVCLAYFTSGFNAAALDYEADGSTNNGIFQINSRRWCSNLTPNVPNVCRMYCSDLLNPNLKDTVICAMKITQEPQGLGYWEAWRHHCQGKDLTEWVDGCDF

SEQ ID NO: 82979 - protein, 146 aa, Homo sapiens
  Payload ID: 16518
  Gene Symbol: SPACA3
  Gene Name: sperm acrosome associated 3
  Uniprot ID: Q8IXA5
  ENSP ID: ENSP00000463386
MLLALVCLLSCLLPSSEAKLYGRCELARVLHDFGLDGYRGYSLADWVCLAYFTSGFNAAALDYEADGSTNNGIFQINSRRWCSNLTPNVPNVCRMYCSDLLNPNLKDTVICAMKITQEPQGLGYWEAWRHHCQGKDLTEWVDGCDF

SEQ ID NO: 82980 - protein, 124 aa, Homo sapiens
  Payload ID: 16519
  Gene Symbol: SPACA4
  Gene Name: sperm acrosome associated 4
  Uniprot ID: Q8TDM5
  ENSP ID: ENSP00000312774
MVLCWLLLLVMALPPGTTGVKDCVFCELTDSMQCPGTYMHCGDDEDCFTGHGVAPGTGPVINKGCLRATSCGLEEPVSYRGVTYSLTTNCCTGRLCNRAPSSQTVGATTSLALGLGMLLPPRLL

SEQ ID NO: 82981 - protein, 159 aa, Homo sapiens
  Payload ID: 16520
  Gene Symbol: SPACA5
  Gene Name: sperm acrosome associated 5
  Uniprot ID: Q96QH8
  ENSP ID: ENSP00000305847
MKAWGTVVVTLATLMVVTVDAKIYERCELAARLERAGLNGYKGYGVGDWLCMAHYESGFDTAFVDHNPDGSSEYGIFQLNSAWWCDNGITPTKNLCHMDCHDLLNRHILDDIRCAKQIVSSQNGLSAWTSWRLHCSGHDLSEWLKGCDMHVKIDPKIHP

SEQ ID NO: 82982 - protein, 159 aa, Homo sapiens; identical to SEQ ID NO: 82981
  Payload ID: 16520
  Gene Symbol: SPACA5
  Gene Name: sperm acrosome associated 5
  Uniprot ID: Q96QH8
  ENSP ID: ENSP00000366139

SEQ ID NO: 82983 - protein, 159 aa, Homo sapiens; identical to SEQ ID NO: 82981
  Payload ID: 16521
  Gene Symbol: SPACA5B
  Gene Name: sperm acrosome associated 5B
  Uniprot ID: Q96QH8
  ENSP ID: ENSP00000304762

SEQ ID NO: 82984 - protein, 195 aa, Homo sapiens
  Payload ID: 16522
  Gene Symbol: SPACA7
  Gene Name: sperm acrosome associated 7
  Uniprot ID: Q96KW9
  ENSP ID: ENSP00000283550
MAVSQGDGTLCFVLLLCCWQETELRPRTVIPGSPTEIPFSSKQEDMSELLDEILVQEILDLNKTTPSEMPSTASTLSTPLHAGIDENYQAGGSENYHELLENLQFSPGIEVKISNDEANANANLHGDPSENYRGPQVSPGSEKSVSSKEKNSKNTQYENLSILDQILQNIGRSSGNIFHKEQQRTSAQRRSQGSQ

SEQ ID NO: 82985 - protein, 164 aa, Homo sapiens
  Payload ID: 16522
  Gene Symbol: SPACA7
  Gene Name: sperm acrosome associated 7
  ENSP ID: ENSP00000364851
MLWLLPTDRGRSGNGNEPQDEILVQEILDLNKTTPSEMPSTASTLSTPLHAGIDENYQAGGSENYHELLENLQFSPGIEVKISNDEANANANLHGDPSENYRGPQVSPGSEKSVSSKEKNSKNTQYENLSILDQILQNIGRSSGNIFHKEQQRTSAQRRSQGSQ

SEQ ID NO: 82986 - protein, 111 aa, Homo sapiens
  Payload ID: 16522
  Gene Symbol: SPACA7
  Gene Name: sperm acrosome associated 7
  ENSP ID: ENSP00000406733
MTFFTHLWDGDPVSQVAGSPTEIPFSSKQEDMSELLDEILVQEILDLNKTTPSEMPSTASTLSTPLHAGIDENYQAGGSENYHELLENLQFSPGIEVKISNDEANANANLH

SEQ ID NO: 82987 - protein, 104 aa, Homo sapiens
  Payload ID: 16522
  Gene Symbol: SPACA7
  Gene Name: sperm acrosome associated 7
  ENSP ID: ENSP00000416096
MLWLLPTDRGRSGNGNEPQGSPTEIPFSSKQEDMSELLDEILVQEILDLNKTTPSEMPSTASTLSTPLHAGIDENYQAGGSENYHELLENLQFSPGIEVKISND

SEQ ID NO: 82988 - protein, 195 aa, Homo sapiens; identical to SEQ ID NO: 82984
  Payload ID: 16522
  Gene Symbol: SPACA7
  Gene Name: sperm acrosome associated 7
  Uniprot ID: Q96KW9
  ENSP ID: ENSP00000480272

SEQ ID NO: 82989 - protein, 104 aa, Homo sapiens; identical to SEQ ID NO: 82987
  Payload ID: 16522
  Gene Symbol: SPACA7
  Gene Name: sperm acrosome associated 7
  ENSP ID: ENSP00000487684

SEQ ID NO: 82990 - protein, 111 aa, Homo sapiens; identical to SEQ ID NO: 82986
  Payload ID: 16522
  Gene Symbol: SPACA7
  Gene Name: sperm acrosome associated 7
  ENSP ID: ENSP00000488255

SEQ ID NO: 82991 - protein, 164 aa, Homo sapiens; identical to SEQ ID NO: 82985
  Payload ID: 16522
  Gene Symbol: SPACA7
  Gene Name: sperm acrosome associated 7
  ENSP ID: ENSP00000488452

SEQ ID NO: 82992 - protein, 509 aa, Homo sapiens
  Payload ID: 16523
  Gene Symbol: SPAM1
  Gene Name: sperm adhesion molecule 1 (PH-20 hyaluronidase, zona pellucida binding)
  Uniprot ID: P38567
  ENSP ID: ENSP00000223028
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 82993 - protein, 511 aa, Homo sapiens
  Payload ID: 16523
  Gene Symbol: SPAM1
  Gene Name: sperm adhesion molecule 1 (PH-20 hyaluronidase, zona pellucida binding)
  Uniprot ID: P38567
  ENSP ID: ENSP00000345849
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIWRLEVWDQGISRIGFF

SEQ ID NO: 82994 - protein, 511 aa, Homo sapiens; identical to SEQ ID NO: 82993
  Payload ID: 16523
  Gene Symbol: SPAM1
  Gene Name: sperm adhesion molecule 1 (PH-20 hyaluronidase, zona pellucida binding)
  Uniprot ID: P38567
  ENSP ID: ENSP00000386028

SEQ ID NO: 82995 - protein, 80 aa, Homo sapiens
  Payload ID: 16523
  Gene Symbol: SPAM1
  Gene Name: sperm adhesion molecule 1 (PH-20 hyaluronidase, zona pellucida binding)
  ENSP ID: ENSP00000391491
MGVLKFKHIFFRSFVKSSGVSQIVFTFLLIPCCLTLNFRAPPVIPNVPFLWAWNAPSEFCLGKFDEPLDMSLFSFIGSPR

SEQ ID NO: 82996 - protein, 509 aa, Homo sapiens; identical to SEQ ID NO: 82992
  Payload ID: 16523
  Gene Symbol: SPAM1
  Gene Name: sperm adhesion molecule 1 (PH-20 hyaluronidase, zona pellucida binding)
  Uniprot ID: P38567
  ENSP ID: ENSP00000402123

SEQ ID NO: 82997 - protein, 509 aa, Homo sapiens; identical to SEQ ID NO: 82992
  Payload ID: 16523
  Gene Symbol: SPAM1
  Gene Name: sperm adhesion molecule 1 (PH-20 hyaluronidase, zona pellucida binding)
  Uniprot ID: P38567
  ENSP ID: ENSP00000417934

SEQ ID NO: 82998 - protein, 1068 aa, Homo sapiens
  Payload ID: 16524
  Gene Symbol: SPECC1
  Gene Name: sperm antigen with calponin homology and coiled-coil domains 1
  Uniprot ID: Q5M775
  ENSP ID: ENSP00000261503
MRSAAKPWNPAIRAGGHGPDRVRPLPAASSGMKSSKSSTSLAFESRLSRLKRASSEDTLNKPGSTAASGVVRLKKTATAGAISELTESRLRSGTGAFTTTKRTGIPAPREFSVTVSRERSVPRGPSNPRKSVSSPTSSNTPTPTKHLRTPSTKPKQENEGGEKAALESQVRELLAEAKAKDSEINRLRSELKKYKEKRTLNAEGTDALGPNVDGTSVSPGDTEPMIRALEEKNKNFQKELSDLEEENRVLKEKLIYLEHSPNSEGAASHTGDSSCPTSITQESSFGSPTGNQMSSDIDEYKKNIHGNALRTSGSSSSDVTKASLSPDASDFEHITAETPSRPLSSTSNPFKSSKCSTAGSSPNSVSELSLASLTEKIQKMEENHHSTAEELQATLQELSDQQQMVQELTAENEKLVDEKTILETSFHQHRERAEQLSQENEKLMNLLQERVKNEEPTTQEGKIIELEQKCTGILEQGRFEREKLLNIQQQLTCSLRKVEEENQGALEMIKRLKEENEKLNEFLELERHNNNMMAKTLEECRVTLEGLKMENGSLKSHLQGEKQKATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPPPVDEEPESSEVDAAGRWPGVCVSRTSPTPPESATTVKSLIKSFDLGRPGGAGQNISVHKTPRSPLSGIPVRTAPAAAVSPMQRHSTYSSVRPASRGVTQRLDLPDLPLSDILKGRTETLKPDPHLRKSPSLESLSRPPSLGFGDTRLLSASTRAWKPQSKLSVERKDPLAALAREYGGSKRNALLKWCQKKTQGYANIDITNFSSSWSDGLAFCALLHTYLPAHIPYQELNSQEKKRNLLLAFEAAESVGIKPSLELSEMLYTDRPDWQSVMQYVAQIYKYFET

SEQ ID NO: 82999 - protein, 703 aa, Homo sapiens
  Payload ID: 16524
  Gene Symbol: SPECC1
  Gene Name: sperm antigen with calponin homology and coiled-coil domains 1
  Uniprot ID: Q5M775
  ENSP ID: ENSP00000378893
MGNHSGRPEDPEPGAFTTTKRTGIPAPREFSVTVSRERSVPRGPSNPRKSVSSPTSSNTPTPTKHLRTPSTKPKQENEGGEKAALESQVRELLAEAKAKDSEINRLRSELKKYKEKRTLNAEGTDALGPNVDGTSVSPGDTEPMIRALEEKNKNFQKELSDLEEENRVLKEKLIYLEHSPNSEGAASHTGDSSCPTSITQESSFGSPTGNQMSSDIDEYKKNIHGNALRTSGSSSSDVTKASLSPDASDFEHITAETPSRPLSSTSNPFKSSKCSTAGSSPNSVSELSLASLTEKIQKMEENHHSTAEELQATLQELSDQQQMVQELTAENEKLVDEKTILETSFHQHRERAEQLSQENEKLMNLLQERVKNEEPTTQEGKIIELEQKCTGILEQGRFEREKLLNIQQQLTCSLRKVEEENQGALEMIKRLKEENEKLNEFLELERHNNNMMAKTLEECRVTLEGLKMENGSLKSHLQGEKQKATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPP

SEQ ID NO: 83000 - protein, 709 aa, Homo sapiens
  Payload ID: 16524
  Gene Symbol: SPECC1
  Gene Name: sperm antigen with calponin homology and coiled-coil domains 1
  Uniprot ID: Q5M775
  ENSP ID: ENSP00000378896
MGNHSGRPEDPEPGAFTTTKRTGIPAPREFSVTVSRERSVPRGPSNPRKSVSSPTSSNTPTPTKHLRTPSTKPKQENEGGEKAALESQVRELLAEAKAKDSEINRLRSELKKYKEKRTLNAEGTDALGPNVDGTSVSPGDTEPMIRALEEKNKNFQKELSDLEEENRVLKEKLIYLEHSPNSEGAASHTGDSSCPTSITQESSFGSPTGNQMSSDIDEYKKNIHGNALRTSGSSSSDVTKASLSPDASDFEHITAETPSRPLSSTSNPFKSSKCSTAGSSPNSVSELSLASLTEKIQKMEENHHSTAEELQATLQELSDQQQMVQELTAENEKLVDEKTILETSFHQHRERAEQLSQENEKLMNLLQERVKNEEPTTQEGKIIELEQKCTGILEQGRFEREKLLNIQQQLTCSLRKVEEENQGALEMIKRLKEENEKLNEFLELERHNNNMMAKTLEECRVTLEGLKMENGSLKSHLQGEKQKATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPPSLGSVS

SEQ ID NO: 83001 - protein, 1068 aa, Homo sapiens; identical to SEQ ID NO: 82998
  Payload ID: 16524
  Gene Symbol: SPECC1
  Gene Name: sperm antigen with calponin homology and coiled-coil domains 1
  Uniprot ID: Q5M775
  ENSP ID: ENSP00000378898

SEQ ID NO: 83002 - protein, 790 aa, Homo sapiens
  Payload ID: 16524
  Gene Symbol: SPECC1
  Gene Name: sperm antigen with calponin homology and coiled-coil domains 1
  Uniprot ID: Q5M775
  ENSP ID: ENSP00000378900
MRSAAKPWNPAIRAGGHGPDRVRPLPAASSGMKSSKSSTSLAFESRLSRLKRASSEDTLNKPGSTAASGVVRLKKTATAGAISELTESRLRSGTGAFTTTKRTGIPAPREFSVTVSRERSVPRGPSNPRKSVSSPTSSNTPTPTKHLRTPSTKPKQENEGGEKAALESQVRELLAEAKAKDSEINRLRSELKKYKEKRTLNAEGTDALGPNVDGTSVSPGDTEPMIRALEEKNKNFQKELSDLEEENRVLKEKLIYLEHSPNSEGAASHTGDSSCPTSITQESSFGSPTGNQMSSDIDEYKKNIHGNALRTSGSSSSDVTKASLSPDASDFEHITAETPSRPLSSTSNPFKSSKCSTAGSSPNSVSELSLASLTEKIQKMEENHHSTAEELQATLQELSDQQQMVQELTAENEKLVDEKTILETSFHQHRERAEQLSQENEKLMNLLQERVKNEEPTTQEGKIIELEQKCTGILEQGRFEREKLLNIQQQLTCSLRKVEEENQGALEMIKRLKEENEKLNEFLELERHNNNMMAKTLEECRVTLEGLKMENGSLKSHLQGEKQKATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPPSLGSVS

SEQ ID NO: 83003 - protein, 987 aa, Homo sapiens
  Payload ID: 16524
  Gene Symbol: SPECC1
  Gene Name: sperm antigen with calponin homology and coiled-coil domains 1
  Uniprot ID: Q5M775
  ENSP ID: ENSP00000378901
MGNHSGRPEDPEPGAFTTTKRTGIPAPREFSVTVSRERSVPRGPSNPRKSVSSPTSSNTPTPTKHLRTPSTKPKQENEGGEKAALESQVRELLAEAKAKDSEINRLRSELKKYKEKRTLNAEGTDALGPNVDGTSVSPGDTEPMIRALEEKNKNFQKELSDLEEENRVLKEKLIYLEHSPNSEGAASHTGDSSCPTSITQESSFGSPTGNQMSSDIDEYKKNIHGNALRTSGSSSSDVTKASLSPDASDFEHITAETPSRPLSSTSNPFKSSKCSTAGSSPNSVSELSLASLTEKIQKMEENHHSTAEELQATLQELSDQQQMVQELTAENEKLVDEKTILETSFHQHRERAEQLSQENEKLMNLLQERVKNEEPTTQEGKIIELEQKCTGILEQGRFEREKLLNIQQQLTCSLRKVEEENQGALEMIKRLKEENEKLNEFLELERHNNNMMAKTLEECRVTLEGLKMENGSLKSHLQGEKQKATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPPPVDEEPESSEVDAAGRWPGVCVSRTSPTPPESATTVKSLIKSFDLGRPGGAGQNISVHKTPRSPLSGIPVRTAPAAAVSPMQRHSTYSSVRPASRGVTQRLDLPDLPLSDILKGRTETLKPDPHLRKSPSLESLSRPPSLGFGDTRLLSASTRAWKPQSKLSVERKDPLAALAREYGGSKRNALLKWCQKKTQGYANIDITNFSSSWSDGLAFCALLHTYLPAHIPYQELNSQEKKRNLLLAFEAAESVGIKPSLELSEMLYTDRPDWQSVMQYVAQIYKYFET

SEQ ID NO: 83004 - protein, 78 aa, Homo sapiens
  Payload ID: 16524
  Gene Symbol: SPECC1
  Gene Name: sperm antigen with calponin homology and coiled-coil domains 1
  ENSP ID: ENSP00000461918
MRSAAKPWNPAIRAGGHGPDRVRPLPAASSGMKSSKSSTSLAFESRLSRLKRASSEDTLNKPGSTAASGVVRLKKTAT

SEQ ID NO: 83005 - protein, 73 aa, Homo sapiens
  Payload ID: 16524
  Gene Symbol: SPECC1
  Gene Name: sperm antigen with calponin homology and coiled-coil domains 1
  ENSP ID: ENSP00000461944
MRSAAKPWNPAIRAGGHGPDRVRPLPAASSGMKSSKSSTSLAFESRLSRLKRASSEDTLNKPGSTAASGVVRL

SEQ ID NO: 83006 - protein, 167 aa, Homo sapiens
  Payload ID: 16524
  Gene Symbol: SPECC1
  Gene Name: sperm antigen with calponin homology and coiled-coil domains 1
  ENSP ID: ENSP00000462092
  MOD_RES (1)..(1): Any amino acid
XATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKKDSPALAMIGSRSHL

SEQ ID NO: 83007 - protein, 19 aa, Homo sapiens
  Payload ID: 16524
  Gene Symbol: SPECC1
  Gene Name: sperm antigen with calponin homology and coiled-coil domains 1
  ENSP ID: ENSP00000462266
MRSAAKPWNPAIRAGGHGP

SEQ ID NO: 83008 - protein, 534 aa, Homo sapiens
  Payload ID: 16524
  Gene Symbol: SPECC1
  Gene Name: sperm antigen with calponin homology and coiled-coil domains 1
  ENSP ID: ENSP00000462471
  MOD_RES (1)..(1): Any amino acid
XKVEEENQGALEMIKRLKEENEKLNEFLELERHNNNMMAKTLEECRVTLEGLKMENGSLKSHLQGEKQKATEASAVEQTAESCEVQEMLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPPPVDEEPESSEVDAAGRWPGVCVSRTSPTPPESATTVKSLIKSFDLGRPGGAGQNISVHKTPRSPLSGIPVRTAPAAAVSPMQRHSTYSSVRPASRGVTQRLDLPDLPLSDILKGRTETLKPDPHLRKSPSLESLSRPPSLGFGDTRLLSASTRAWKPQSKLSVERKDPLAALAREYGGSKRNALLKWCQKKTQGYAKRNLLLAFEAAESVGIKPSLELSEMLYTDRPDWQSVMQYVAQIYKYFET

SEQ ID NO: 83009 - protein, 46 aa, Homo sapiens
  Payload ID: 16524
  Gene Symbol: SPECC1
  Gene Name: sperm antigen with calponin homology and coiled-coil domains 1
  ENSP ID: ENSP00000462987
  MOD_RES (1)..(1): Any amino acid
XPAHIPYQELNSQEKKRNLLLAFEAAESVGIKPSLVRILFCILVIL

SEQ ID NO: 83010 - protein, 101 aa, Homo sapiens
  Payload ID: 16524
  Gene Symbol: SPECC1
  Gene Name: sperm antigen with calponin homology and coiled-coil domains 1
  ENSP ID: ENSP00000463006
MRSAAKPWNPAIRAGGHGPDRVRPLPAASSGMKSSKSSTSLAFESRLSRLKRASSEDTLNKPGSTAASGVVRLKKTATAGAISELTESRLRSGTGAFTTTK

SEQ ID NO: 83011 - protein, 25 aa, Homo sapiens
  Payload ID: 16524
  Gene Symbol: SPECC1
  Gene Name: sperm antigen with calponin homology and coiled-coil domains 1
  ENSP ID: ENSP00000463130
MGNHSGRPEDPEPGGKGLFIPEGDM

SEQ ID NO: 83012 - protein, 202 aa, Homo sapiens
  Payload ID: 16524
  Gene Symbol: SPECC1
  Gene Name: sperm antigen with calponin homology and coiled-coil domains 1
  ENSP ID: ENSP00000463799
MLKVARAEKDLLELSCNELRQELLKANGEIKHVSSLLAKVEKDYSYLKEICDHQAEQLSRTSLKLQEKASESDAEIKDMKETIFELEDQVEQHRAVKLHNNQLISELESSVIKLEEQKSDLERQLKTLTKQMKEETEEWRRFQADLQTAVVVANDIKCEAQQELRTVKRKLLEEEEKNARLQKELGDVQGHGRVVTSRAAPP

SEQ ID NO: 83013 - protein, 102 aa, Homo sapiens
  Payload ID: 16524
  Gene Symbol: SPECC1
  Gene Name: sperm antigen with calponin homology and coiled-coil domains 1
  ENSP ID: ENSP00000464341
MRSAAKPWNPAIRAGGHGPDRVRPLPAASSGMKSSKSSTSLAFESRLSRLKRASSEDTLNKPGSTAASGVVRLKKTATAGAISELTESRLRSGTGAFTTTKR

SEQ ID NO: 83014 - protein, 132 aa, Homo sapiens
  Payload ID: 16524
  Gene Symbol: SPECC1
  Gene Name: sperm antigen with calponin homology and coiled-coil domains 1
  ENSP ID: ENSP00000464489
MRSAAKPWNPAIRAGGHGPDRVRPLPAASSGMKSSKSSTSLAFESRLSRLKRASSEDTLNKPGSTAASGVVRLKKTATAGAISELTESRLRSGTGAFTTTKRTGIPAPREFSVTVSRERSVPRGPSNPRKSV

SEQ ID NO: 83015 - protein, 21 aa, Homo sapiens
  Payload ID: 16524
  Gene Symbol: SPECC1
  Gene Name: sperm antigen with calponin homology and coiled-coil domains 1
  ENSP ID: ENSP00000464639
MRSAAKPWNPAIRAGGHGPDR

SEQ ID NO: 83016 - protein, 1117 aa, Homo sapiens
  Payload ID: 16525
  Gene Symbol: SPECC1L
  Gene Name: sperm antigen with calponin homology and coiled-coil domains 1-like
  Uniprot ID: Q69YQ0
  ENSP ID: ENSP00000325785
MKKASRSVGSVPKVSAISKTQTAEKIKPENSSSASTGGKLVKPGTAASLSKTKSSDDLLAGMAGGVTVTNGVKGKKSTCPSAAPSASAPAMTTVENKSKISTGTASSTKRSTSTGNKESSSTRERLRERTRLNQSKKLPSAGQGANDMALAKRSRSRTATECDVRMSKSKSDNQISDRAALEAKVKDLLTLAKTKDVEILHLRNELRDMRAQLGINEDHSEGDEKSEKETIMAHQPTDVESTLLQLQEQNTAIREELNQLKNENRMLKDRLNALGFSLEQRLDNSEKLFGYQSLSPEITPGNQSDGGGTLTSSVEGSAPGSVEDLLSQDENTLMDHQHSNSMDNLDSECSEVYQPLTSSDDALDAPSSSESEGIPSIERSRKGSSGNASEVSVACLTERIHQMEENQHSTSEELQATLQELADLQQITQELNSENERLGEEKVILMESLCQQSDKLEHFSRQIEYFRSLLDEHHISYVIDEDVKSGRYMELEQRYMDLAENARFEREQLLGVQQHLSNTLKMAEQDNKEAQEMIGALKERSHHMERIIESEQKGKAALAATLEEYKATVASDQIEMNRLKAQLENEKQKVAELYSIHNSGDKSDIQDLLESVRLDKEKAETLASSLQEDLAHTRNDANRLQDAIAKVEDEYRAFQEEAKKQIEDLNMTLEKLRSDLDEKETERSDMKETIFELEDEVEQHRAVKLHDNLIISDLENTVKKLQDQKHDMEREIKTLHRRLREESAEWRQFQADLQTAVVIANDIKSEAQEEIGDLKRRLHEAQEKNEKLTKELEEIKSRKQEEERGRVYNYMNAVERDLAALRQGMGLSRRSSTSSEPTPTVKTLIKSFDSASQVPNPAAAAIPRTPLSPSPMKTPPAAAVSPMQRHSISGPISTSKPLTALSDKRPNYGEIPVQEHLLRTSSASRPASLPRVPAMESAKTLSVSRRSSEEVKRDISAQEGASPASLMAMGTTSPQLSLSSSPTASVTPTTRSRIREERKDPLSALAREYGGSKRNALLKWCQKKTEGYQNIDITNFSSSWNDGLAFCALLHTYLPAHIPYQELNSQDKRRNFMLAFQAAESVGIKSTLDINEMVRTERPDWQNVMLYVTAIYKYFET

SEQ ID NO: 83017 - protein, 1117 aa, Homo sapiens; identical to SEQ ID NO: 83016
  Payload ID: 16525
  Gene Symbol: SPECC1L
  Gene Name: sperm antigen with calponin homology and coiled-coil domains 1-like
  Uniprot ID: Q69YQ0
  ENSP ID: ENSP00000393363

SEQ ID NO: 83018 - protein, 788 aa, Homo sapiens
  Payload ID: 16525
  Gene Symbol: SPECC1L
  Gene Name: sperm antigen with calponin homology and coiled-coil domains 1-like
  ENSP ID: ENSP00000405671
MKKASRSVGSVPKVSAISKTQTAEKIKPENSSSASTGGKLVKPGTAASLSKTKSSDDLLAGMAGGVTVTNGVKGKKSTCPSAAPSASAPAMTTVENKSKISTGTASSTKRSTSTGNKESSSTRERLRERTRLNQSKKLPSAGQGANDMALAKRSRSRTATECDVRMSKSKSDNQISDRAALEAKVKDLLTLAKTKDVEILHLRNELRDMRAQLGINEDHSEGDEKSEKETIMAHQPTDVESTLLQLQEQNTAIREELNQLKNENRMLKDRLNALGFSLEQRLDNSEKLFGYQSLSPEITPGNQSDGGGTLTSSVEGSAPGSVEDLLSQDENTLMDHQHSNSMDNLDSECSEVYQPLTSSDDALDAPSSSESEGIPSIERSRKGSSGNASEVSVACLTERIHQMEENQHSTSEELQATLQELADLQQITQELNSENERLGEEKVILMESLCQQSDKLEHFSRQIEYFRSLLDEHHISYVIDEDVKSGRYMELEQRYMDLAENARFEREQLLGVQQHLSNTLKMAEQDNKEAQEMIGALKERSHHMERIIESEQKGKAALAATLEEYKATVASDQIEMNRLKAQLENEKQKVAELYSIHNSGDKSDIQDLLESVRLDKEKAETLASSLQEDLAHTRNDANRLQDAIAKVEDEYRAFQEEAKKQIEDLNMTLEKLRSDLDEKETERSDMKETIFELEDEVEQHRAVKLHDNLIISDLENTVKKLQDQKHDMEREIKTLHRRLREESAEWRQFQADLQTAVVIANDIKSEAQEEIGDLKRRLHEAQEKNEKL

SEQ ID NO: 83019 - protein, 175 aa, Homo sapiens
  Payload ID: 16525
  Gene Symbol: SPECC1L
  Gene Name: sperm antigen with calponin homology and coiled-coil domains 1-like
  ENSP ID: ENSP00000414354
MAGGVTVTNGVKGKKSTCPSAAPSASAPAMTTVENKSKISTGTASSTKRSTSTGNKESSSTRERLRERTRLNQSKKLPSAGQGANDMALAKRSRSRTATECDVRMSKSKSDNQISDRAALEAKVKDLLTLAKTKDVEILHLRNELRDMRAQLGINEDHSEGDEKSEKETIMAHQP

SEQ ID NO: 83020 - protein, 1078 aa, Homo sapiens
  Payload ID: 16525
  Gene Symbol: SPECC1L
  Gene Name: sperm antigen with calponin homology and coiled-coil domains 1-like
  Uniprot ID: Q69YQ0
  ENSP ID: ENSP00000439633
MKKASRSVGSVPKVSAISKTQTAEKIKPENSSSASTGGKLVKPGTAASLSKTKSSDDLLAGMAGGVTVTNGVKGKKSTCPSAAPSASAPAMTTVENKSKISTGTASSTKRSTSTGNKESSSTRERLRERTRLNQSKKLPSAGQGANDMALAKRSRSRTATECDVRMSKSKSDNQISDRAALEAKVKDLLTLAKTKDVEILHLRNELRDMRAQLGINEDHSEGDEKSEKETIMAHQPTDVESTLLQLQEQNTAIREELNQLKNENRMLKDRLNALGFSLEQRLDNSEKLFGYQSLSPEITPGNQSDGGGTLTSSVEGSAPGSVEDLLSQDENTLMDHQHSNSMDNLDSECSEVYQPLTSSDDALDAPSSSESEGIPSIERSRKGSSGNASEVSVACLTERIHQMEENQHSTSEELQATLQELADLQQITQELNSENERLGEEKVILMESLCQQSDKLEHFSRQIEYFRSLLDEHHISYVIDEDVKSGRYMELEQRYMDLAENARFEREQLLGVQQHLSNTLKMAEQDNKEAQEMIGALKERSHHMERIIESEQKGKAALAATLEEYKATVASDQIEMNRLKAQLENEKQKVAELYSIHNSGDKSDIQDLLESVRLDKEKAETLASSLQEDLAHTRNDANRLQDAIAKVEDEYRAFQEEAKKQIEDLNMTLEKLRSDLDEKETERSDMKETIFELEDEVEQHRAVKLHDNLIISDLENTVKKLQDQKHDMEREIKTLHRRLREESAEWRQFQADLQTAVVIANDIKSEAQEEIGDLKRRLHEAQEKNEKLTKELEEIKSRKQEEERGRVYNYMNAVERDLAALRQGMGLSRRSSTSSEPTPTVKTLIKSFDSASQVPNPAAAAIPRTPLSPSPMKTPPAAAVSPMQRHSISGPISTSKPLTALSDKRPNYGEIPVQEHLLRTSSASRPASLPRVPAMESAKTLSVSRRSSEEVKRDISAQEGASPASLMAMGTTSPQLSLSSSPTASVTPTTRSRIREERKDPLSALAREYGGSKRNALLKWCQKKTEGYQRRNFMLAFQAAESVGIKSTLDINEMVRTERPDWQNVMLYVTAIYKYFET

SEQ ID NO: 83021 - protein, 926 aa, Homo sapiens
  Payload ID: 16526
  Gene Symbol: SPAG1
  Gene Name: sperm associated antigen 1
  Uniprot ID: Q07617
  ENSP ID: ENSP00000251809
MTTKDYPSLWGFGTTKTFKIPIEHLDFKYIEKCSDVKHLEKILCVLRSGEEGYYPELTEFCEKHLQALAPESRALRKDKPAATAASFTAEEWEKIDGDIKSWVSEIKKEEDKMHFHETETFPAMKDNLPPVRGSNSCLHVGKEKYSKRPTKKKTPRDYAEWDKFDVEKECLKIDEDYKEKTVIDKSHLSKIETRIDTAGLTEKEKDFLATREKEKGNEAFNSGDYEEAVMYYTRSISALPTVVAYNNRAQAEIKLQNWNSAFQDCEKVLELEPGNVKALLRRATTYKHQNKLREATEDLSKVLDVEPDNDLAKKTLSEVERDLKNSEAASETQTKGKRMVIQEIENSEDEEGKSGRKHEDGGGDKKPAEPAGAARAAQPCVMGNIQKKLTGKAEGGKRPARGAPQRGQTPEAGADKRSPRRASAAAAAGGGATGHPGGGQGAENPAGLKSQGNELFRSGQFAEAAGKYSAAIALLEPAGSEIADDLSILYSNRAACYLKEGNCSGCIQDCNRALELHPFSMKPLLRRAMAYETLEQYGKAYVDYKTVLQIDCGLQLANDSVNRLSRILMELDGPNWREKLSPIPAVPASVPLQAWHPAKEMISKQAGDSSSHRQQGITDEKTFKALKEEGNQCVNDKNYKDALSKYSECLKINNKECAIYTNRALCYLKLCQFEEAKQDCDQALQLADGNVKAFYRRALAHKGLKNYQKSLIDLNKVILLDPSIIEAKMELEEVTRLLNLKDKTAPFNKEKERRKIEIQEVNEGKEEPGRPAGEVSMGCLASEKGGKSSRSPEDPEKLPIAKPNNAYEFGQIINALSTRKDKEACAHLLAITAPKDLPMFLSNKLEGDTFLLLIQSLKNNLIEKDPSLVYQHLLYLSKAERFKMMLTLISKGQKELIEQLFEDLSDTPNNHFTLEDIQALKRQYEL

SEQ ID NO: 83022 - protein, 926 aa, Homo sapiens; identical to SEQ ID NO: 83021
  Payload ID: 16526
  Gene Symbol: SPAG1
  Gene Name: sperm associated antigen 1
  Uniprot ID: Q07617
  ENSP ID: ENSP00000373450

SEQ ID NO: 83023 - protein, 416 aa, Homo sapiens
  Payload ID: 16526
  Gene Symbol: SPAG1
  Gene Name: sperm associated antigen 1
  Uniprot ID: Q07617
  ENSP ID: ENSP00000427716
MTTKDYPSLWGFGTTKTFKIPIEHLDFKYIEKCSDVKHLEKILCVLRSGEEGYYPELTEFCEKHLQALAPESRALRKDKPAATAASFTAEEWEKIDGDIKSWVSEIKKEEDKMHFHETETFPAMKDNLPPVRGSNSCLHVGKEKYSKRPTKKKTPRDYAEWDKFDVEKECLKIDEDYKEKTVIDKSHLSKIETRIDTAGLTEKEKDFLATREKEKGNEAFNSGDYEEAVMYYTRSISALPTVVAYNNRAQAEIKLQNWNSAFQDCEKVLELEPGNVKALLRRATTYKHQNKLREATEDLSKVLDVEPDNDLAKKTLSEVERDLKNSEAASETQTKGKRMVIQEIENSEDEEGKSGRKHEDGGGDKSKIFFLFRLCKKLPFNMMSWLNFSIRTEIRNLSVFLALPCKFTSQFRSSFS

SEQ ID NO: 83024 - protein, 416 aa, Homo sapiens; identical to SEQ ID NO: 83023
  Payload ID: 16526
  Gene Symbol: SPAG1
  Gene Name: sperm associated antigen 1
  Uniprot ID: Q07617
  ENSP ID: ENSP00000428070

SEQ ID NO: 83025 - protein, 82 aa, Homo sapiens
  Payload ID: 16527
  Gene Symbol: SPAG11A
  Gene Name: sperm associated antigen 11A
  Uniprot ID: Q6PDA7
  ENSP ID: ENSP00000297496
MRQRLLPSVTSLLLVALLFPGSSQARHVNHSATEALGELRERAPGQGTNGFQLLRHAVKRDLLPPRTPPYQGTGQQHRQRCG

SEQ ID NO: 83026 - protein, 108 aa, Homo sapiens
  Payload ID: 16527
  Gene Symbol: SPAG11A
  Gene Name: sperm associated antigen 11A
  ENSP ID: ENSP00000316012
MRQRLLPSVTSLLLVALLFPGSSQARHVNHSATEALGELRERAPGQGTNGFQLLRHAVKRDLLPPRTPPYQGDVPLGIRNTICRMQQGICRLFFCHSGTGQQHRQRCG

SEQ ID NO: 83027 - protein, 80 aa, Homo sapiens
  Payload ID: 16527
  Gene Symbol: SPAG11A
  Gene Name: sperm associated antigen 11A
  ENSP ID: ENSP00000316648
MKVFFLFAVLFCLVQTNSGDVPLGIRNTICRMQQGICRLFFCHSGEKKRDISSDPWNRCCVSNTDEEGKEKPEMDGRSGI

SEQ ID NO: 83028 - protein, 113 aa, Homo sapiens
  Payload ID: 16527
  Gene Symbol: SPAG11A
  Gene Name: sperm associated antigen 11A
  ENSP ID: ENSP00000382990
MRQRLLPSVTSLLLVALLFPGSSQARHVNHSATEALGELRERAPGQGTNGFQLLRHAVKRDLLPPRTPPYQEPASDLKVVDCRRSEGFCQEYCNYMETQVGYCSKKKDACCLH

SEQ ID NO: 83029 - protein, 50 aa, Homo sapiens
  Payload ID: 16527
  Gene Symbol: SPAG11A
  Gene Name: sperm associated antigen 11A
  ENSP ID: ENSP00000394885
MKVFFLFAVLFCLVQTNSVHISHQEARGPSFKICVGFLGPRWARGCSTGN

SEQ ID NO: 83030 - protein, 103 aa, Homo sapiens
  Payload ID: 16527
  Gene Symbol: SPAG11A
  Gene Name: sperm associated antigen 11A
  ENSP ID: ENSP00000416991
MRQRLLPSVTSLLLVALLFPGSSQARHVNHSATEALGELRERAPGQGTNGFQLLRHAVKRDLLPPRTPPYQVHISHQEARGPSFKICVGFLGPRWARGCSTGN

SEQ ID NO: 83031 - protein, 53 aa, Homo sapiens
  Payload ID: 16527
  Gene Symbol: SPAG11A
  Gene Name: sperm associated antigen 11A
  ENSP ID: ENSP00000434968
SSQARHVNHSATEALGELRERAPGQGTNGFQLLRHAVKRDLLPPRTPPYQEMK

SEQ ID NO: 83032 - protein, 106 aa, Homo sapiens
  Payload ID: 16527
  Gene Symbol: SPAG11A
  Gene Name: sperm associated antigen 11A
  ENSP ID: ENSP00000436043
  MOD_RES (1)..(1): Any amino acid
XFPGSSQARHVNHSATEALGELRERAPGQGTNGFQLLRHAVKRDLLPPRTPPYQGTHSVAQAGVQWHCYRLLQPLPPGLKCSSHLSLPNTWDHRHAPLHTASFFRC

SEQ ID NO: 83033 - protein, 103 aa, Homo sapiens
  Payload ID: 16528
  Gene Symbol: SPAG11B
  Gene Name: sperm associated antigen 11B
  Uniprot ID: Q08648
  ENSP ID: ENSP00000297498
MRQRLLPSVTSLLLVALLFPGSSQARHVNHSATEALGELRERAPGQGTNGFQLLRHAVKRDLLPPRTPPYQVHISHREARGPSFRICVDFLGPRWARGCSTGN

SEQ ID NO: 83034 - protein, 113 aa, Homo sapiens; identical to SEQ ID NO: 83028
  Payload ID: 16528
  Gene Symbol: SPAG11B
  Gene Name: sperm associated antigen 11B
  Uniprot ID: Q08648
  ENSP ID: ENSP00000322591

SEQ ID NO: 83035 - protein, 108 aa, Homo sapiens
  Payload ID: 16528
  Gene Symbol: SPAG11B
  Gene Name: sperm associated antigen 11B
  ENSP ID: ENSP00000352797
MRQRLLPSVTSLLLVALLFPGSSQARHVNHSATEALGELRERAPGQGTNGFQLLRHAVKRDLLPPRTPPYQGDVPPGIRNTICHMQQGICRLFFCHSGTGQQHRQRCG

SEQ ID NO: 83036 - protein, 82 aa, Homo sapiens; identical to SEQ ID NO: 83025
  Payload ID: 16528
  Gene Symbol: SPAG11B
  Gene Name: sperm associated antigen 11B
  ENSP ID: ENSP00000354411

SEQ ID NO: 83037 - protein, 133 aa, Homo sapiens
  Payload ID: 16528
  Gene Symbol: SPAG11B
  Gene Name: sperm associated antigen 11B
  ENSP ID: ENSP00000381480
MRQRLLPSVTSLLLVALLFPGSSQARHVNHSATEALGELRERAPGQGTNGFQLLRHAVKRDLLPPRTPPYQGDVPPGIRNTICHMQQGICRLFFCHSGEKKRDICSDPWNRCCVSNTDEEGKEKPEMDGRSGI

SEQ ID NO: 83038 - protein, 80 aa, Homo sapiens
  Payload ID: 16528
  Gene Symbol: SPAG11B
  Gene Name: sperm associated antigen 11B
  Uniprot ID: Q08648
  ENSP ID: ENSP00000398550
MKVFFLFAVLFCLVQTNSGDVPPGIRNTICHMQQGICRLFFCHSGEKKRDICSDPWNRCCVSNTDEEGKEKPEMDGRSGI

SEQ ID NO: 83039 - protein, 50 aa, Homo sapiens
  Payload ID: 16528
  Gene Symbol: SPAG11B
  Gene Name: sperm associated antigen 11B
  Uniprot ID: Q08648
  ENSP ID: ENSP00000431230
MKVFFLFAVLFCLVQTNSVHISHREARGPSFRICVDFLGPRWARGCSTGN

SEQ ID NO: 83040 - protein, 53 aa, Homo sapiens; identical to SEQ ID NO: 83031
  Payload ID: 16528
  Gene Symbol: SPAG11B
  Gene Name: sperm associated antigen 11B
  ENSP ID: ENSP00000432257

SEQ ID NO: 83041 - protein, 106 aa, Homo sapiens
  Payload ID: 16528
  Gene Symbol: SPAG11B
  Gene Name: sperm associated antigen 11B
  ENSP ID: ENSP00000437154
LFPGSSQARHVNHSATEALGELRERAPGQGTNGFQLLRHAVKRDLLPPRTPPYQGTHSVAQAGVQWHCYRLLQPLPPGLKCSSHLSLPNTWDHRHAPLHTASFFRC

SEQ ID NO: 83042 - protein, 113 aa, Homo sapiens
  Payload ID: 16528
  Gene Symbol: SPAG11B
  Gene Name: sperm associated antigen 11B
  ENSP ID: ENSP00000477700
MRQRLLPSVTSLLLVALLFPGSSQARHVNHSATEALGELRERAPGQGTNGFQLLRHAVKRDLLQPRTPPYQEPASDLKVVDCRRSEGFCQEYCNYMETQVGYCSKKKDACCLH

SEQ ID NO: 83043 - protein, 133 aa, Homo sapiens
  Payload ID: 16528
  Gene Symbol: SPAG11B
  Gene Name: sperm associated antigen 11B
  ENSP ID: ENSP00000480728
MRQRLLPSVTSLLLVALLFPGSSQARHVNHSATEALGELRERAPGQGTNGFQLLRHAVKRDLLQPRTPPYQGDVPPGIRNTICHMQQGICRLFFCHSGEKKRDICSDPWNRCCVSNTDEEGKEKPEMDGRSGI

SEQ ID NO: 83044 - protein, 103 aa, Homo sapiens
  Payload ID: 16528
  Gene Symbol: SPAG11B
  Gene Name: sperm associated antigen 11B
  ENSP ID: ENSP00000481016
MRQRLLPSVTSLLLVALLFPGSSQARHVNHSATEALGELRERAPGQGTNGFQLLRHAVKRDLLQPRTPPYQVHISHREARGPSFRICVDFLGPRWARGCSTGN

SEQ ID NO: 83045 - protein, 50 aa, Homo sapiens; identical to SEQ ID NO: 83039
  Payload ID: 16528
  Gene Symbol: SPAG11B
  Gene Name: sperm associated antigen 11B
  Uniprot ID: Q08648
  ENSP ID: ENSP00000481630

SEQ ID NO: 83046 - protein, 108 aa, Homo sapiens
  Payload ID: 16528
  Gene Symbol: SPAG11B
  Gene Name: sperm associated antigen 11B
  ENSP ID: ENSP00000482321
MRQRLLPSVTSLLLVALLFPGSSQARHVNHSATEALGELRERAPGQGTNGFQLLRHAVKRDLLQPRTPPYQGDVPPGIRNTICHMQQGICRLFFCHSGTGQQHRQRCG

SEQ ID NO: 83047 - protein, 80 aa, Homo sapiens; identical to SEQ ID NO: 83038
  Payload ID: 16528
  Gene Symbol: SPAG11B
  Gene Name: sperm associated antigen 11B
  Uniprot ID: Q08648
  ENSP ID: ENSP00000483205

SEQ ID NO: 83048 - protein, 82 aa, Homo sapiens
  Payload ID: 16528
  Gene Symbol: SPAG11B
  Gene Name: sperm associated antigen 11B
  ENSP ID: ENSP00000483423
MRQRLLPSVTSLLLVALLFPGSSQARHVNHSATEALGELRERAPGQGTNGFQLLRHAVKRDLLQPRTPPYQGTGQQHRQRCG

SEQ ID NO: 83049 - protein, 53 aa, Homo sapiens
  Payload ID: 16528
  Gene Symbol: SPAG11B
  Gene Name: sperm associated antigen 11B
  ENSP ID: ENSP00000486300
SSQARHVNHSATEALGELRERAPGQGTNGFQLLRHAVKRDLLQPRTPPYQEMK

SEQ ID NO: 83050 - protein, 103 aa, Homo sapiens
  Payload ID: 16528
  Gene Symbol: SPAG11B
  Gene Name: sperm associated antigen 11B
  ENSP ID: ENSP00000486365
  MOD_RES (1)..(1): Any amino acid
XSSQARHVNHSATEALGELRERAPGQGTNGFQLLRHAVKRDLLQPRTPPYQGTHSVAQAGVQWHCYRLLQPLPPGLKCSSHLSLPNTWDHRHAPLHTASFFRC

SEQ ID NO: 83051 - protein, 318 aa, Homo sapiens [sequence omitted]

SEQ ID NO: 83052 - protein, 631 aa, Homo sapiens
  Payload ID: 16529
  Gene Symbol: SPAG16
  Gene Name: sperm associated antigen 16
  Uniprot ID: Q8N0X2
  ENSP ID: ENSP00000332592
MAAQRGMPSSAVRVLEEALGMGLTAAGDARDTADAVAAEGAYYLEQVTITEASEDDYEYEEIPDDNFSIPEGEEDLAKAIQMAQEQATDTEILERKTVLPSKHAVPEVIEDFLCNFLIKMGMTRTLDCFQSEWYELIQKGVTELRTVGNVPDVYTQIMLLENENKNLKKDLKHYKQAADKAREDLLKIQKERDFHRMHHKRIVQEKNKLINDLKGLKLHYASYEPTIRVLHEKHHTLLKEKMLTSLERDKVVGQISGLQETLKKLQRGHSYHGPQIKVDHSREKENAPEGPTQKGLREAREQNKCKTKMKGNTKDSEFPIDMQPNPNLNVSKESLSPAKFDYKLKNIFRLHELPVSCVSMQPHKDILVSCGEDRLWKVLGLPKCNVLLTGFGHTDWLSDCCFHPSGDKLATSSGDTTVKLWDLCKGDCILTFEGHSRAVWSCTWHSCGNFVASSSLDKTSKIWDVNSERCRCTLYGHTDSVNSIEFFPFSNTLLTSSADKTLSIWDARTGICEQSLYGHMHSINDAIFDPRGHMIASCDACGVTKLWDFRKLLPIVSIDIGPSPGNEVNFDSSGRVLAQASGNGVIHLLDLKSGEIHKLMGHENEAHTVVFSHDGEILFSGGSDGTVRTWS

SEQ ID NO: 83053 - protein, 57 aa, Homo sapiens
  Payload ID: 16529
  Gene Symbol: SPAG16
  Gene Name: sperm associated antigen 16
  ENSP ID: ENSP00000385496
MAAQRGMPSSAVRVLEEALGMGLTAAGDARDTADAVAAEGAYYLEPYLYPVPLLLND

SEQ ID NO: 83054 - protein, 251 aa, Homo sapiens
  Payload ID: 16529
  Gene Symbol: SPAG16
  Gene Name: sperm associated antigen 16
  ENSP ID: ENSP00000390494
MGVGTKARASHWRRLLSLGATPEEPLLDFKIPDDNFSIPEGEEDLAKAIQMAQEQATDTEILERKTVLPSKHAVPEVIEDFLCNFLIKMGMTRTLDCFQSEWYELIQKGVTELRTVGNVPDVYTQIMLLENENKNLKKDLKHYKQAADKAREDLLKIQKERDFHRMHHKRIVQEKNKLINDLKGLKLHYASYEPTIRVLHEKHHTLLKEKMLTSLERDKVVGQISGLQETLKKLQRGHSYHGPQIKGKCKM

SEQ ID NO: 83055 - protein, 64 aa, Homo sapiens
  Payload ID: 16529
  Gene Symbol: SPAG16
  Gene Name: sperm associated antigen 16
  ENSP ID: ENSP00000398926
MAAQRGMPSSAVRVLEEALGMGLTAAGDARDTADAVAAEGAYYLEQVTITEASEDDYEYEEVTC

SEQ ID NO: 83056 - protein, 374 aa, Homo sapiens
  Payload ID: 16529
  Gene Symbol: SPAG16
  Gene Name: sperm associated antigen 16
  ENSP ID: ENSP00000400847
MAAQRGMPSSAVRVLEEALGMGLTAAGDARDTADAVAAEGAYYLEQVTITEASEDDYEYEEIPDDNFSIPEGEEDLAKAIQMAQEQATDTEILERKTVLPSKHAVPEVIEDFLCNFLIKMGMTRTLDCFQSEWYELIQKGVTELRTVGNVPDVYTQIMLLENENKNLKKDLKHYKQAADKAREDLLKIQKERDFHRMHHKRIVQEKNKLINDLKGLKLHYASYEPTIRVLHEKHHTLLKEKMLTSLERDKVVGQISGLQETLKKLQRGHSYHGPQIKVDHSREKENAPEGPTQKGLREAREQNKCKTKMKGNTKVMRRREELWPFREPRPRSSTSQCCDTLFGAVQFQMFPSIQTPLNSHPDLGAHSRSCLECI

SEQ ID NO: 83057 - protein, 94 aa, Homo sapiens
  Payload ID: 16529
  Gene Symbol: SPAG16
  Gene Name: sperm associated antigen 16
  ENSP ID: ENSP00000404949
MAAQRGMPSSAVRVLEEALGMGLTAAGDARDTADAVAAEGAYYLEQVTITEASEDDYEYEEIPDDNFSIPEGEEDLAKAIQMAQEQATDTEILV

SEQ ID NO: 83058 - protein, 98 aa, Homo sapiens
  Payload ID: 16529
  Gene Symbol: SPAG16
  Gene Name: sperm associated antigen 16
  ENSP ID: ENSP00000411077
MAAQRGMPSSAVRVLEEALGMGLTAAGDARDTADAVAAEGAYYLEQVTITEASEDDYEYEEIKAVAHKLILNLLEVTFIDIYKEVRRKQLFIFHGSSE

SEQ ID NO: 83059 - protein, 183 aa, Homo sapiens
  Payload ID: 16529
  Gene Symbol: SPAG16
  Gene Name: sperm associated antigen 16
  Uniprot ID: Q8N0X2
  ENSP ID: ENSP00000415079
MAAQRGMPSSAVRVLEEALGMGLTAAGDARDTADAVAAEGAYYLEQVTITEASEDDYEYEEIPDDNFSIPEGEEDLAKAIQMAQEQATDTEILERKTVLPSKHAVPEVIEDFLCNFLIKMGMTRTLDCFQSEWYELIQKGVTELRTVGNVPDVYTQIMLLENENKNLKKDLKHYKQAAEYVIF

SEQ ID NO: 83060 - protein, 255 aa, Homo sapiens
  Payload ID: 16529
  Gene Symbol: SPAG16
  Gene Name: sperm associated antigen 16
  ENSP ID: ENSP00000416600
DSEFPIDMQPNPNLNVSKESLSPAKFDYKLKNIFRLHELPVSCVSMQPHKDILVSCGEDRLWKVLGLPKCNVLLTGFGHTDWLSDCCFHPSERCRCTLYGHTDSVNSIEFFPFSNTLLTSSADKTLSIWDARTGICEQSLYGHMHSINDAIFDPRGHMIASCDACGVTKLWDFRKLLPIVSIDIGPSPGNEVNFDSSGRVLAQASGNGVIHLLDLKSGEIHKLMGHENEAHTVVFSHDGEILFSGGSDGTVRTWS

SEQ ID NO: 83061 - protein, 2223 aa, Homo sapiens
  Payload ID: 16530
  Gene Symbol: SPAG17
  Gene Name: sperm associated antigen 17
  Uniprot ID: Q6Q759
  ENSP ID: ENSP00000337804
MAPKKEKGGTVNTSSKIWEPSLIAAQFNQNDWQASIAFVVGNQIEDDLLIQALTVAVQVPQRKLFSMVSWQDILQQINEINTLVGSASSKKAKKPVGGNAPLYYEVLTAAKAIMDSGEKLTLPLIGKLLKFQLLQIKFKDQQRRENEKKVIEDKPKLEKDKGKAKSPKEKKAPSAKPAKGKGKDQPEANAPVKKTTQLKRRGEDDHTNRYIDDEPDDGAQHYIIVVGFNNPQLLAIMAELGIPITSVIKISSENYEPLQTHLAAVNQQQEVLLQSEDLEAEKLKKENAIKELKTFWKYLEPVLNNEKPETNLFDVARLEYMVKAADFPSDWSDGEMMLKLGTDIFENIACLMYDILDWKRQHQHYLESMQLINVPQVVNEKPVLEAMPTSEAPQPAVPAPGKKKAQYEEPQAPPPVTSVITTEVDMRYYNYLLNPIREEFISVPLILHCMLEQVVATEEDLVPPSLREPSPRADGLDHRIAAHIVSLLPSLCLSEREKKNLHDIFLSEEENESKAVPKGPLLLNYHDAHAHKKYALQDQKNFDPVQIEQEMQSKLPLWEFLQFPLPPPWNNTKRLATIHELMHFCTSDVLSWNEVERAFKVFTFESLKLSEVDEKGKLKPSGMMCGSDSEMFNIPWDNPARFAKQIRQQYVMKMNTQEAKQKADIKIKDRTLFVDQNLSMSVQDNESNREPSDPSQCDANNMKHSDLNNLKLSVPDNRQLLEQESIMKAQPQHESLEQTTNNEIKDDAVTKADSHEKKPKKMMVEADLEDIKKTQQRSLMDWSFTEHFKPKVLLQVLQEAHKQYRCVDSYYHTQDNSLLLVFHNPMNRQRLHCEYWNIALHSNVGFRNYLELVAKSIQDWITKEEAIYQESKMNEKIIRTRAELELKSSANAKLTSASKIFSIKESKSNKGISKTEISDQEKEKEKEKIPFILEGSLKAWKEEQHRLAEEERLREEKKAEKKGKEAGKKKGKDNAEKEDSRSLKKKSPYKEKSKEEQVKIQEVTEESPHQPEPKITYPFHGYNMGNIPTQISGSNYYLYPSDGGQIEVEKTMFEKGPTFIKVRVVKDNHNFMIHLNDPKEIVKKEEKGDYYLEEEEEGDEEQSLETEVSDAKNKAFSKFGSFSATLENGICLSISYYGSNGMAPEDKDPDLETILNIPSALTPTVVPVIVTVPQSKAKGKIKGKEKPKESLKEEEHPKEEEKKEEEVEPEPVLQETLDVPTFQSLNVSCPSGLLLTFIGQESTGQYVIDEEPTWDIMVRQSYPQRVKHYEFYKTVMPPAEQEASRVITSQGTVVKYMLDGSTQILFADGAVSRSPNSGLICPPSEMPATPHSGDLMDSISQQKSETIPSEITNTKKGKSHKSQSSMAHKGEIHDPPPEAVQTVTPVEVHIGTWFTTTPEGNRIGTKGLERIADLTPLLSFQATDPVNGTVMTTREDKVVIVERKDGTRIVDHADGTRITTFYQVYEDQIILPDDQETTEGPRTVTRQVKCMRVESSRYATVIANCEDSSCCATFGDGTTIIAKPQGTYQVLPPNTGSLYIDKDCSAVYCHESSSNIYYPFQKREQLRAGRYIMRHTSEVICEVLDPEGNTFQVMADGSISTILPEKKLEDDLNEKTEGYDSLSSMHLEKNHQQIYGEHVPRFFVMYADGSGMELLRDSDIEEYLSLAYKESNTVVLQEPVQEQPGTLTITVLRPFHEASPWQVKKEDTIVPPNLRSRSWETFPSVEKKTPGPPFGTQIWKGLCIESKQLVSAPGAILKSPSVLQMRQFIQHEVIKNEVKLRLQVSLKDYINYILKKEDELQEMMVKDSRTEEERGNAADLLKLVMSFPKMEETTKSHVTEVAAHLTDLFKQSLATPPKCPPDTFGKDFFEKTWRHTASSKRWKEKIDKTRKEIETTQNYLMDIKNRIIPPFFKSELNQLYQSQYNHLDSLSKKLPSFTKKNEDANETAVQDTSDLNLDFKPHKVSEQKSSSVPSLPKPEISADKKDFTAQNQTENLTKSPEEAESYEPVKIPTQSLLQDVAGQTRKEKVKLPHYLLSSKPKSQPLAKVQDSVGGKVNTSSVASAAINNAKSSLFGFHLLPSSVKFGVLKEGHTYATVVKLKNVGVDFCRFKVKQPPPSTGLKVTYKPGPVAAGMQTELNIELFATAVGEDGAKGSAHISHNIEIMTEHEVLFLPVEATVLTSSNYDKRPKDFPQGKENPMVQRTSTIYSSTLGVFMSRKVSPH

SEQ ID NO: 83062 - protein, 660 aa, Homo sapiens
  Payload ID: 16530
  Gene Symbol: SPAG17
  Gene Name: sperm associated antigen 17
  ENSP ID: ENSP00000402749
IAKPQGTYQVLPPNTGSLYIDKDCSAVYCHESSSNIYYPFQKREQLRAGRYIMRHTSEVICEVLDPEGNTFQVMADGSISTILPEKKLEDDLNEKTEGYDSLSSMHLEKNHQQIYGEHVPRFFVMYADGSGMELLRDSDIEEYLSLAYKESNTVVLQEPVQEQPGTLTITVLRPFHEASPWQVKKEDTIVPPNLRSRSWETFPSVEKKTPGPPFGTQIWKGLCIESKQLVSAPGAILKSPSVLQMRQFIQHEVIKNEVKLRLQVSLKDYINYILKKEDELQEMMVKDSRTEEERGNAADLLKLVMSFPKMEETTKSHVTEVAAHLTDLFKQSLATPPKCPPDTFGKDFFEKTWRHTASSKRWKEKIDKTRKEIETTQNYLMDIKNRIIPPFFKSELNQLYQSQYNHLDSLSKKLPSFTKKNEDANETAVQDTSDLNLDFKPHKVSEQKSSSVPSLPKPEISADKKDFTAQNQTENLTKSPEEAESYEPVKIPTQSLLQDVAGQTRKEKVKLPHYLLSSKPKSQPLAKVQDSVGGKVNTSSVASAAINNAKSSLFGFHLLPSSVKFGVLKEGHTYATVVKLKNVGVDFCRFKVKQPPPSTGLKVTYKPGPVAAGMQTELNIELFATAVGEDGAKGSAHISHNIEIMTEHEVLFLPVEANIL

SEQ ID NO: 83063 - protein, 437 aa, Homo sapiens
  Payload ID: 16531
  Gene Symbol: SPAG4
  Gene Name: sperm associated antigen 4
  Uniprot ID: Q9NPE6
  ENSP ID: ENSP00000363391
MRRSSRPGSASSSRKHTPNFFSENSSMSITSEDSKGLRSAEPGPGEPEGRRARGPSCGEPALSAGVPGGTTWAGSSQQKPAPRSHNWQTACGAATVRGGASEPTGSPVVSEEPLDLLPTLDLRQEMPPPRVFKSFLSLLFQGLSVLLSLAGDVLVSMYREVCSIRFLFTAVSLLSLFLSAFWLGLLYLVSPLENEPKEMLTLSEYHERVRSQGQQLQQLQAELDKLHKEVSTVRAANSERVAKLVFQRLNEDFVRKPDYALSSVGASIDLQKTSHDYADRNTAYFWNRFSFWNYARPPTVILEPHVFPGNCWAFEGDQGQVVIQLPGRVQLSDITLQHPPPSVEHTGGANSAPRDFAVFGLQVYDETEVSLGKFTFDVEKSEIQTFHLQNDPPAAFPKVKIQILSNWGHPRFTCLYRVRAHGVRTSEGAEGSAQGPH

SEQ ID NO: 83064 - protein, 214 aa, Homo sapiens
  Payload ID: 16531
  Gene Symbol: SPAG4
  Gene Name: sperm associated antigen 4
  ENSP ID: ENSP00000396670
MPPPRVFKSFLSLLFQGLSVLLSLAGDVLVSMYREVCSIRFLFTAVSLLSLFLSAFWLGLLYLVSPLENEPKEMLTLSEYHERVRSQGQQLQQLQAELDKLHKEVSTVRAANSERVAKLVFQRLNEDFVRKPDYALSSVGASIDLQKTSHDYADRNTAYFWNRFSFWNYARPPTVILEPHVFPGNCWAFEGDQGQVVIQLPGRVQLSDITLQHP

SEQ ID NO: 83065 - protein, 141 aa, Homo sapiens
  Payload ID: 16531
  Gene Symbol: SPAG4
  Gene Name: sperm associated antigen 4
  ENSP ID: ENSP00000399231
VFPGNCWAFEGDQGQVVIQLPGRVQLSDITLQHPPPSVEHTGGANSAPRDFAVFFLLSFFTHQGLQVYDETEVSLGKFTFDVEKSEIQTFHLQNDPPAAFPKVKIQILSNWGHPRFTCLYRVRAHGVRTSEGAEGSAQGPH

SEQ ID NO: 83066 - protein, 1193 aa, Homo sapiens
  Payload ID: 16532
  Gene Symbol: SPAG5
  Gene Name: sperm associated antigen 5
  Uniprot ID: Q96R06
  ENSP ID: ENSP00000323300
MWRVKKLSLSLSPSPQTGKPSMRTPLRELTLQPGALTNSGKRSPACSSLTPSLCKLGLQEGSNNSSPVDFVNNKRTDLSSEHFSHSSKWLETCQHESDEQPLDPIPQISSTPKTSEEAVDPLGNYMVKTIVLVPSPLGQQQDMIFEARLDTMAETNSISLNGPLRTDDLVREEVAPCMGDRFSEVAAVSEKPIFQESPSHLLEESPPNPCSEQLHCSKESLSSRTEAVREDLVPSESNAFLPSSVLWLSPSTALAADFRVNHVDPEEEIVEHGAMEEREMRFPTHPKESETEDQALVSSVEDILSTCLTPNLVEMESQEAPGPAVEDVGRILGSDTESWMSPLAWLEKGVNTSVMLENLRQSLSLPSMLRDAAIGTTPFSTCSVGTWFTPSAPQEKSTNTSQTGLVGTKHSTSETEQLLCGRPPDLTALSRHDLEDNLLSSLVILEVLSRQLRDWKSQLAVPHPETQDSSTQTDTSHSGITNKLQHLKESHEMGQALQQARNVMQSWVLISKELISLLHLSLLHLEEDKTTVSQESRRAETLVCCCFDLLKKLRAKLQSLKAEREEARHREEMALRGKDAAEIVLEAFCAHASQRISQLEQDLASMREFRGLLKDAQTQLVGLHAKQEELVQQTVSLTSTLQQDWRSMQLDYTTWTALLSRSRQLTEKLTVKSQQALQERDVAIEEKQEVSRVLEQVSAQLEECKGQTEQLELENSRLATDLRAQLQILANMDSQLKELQSQHTHCAQDLAMKDELLCQLTQSNEEQAAQWQKEEMALKHMQAELQQQQAVLAKEVRDLKETLEFADQENQVAHLELGQVECQLKTTLEVLRERSLQCENLKDTVENLTAKLASTIADNQEQDLEKTRQYSQKLGLLTEQLQSLTLFLQTKLKEKTEQETLLLSTACPPTQEHPLPNDRTFLGSILTAVADEEPESTPVPLLGSDKSAFTRVASMVSLQPAETPGMEESLAEMSIMTTELQSLCSLLQESKEEAIRTLQRKICELQARLQAQEEQHQEVQKAKEADIEKLNQALCLRYKNEKELQEVIQQQNEKILEQIDKSGELISLREEVTHLTRSLRRAETETKVLQEALAGQLDSNCQPMATNWIQEKVWLSQEVDKLRVMFLEMKNEKEKLMIKFQSHRNILEENLRRSDKELEKLDDIVQHIYKTLLSIPEVVRGCKELQGLLEFLS

SEQ ID NO: 83067 - protein, 272 aa, Homo sapiens
  Payload ID: 16532
  Gene Symbol: SPAG5
  Gene Name: sperm associated antigen 5
  ENSP ID: ENSP00000444223
MWRVKKLSLSLSPSPQTGKPSMRTPLRELTLQPGALTNSGKRSPACSSLTPSLCKLGLQVRFAWTASRLGCLPREGSNNSSPVDFVNNKRTDLSSEHFSHSSKWLETCQHESDEQPLDPIPQISSTPKTSEEAVDPLGNYMVKTIVLVPSPLGQQQDMIFEARLDTMAETNSISLNGPLRTDDLVREEVAPCMGDRFSEVAAVSEKPIFQESPSHLLEESPPNPCSEQLHCSKESLSSRTEAVREDLVPSESNAFLPSSVLWLSPSTALAAD

SEQ ID NO: 83068 - protein, 72 aa, Homo sapiens
  Payload ID: 16532
  Gene Symbol: SPAG5
  Gene Name: sperm associated antigen 5
  ENSP ID: ENSP00000462663
MWRVKKLSLSLSPSPQTGKPSMRTPLRELTLQPGALTNSGKRSPACSSLTPSLCKLGLQISVSIMWTQRRKL

SEQ ID NO: 83069 - protein, 238 aa, Homo sapiens
  Payload ID: 16532
  Gene Symbol: SPAG5
  Gene Name: sperm associated antigen 5
  ENSP ID: ENSP00000463095
  MOD_RES (1)..(1): Any amino acid
XPHPETQDSSTQTDTSHSGITNKLQHLKESHEMGQALQQARNVMQSWVLISKELISLLHLSLLHLEEDKTTVSQESRRAETLVCCCFDLLKKLRAKLQSLKAEREEARHREEMALRGKDAVGLHAKQEELVQQTVSLTSTLQQDWRSMQLDYTTWTALLSRSRQLTEKLTVKSQQALQERDVAIEEKQEVSRVLEQVSAQLEECKGQTEQLELENSRLATDLRAQLQILANMDSQLKE

SEQ ID NO: 83070 - protein, 57 aa, Homo sapiens
  Payload ID: 16532
  Gene Symbol: SPAG5
  Gene Name: sperm associated antigen 5
  ENSP ID: ENSP00000464280
QEQDLEKTRQYSQKLGLLTEQLQSLTLFLQTKLKEKTMFQESRNIAFFGLPAVCTKQ

SEQ ID NO: 83071 - protein, 73 aa, Homo sapiens
  Payload ID: 16532
  Gene Symbol: SPAG5
  Gene Name: sperm associated antigen 5
  ENSP ID: ENSP00000464400
MWRVKKLSLSLSPSPQTGKPSMRTPLRELTLQPGALTNSGKRSPACSSLTPSLCKLGLQQISVSIMWTQRRKL

SEQ ID NO: 83072 - protein, 129 aa, Homo sapiens
  Payload ID: 16532
  Gene Symbol: SPAG5
  Gene Name: sperm associated antigen 5
  ENSP ID: ENSP00000464474
SRRAETLVCCCFDLLKKLRAKLQSLKAEREEARHREEMALRGKDAVGLHAKQEELVQQTVSLTSTLQQDWRSMQLDYTTWTALLSRSRQLTEKLTVKSQQALQERDVAIEEKQEISGLSCRFWPTWTAS

SEQ ID NO: 83073 - protein, 186 aa, Homo sapiens
  Payload ID: 16532
  Gene Symbol: SPAG5
  Gene Name: sperm associated antigen 5
  ENSP ID: ENSP00000466021
  MOD_RES (1)..(1): Any amino acid
XLATDLRAQLQILANMDSQLKELQSQHTHCAQDLAMKDELLCQLTQSNEEQAAQWQKEEMALKHMQAELQQQQAVLAKEVRDLKETLEFADQENQVAHLELGQVECQLKTTLEVLRERSLQCENLKDTVENLTAKLASTIADNQEQDLEKTRQYSQKLGLLTEQLQSLTLFLQTKLKEKLFFLLCP

SEQ ID NO: 83074 - protein, 185 aa, Homo sapiens
  Payload ID: 16532
  Gene Symbol: SPAG5
  Gene Name: sperm associated antigen 5
  ENSP ID: ENSP00000466061
  MOD_RES (1)..(1): Any amino acid
XESKEEAIRTLQRKICELQARLQAQEEQHQEVQKAKEADIEKLNQALCLRYKNEKELQEVIQQQNEKILEQIDKSGELISLREEVTHLTRSLRRAETETKVLQEALAGQLDSNCQPMATNWIQEKVWLSQEVDKLRVMFLEMKNEKEKLMIKFQSHRNILEENLRRSDKELEKLDDIVQHIYKRW

SEQ ID NO: 83075 - protein, 458 aa, Homo sapiens
  Payload ID: 16533
  Gene Symbol: SPAG6
  Gene Name: sperm associated antigen 6
  Uniprot ID: O75602
  ENSP ID: ENSP00000323599
MSQRQVLQVFEQYQKARTQFVQMVAELATRPQNIETLQNAGVMSLLRTLLLDVVPTIQQTAALALGRLANYNDDLAEAVVKCDILPQLVYSLAEQNRFYKKAAAFVLRAVGKHSPQLAQAIVDCGALDTLVICLEDFDPGVKEAAAWALRYIARHNAELSQAVVDAGAVPLLVLCIQEPEIALKRIAASALSDIAKHSPELAQTVVDAGAVAHLAQMILNPDAKLKHQILSALSQVSKHSVDLAEMVVEAEIFPVVLTCLKDKDEYVKKNASTLIREIAKHTPELSQLVVNAGGVAAVIDCIGSCKGNTRLPGIMMLGYVAAHSENLAMAVIISKGVPQLSVCLSEEPEDHIKAAAAWALGQIGRHTPEHARAVAVTNTLPVLLSLYMSTESSEDLQVKSKKAIKNILQKCTYLPALEPFLYDAPPNILKHVVGQFSKVLFPWIFRYTSAEGGQLSTT

SEQ ID NO: 83076 - protein, 484 aa, Homo sapiens
  Payload ID: 16533
  Gene Symbol: SPAG6
  Gene Name: sperm associated antigen 6
  ENSP ID: ENSP00000365788
MVAELATRPQNIETLQNAGVMSLLRTLLLDVVPTIQQTAALALGRLANYNDDLAEAVVKCDILPQLVYSLAEQNRFYKKAAAFVLRAVGKHSPQLAQAIVDCGALDTLVICLEDFDPGVKEAAAWALRYIARHNAELSQAVVDAGAVPLLVLCIQEPEIALKRIAASALSDIAKHSPELAQTVVDAGAVAHLAQMILNPDAKLKHQILSALSQVSKHSVDLAEMVVEAEIFPVVLTCLKDKDEYVKKNASTLIREIAKHTPELSQLVVNAGGVAAVIDCIGSCKGNTRLPGIMMLGYVAAHSENLAMAVIISKGVPQLSVCLSEEPEDHIKAAAAWALGQIGRHTPEHARAVAVTNTLPVLLSLYMSTESSEDLQVKSKKAIKNILQKCTYLPALEPFLYDAPPNILKHVVGQFSKVLPHDSKARRLFVTSGGLKKVQEIKAEPGSLLQEYINSINSCYPEEIVSKFFPELQVCALFRKFMRTP

SEQ ID NO: 83077 - protein, 509 aa, Homo sapiens
  Payload ID: 16533
  Gene Symbol: SPAG6
  Gene Name: sperm associated antigen 6
  Uniprot ID: O75602
  ENSP ID: ENSP00000365811
MSQRQVLQVFEQYQKARTQFVQMVAELATRPQNIETLQNAGVMSLLRTLLLDVVPTIQQTAALALGRLANYNDDLAEAVVKCDILPQLVYSLAEQNRFYKKAAAFVLRAVGKHSPQLAQAIVDCGALDTLVICLEDFDPGVKEAAAWALRYIARHNAELSQAVVDAGAVPLLVLCIQEPEIALKRIAASALSDIAKHSPELAQTVVDAGAVAHLAQMILNPDAKLKHQILSALSQVSKHSVDLAEMVVEAEIFPVVLTCLKDKDEYVKKNASTLIREIAKHTPELSQLVVNAGGVAAVIDCIGSCKGNTRLPGIMMLGYVAAHSENLAMAVIISKGVPQLSVCLSEEPEDHIKAAAAWALGQIGRHTPEHARAVAVTNTLPVLLSLYMSTESSEDLQVKSKKAIKNILQKCTYLPALEPFLYDAPPNILKHVVGQFSKVLPHDSKARRLFVTSGGLKKVQEIKAEPGSLLQEYINSINSCYPEEIVRYYSPGYSDTLLQRVDSYQPLNN

SEQ ID NO: 83078 - protein, 246 aa, Homo sapiens
  Payload ID: 16533
  Gene Symbol: SPAG6
  Gene Name: sperm associated antigen 6
  ENSP ID: ENSP00000406594
MSQRQVLQVFEQYQKARTQFVQMVAELATRPQNIETLQNAGEPGARTPVAPRALSPRRLRPAALPVELLGSRSVGTGVRKSIHSFQRVFGGQAERVKLPDGCGRCALSLFPSSLHTGVMSLLRTLLLDVVPTIQQTAALALGRLANYNDDLAEAVVKCDILPQLVYSLAEQNRFYKKAAAFVLRAVGKHSPQLAQAIVDCGALDTLVICLEDFDPGVKEAAAWALRYIARHNAELSQAVVDAGAVP

SEQ ID NO: 83079 - protein, 191 aa, Homo sapiens
  Payload ID: 16533
  Gene Symbol: SPAG6
  Gene Name: sperm associated antigen 6
  ENSP ID: ENSP00000411111
MSQRQVLQVFEQYQKARTQFVQMVAELATRPQNIETLQNAGVMSLLRTLLLDVVPTIQQTAALALGRLANYNDDLAEAVVKCDILPQLVYSLAEQNGVPQLSVCLSEEPEDHIKAAAAWALGQIGRHTPEHARAVAVTNTLPVLLSLYMSTESSEDLQVKSKKAIKNILQKCTYLPALEPFLYDAPPNILK

SEQ ID NO: 83080 - protein, 484 aa, Homo sapiens
  Payload ID: 16533
  Gene Symbol: SPAG6
  Gene Name: sperm associated antigen 6
  Uniprot ID: O75602
  ENSP ID: ENSP00000441325
MHSLTMDLWIPNGQAGVMSLLRTLLLDVVPTIQQTAALALGRLANYNDDLAEAVVKCDILPQLVYSLAEQNRFYKKAAAFVLRAVGKHSPQLAQAIVDCGALDTLVICLEDFDPGVKEAAAWALRYIARHNAELSQAVVDAGAVPLLVLCIQEPEIALKRIAASALSDIAKHSPELAQTVVDAGAVAHLAQMILNPDAKLKHQILSALSQVSKHSVDLAEMVVEAEIFPVVLTCLKDKDEYVKKNASTLIREIAKHTPELSQLVVNAGGVAAVIDCIGSCKGNTRLPGIMMLGYVAAHSENLAMAVIISKGVPQLSVCLSEEPEDHIKAAAAWALGQIGRHTPEHARAVAVTNTLPVLLSLYMSTESSEDLQVKSKKAIKNILQKCTYLPALEPFLYDAPPNILKHVVGQFSKVLPHDSKARRLFVTSGGLKKVQEIKAEPGSLLQEYINSINSCYPEEIVRYYSPGYSDTLLQRVDSYQPLNN

SEQ ID NO: 83081 - protein, 227 aa, Homo sapiens
  Payload ID: 16534
  Gene Symbol: SPAG7
  Gene Name: sperm associated antigen 7
  Uniprot ID: O75391
  ENSP ID: ENSP00000206020
MADLLGSILSSMEKPPSLGDQETRRKAREQAARLKKLQEQEKQQKVEFRKRMEKEVSDFIQDSGQIKKKFQPMNKIERSILHDVVEVAGLTSFSFGEDDDCRYVMIFKKEFAPSDEELDSYRRGEEWDPQKAEEKRKLKELAQRQEEEAAQQGPVVVSPASDYKDKYSHLIGKGAAKDAAHMLQANKTYGCVPVANKRDTRSIEEAMNEIRAKKRLRQSGEELPPTS

SEQ ID NO: 83082 - protein, 87 aa, Homo sapiens
  Payload ID: 16534
  Gene Symbol: SPAG7
  Gene Name: sperm associated antigen 7
  ENSP ID: ENSP00000458264
MEKPPSLGDQETRRKAREQAARLKKLQEQEKQQKVEFRKRMEKEVSDFIQDSGQIKKKFQPMNKIERSILLIPPPRPRNEMKHLYGL

SEQ ID NO: 83083 - protein, 176 aa, Homo sapiens
  Payload ID: 16534
  Gene Symbol: SPAG7
  Gene Name: sperm associated antigen 7
  ENSP ID: ENSP00000458405
MEKEVSDFIQDSGQIKKKFQPMNKIERSILHDVVEVAGLTSFSFGEDDDCRYVMIFKKEFAPSDEELDSYRRGEEWDPQKAEEKRKLKELAQRQEEEAAQQGPVVVSPASDYKDKYSHLIGKGAAKDAAHMLQANKTYGCVPVANKRDTRSIEEAMNEIRAKKRLRQSGEELPPTS

SEQ ID NO: 83084 - protein, 194 aa, Homo sapiens
  Payload ID: 16534
  Gene Symbol: SPAG7
  Gene Name: sperm associated antigen 7
  ENSP ID: ENSP00000461145
MEKPPSLGDQETRRKAREQAARLKKLQEQEKQQKVEFRKRMEKEVSDFIQDSGQIKKKFQPMNKIERSILHDVVEVAGLTSFSFGEDDDCRYVMIFKKEFAPSDEELDSYRRGEEWDPQKAEEKRKLKELAQRQEEEAAQQGPVVVSPASDYKDKYSHLIGKGAAKDAAHMLQANKTYGCGEATVRLGVAGRGA

SEQ ID NO: 83085 - protein, 501 aa, Homo sapiens
  Payload ID: 16535
  Gene Symbol: SPAG8
  Gene Name: sperm associated antigen 8
  Uniprot ID: Q99932
  ENSP ID: ENSP00000340982
METNESTEGSRSRSRSLDIQPSSEGLGPTSEPFPSSDDSPRSALAAATAAAAAAASAAAATAAFTTAKAAALSTKTPAPCSEFMEPSSDPSLLGEPCAGPGFTHNIAHGSLGFEPVYVSCIAQDTCTTTDHSSNPGPVPGSSSGPVLGSSSGAGHGSGSGSGPGCGSVPGSGSGPGPGSGPGSGPGHGSGSHPGPASGPGPDTGPDSELSPCIPPGFRNLVADRVPNYTSWSQHCPWEPQKQPPWEFLQVLEPGARGLWKPPDIKGKLMVCYETLPRGQCLLYNWEEERATNHLDQVPSMQDGSESFFFRHGHRGLLTMQLKSPMPSSTTQKDSYQPPGNVYWPLRGKREAMLEMLLQHQICKEVQAEQEPTRKLFEVESVTHHDYRMELAQAGTPAPTKPHDYRQEQPETFWIQRAPQLPTWWPLPTQVPAAEDYLTWKEWGFTGVQEVLSALLRATPGEYSVNICGMNEHPVCSRTWTNRLCHQEMGSKKTVTQEDRGW

SEQ ID NO: 83086 - protein, 485 aa, Homo sapiens
  Payload ID: 16535
  Gene Symbol: SPAG8
  Gene Name: sperm associated antigen 8
  Uniprot ID: Q99932
  ENSP ID: ENSP00000379878
METNESTEGSRSRSRSLDIQPSSEGLGPTSEPFPSSDDSPRSALAAATAAAAAAASAAAATAAFTTAKAAALSTKTPAPCSEFMEPSSDPSLLGEPCAGPGFTHNIAHGSLGFEPVYVSCIAQDTCTTTDHSSNPGPVPGSSSGPVLGSSSGAGHGSGSGSGPGCGSVPGSGSGPGPGSGPGSGPGHGSGSHPGPASGPGPDTGPDSELSPCIPPGFRNLVADRVPNYTSWSQHCPWEPQKQPPWEFLQVLEPGARGLWKPPDIKGKLMVCYETLPRGQCLLYNWEEERATNHLDQVPSMQDGSESFFFRHGHRGLLTMQLKSPMPSSTTQKDSYQPPGNVYWPLRGKREAMLEMLLQHQICKEVQAEQEPTRKLFEVESVTHHDYRMELAQAGTPAPTKPHDYRQEQPETFWIQRAPQLPGVSNIRTLDTPFRKNCSFSTPVPLSLGKLLPYEPENYPYQLGEISSLPCPGGRLGGGGGRMTPF

SEQ ID NO: 83087 - protein, 483 aa, Homo sapiens
  Payload ID: 16535
  Gene Symbol: SPAG8
  Gene Name: sperm associated antigen 8
  ENSP ID: ENSP00000417462
  MOD_RES (1)..(1): Any amino acid
XETNESTEGSRSRSLDIQPSSEGLGPTSEPFPSSDDSPRSALAAATAAAAAAASAAAATAAFTTAKAAALSTKTPAPCSEFMEPSSDPSLLGEPCAGPGFTHNIAHGSLGFEPVYVSCIAQDTCTTTDHSSNPGPVPGSSSGPVLGSSSGAGHGSGSGSGPGCGSVPGSGSGPGPGSGPGSGPGHGSGSHPGPASGPGPDTGPDSELSPCIPPGFRNLVADRVPNYTSWSQHCPWEPQKQPPWEFLQVLEPGARGLWKPPDIKGKLMVCYETLPRGQCLLYNWEEERATNHLDQVPSMQDGSESFFFRHGHRGLLTMQLKSPMPSSTTQKDSYQPPGNVYWPLRGKREAMLEMLLQHQICKEVQAEQEPTRKLFEVESVTHHDYRMELAQAGTPAPTKPHDYRQEQPETFWIQRAPQLPGVSNIRTLDTPFRKNCSFSTPVPLSLGKLLPYEPENYPYQLGEISSLPCPGGRLGGGGGRMTPF

SEQ ID NO: 83088 - protein, 477 aa, Homo sapiens
  Payload ID: 16535
  Gene Symbol: SPAG8
  Gene Name: sperm associated antigen 8
  ENSP ID: ENSP00000418072
METNESTEGSRSRSLDIQPSSEGLGPTSEPFPSSDDSPRSALAAATAAAAAAASAAAATAAFTTAKAAALSTKTPAPCSEFMEPSSDPSLLGEPCAGPGFTHNIAHGSLGFEPVYVSCIAQDTCTTTDHSSNPGPVPGSSSGPVLGSSSGAGHGSGSGSGPGCGSVPGSGSGPGPGSGPGSGPGHGSGSHPGPASGPGPDTGPDSELSPCIPPGFRNLVADRVPNYTSWSQHCPWEPQKQPPWEFLQVLEPGARGLWKPPDIKGKLMVCYETLPRGQCLLYNWEEERATNHLDQVPSMQDGSESFFFRHGHRGLLTMQLKSPMPSSTTQKDSYQPPGNVYWPLRGKREAMLEMLLQHQICKEVQAEQEPTRKLFEVESVTHHDYRMELAQAGTPAPTKEQPETFWIQRAPQLPGVSNIRTLDTPFRKNCSFSTPVPLSLGKLLPYEPENYPYQLGEISSLPCPGGRLGGGGGRMTPF

SEQ ID NO: 83089 - protein, 96 aa, Homo sapiens
  Payload ID: 16535
  Gene Symbol: SPAG8
  Gene Name: sperm associated antigen 8
  ENSP ID: ENSP00000418215
METNESTEGSRSRSRSLDIQPSSEGLGPTSEPFPSSDDSPRSALAAATAAAAAAASAAAATAAFTTAKAAALSTKTPAPCSEFMEPSSDPSLLGEP

SEQ ID NO: 83090 - protein, 426 aa, Homo sapiens
  Payload ID: 16535
  Gene Symbol: SPAG8
  Gene Name: sperm associated antigen 8
  Uniprot ID: Q99932
  ENSP ID: ENSP00000418530
METNESTEGSRSRSRSLDIQPSSEGLGPTSEPFPSSDDSPRSALAAATAAAAAAASAAAATAAFTTAKAAALSTKTPAPCSEFMEPSSDPSLLGEPCAGPGFTHNIAHGSLGFEPVYVSCIAQDTCTTTDHSSNPGPVPGSSSGPVLGSSSGAGHGSGSGSGPGCGSVPGSGSGPGPGSGPGSGPGHGSGSHPGPASGPGPDTGPDSELSPCIPPGFRNLVADRVPNYTSWSQHCPWEPQKQPPWEFLQVLEPGARGLWKPPDIKGKLMVCYETLPRGQCLLYNWEEERATNHLDQVPSMQDGSESFFFRHGHRGLLTMQLKSPMPSSTTQKDSYQPPGNVYWPLRGKREAMLEMLLQHQICKEVQAEQEPTRKLFEVESVTHHDYRMELAQAGTPAPTKPHDYRQEQPETFWIQRAPQLPVCEGD

SEQ ID NO: 83091 - protein, 69 aa, Homo sapiens
  Payload ID: 16535
  Gene Symbol: SPAG8
  Gene Name: sperm associated antigen 8
  ENSP ID: ENSP00000419280
METNESTEGSRSRSRSLDIQPSSEGLGPTSEPFPSSDDSPREPPTTWIKSQACRMALRVFSSDTDTGDC

SEQ ID NO: 83092 - protein, 69 aa, Homo sapiens; identical to SEQ ID NO: 83091
  Payload ID: 16535
  Gene Symbol: SPAG8
  Gene Name: sperm associated antigen 8
  ENSP ID: ENSP00000420413

SEQ ID NO: 83093 - protein, 1321 aa, Homo sapiens
  Payload ID: 16536
  Gene Symbol: SPAG9
  Gene Name: sperm associated antigen 9
  Uniprot ID: O60271
  ENSP ID: ENSP00000262013
MELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQISRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKVSNSPEPQKAVEQEDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETNKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 83094 - protein, 1307 aa, Homo sapiens
  Payload ID: 16536
  Gene Symbol: SPAG9
  Gene Name: sperm associated antigen 9
  Uniprot ID: O60271
  ENSP ID: ENSP00000349636
MELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQISRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETNKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 83095 - protein, 1177 aa, Homo sapiens
  Payload ID: 16536
  Gene Symbol: SPAG9
  Gene Name: sperm associated antigen 9
  Uniprot ID: O60271
  ENSP ID: ENSP00000423165
MSPGCMLLFVFGFVGGAVVINSAILVSLSVLLLVHFSISTGVPALTQNLPRILRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETVILHQGRLLGLRANKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 83096 - protein, 152 aa, Homo sapiens
  Payload ID: 16536
  Gene Symbol: SPAG9
  Gene Name: sperm associated antigen 9
  ENSP ID: ENSP00000423346
TSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNG

SEQ ID NO: 83097 - protein, 156 aa, Homo sapiens
  Payload ID: 16536
  Gene Symbol: SPAG9
  Gene Name: sperm associated antigen 9
  ENSP ID: ENSP00000426061
MSPGCMLLFVFGFVGGAVVINSAILVSLSVLLLVHFSISTGVPALTQNLPRILRKERPISLGIFPLPAGDGLLTPDAQKGGETPGSEQWKFQELSQPRSHTSLKVSNSPEPQKAVEQEDELSDVSQGGSKATTPASTANSDVATIPTDTPLKEENE

SEQ ID NO: 83098 - protein, 1311 aa, Homo sapiens
  Payload ID: 16536
  Gene Symbol: SPAG9
  Gene Name: sperm associated antigen 9
  Uniprot ID: O60271
  ENSP ID: ENSP00000426900
MELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQISRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFVPTRFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETNKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 83099 - protein, 174 aa, Homo sapiens
  Payload ID: 16536
  Gene Symbol: SPAG9
  Gene Name: sperm associated antigen 9
  ENSP ID: ENSP00000429343
GSAENEEKSEVQAIIESTPELDMDKDLSGYKGSSTPTKGIENKAFDRNTESLFEELSSAGSGLIGDVDEGADLLGEYSDHNFFGMGREVENLILENTQLLETKNALNIVKNDLIAKVDELTCEKDVLQGELEAVKQAKLKLEEKNRELEEELRKARAEAEDARQKAKDDDDSDI

SEQ ID NO: 83100 - protein, 250 aa, Homo sapiens
  Payload ID: 16536
  Gene Symbol: SPAG9
  Gene Name: sperm associated antigen 9
  ENSP ID: ENSP00000430205
  MOD_RES (1)..(1): Any amino acid
XEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSI

SEQ ID NO: 83101 - protein, 1312 aa, Homo sapiens [sequence omitted]

SEQ ID NO: 83102 - protein, 151 aa, Homo sapiens
  Payload ID: 16537
  Gene Symbol: SPA17
  Gene Name: sperm autoantigenic protein 17
  Uniprot ID: Q15506
  ENSP ID: ENSP00000227135
MSIPFSNTHYRIPQGFGNLLEGLTREILREQPDNIPAFAAAYFESLLEKREKTNFDPAEWGSKVEDRFYNNHAFEEQEPPEKSDPKQEESQISGKEEETSVTILDSSEEDKEKEEVAAVKIQAAFRGHIAREEAKKMKTNSLQNEEKEENK

SEQ ID NO: 83103 - protein, 151 aa, Homo sapiens; identical to SEQ ID NO: 83102
  Payload ID: 16537
  Gene Symbol: SPA17
  Gene Name: sperm autoantigenic protein 17
  Uniprot ID: Q15506
  ENSP ID: ENSP00000432305

SEQ ID NO: 83104 - protein, 350 aa, Homo sapiens
  Payload ID: 16538
  Gene Symbol: SPESP1
  Gene Name: sperm equatorial segment protein 1
  Uniprot ID: Q6UW49
  ENSP ID: ENSP00000312284
MKPLVLLVALLLWPSSVPAYPSITVTPDEEQNLNHYIQVLENLVRSVPSGEPGREKKSNSPKHVYSIASKGSKFKELVTHGDASTENDVLTNPISEETTTFPTGGFTPEIGKKKHTESTPFWSIKPNNVSIVLHAEEPYIENEEPEPEPEPAAKQTEAPRMLPVVTESSTSPYVTSYKSPVTTLDKSTGIGISTESEDVPQLSGETAIEKPEEFGKHPESWNNDDILKKILDINSQVQQALLSDTSNPAYREDIEASKDHLKRSLALAAAAEHKLKTMYKSQLLPVGRTSNKIDDIETVINMLCNSRSKLYEYLDIKCVPPEMREKAATVFNTLKNMCRSRRVTALLKVY

SEQ ID NO: 83105 - protein, 236 aa, Homo sapiens
  Payload ID: 16539
  Gene Symbol: SPEF1
  Gene Name: sperm flagellar 1
  Uniprot ID: Q9Y4P9
  ENSP ID: ENSP00000369080
MASSVDEEALHQLYLWVDNIPLSRPKRNLSRDFSDGVLVAEVIKFYFPKMVEMHNYVPANSLQQKLSNWGHLNRKVLKRLNFSVPDDVMRKIAQCAPGVVELVLIPLRQRLEERQRRRKQGAGSLQELAPQDGSGYMDVGVSQKARGEGVPDPQGGGQLSWDRPPAPRPPAYNRALQGDPSFVLQIAEKEQELLASQETVQVLQMKVRRLEHLLQLKNVRIEDLSRRLQQAERKQR

SEQ ID NO: 83106 - protein, 514 aa, Homo sapiens
  Payload ID: 16540
  Gene Symbol: SPEF2
  Gene Name: sperm flagellar 2
  Uniprot ID: Q9C093
  ENSP ID: ENSP00000282469
MSEILCQWLNKELKVSRTVSPKSFAKAFSSGYLLGEVLHKFELQDDFSEFLDSRVSSAKLNNFSRLEPTLNLLGVQFDQNVAHGIITEKPGVATKLLYQLYIALQKKKKSGLTGVEMQTMQRLTNLRLQNMKSDTFQERLRHMIPRQTDFNLMRITYRFQEKYKHVKEDLAHLHFEKLERFQKLKEEQRCFDIEKQYLNRRRQNEIMAKIQAAIIQIPKPASNRTLKALEAQKMMKKKKEAEDVADEIKKFEALIKKDLQAKESASKTSLDTAGQTTTDLLNTYSDDEYIKKIQKRLEEDAFAREQREKRRRKLLMDQLIAHEAQEEAYREEQLINRLMRQSQQERRIAVQLMHVRHEKEVLWQNRIFREKQHEERRLKDFQDALDREAALAKQAKIDFEEQFLKEKRFHDQIAVERAQARYEKHYSVCAEILDQIVDLSTKVADYRMLTNNLIPYKLMHDWKELFFNAKPIYEQASVKTLPANPSREQLTELEKRDLLDTNDYEEYKVPTDMK

SEQ ID NO: 83107 - protein, 1822 aa, Homo sapiens
  Payload ID: 16540
  Gene Symbol: SPEF2
  Gene Name: sperm flagellar 2
  Uniprot ID: Q9C093
  ENSP ID: ENSP00000348314
MSEILCQWLNKELKVSRTVSPKSFAKAFSSGYLLGEVLHKFELQDDFSEFLDSRVSSAKLNNFSRLEPTLNLLGVQFDQNVAHGIITEKPGVATKLLYQLYIALQKKKKSGLTGVEMQTMQRLTNLRLQNMKSDTFQERLRHMIPRQTDFNLMRITYRFQEKYKHVKEDLAHLHFEKLERFQKLKEEQRCFDIEKQYLNRRRQNEIMAKIQAAIIQIPKPASNRTLKALEAQKMMKKKKEAEDVADEIKKFEALIKKDLQAKESASKTSLDTAGQTTTDLLNTYSDDEYIKKIQKRLEEDAFAREQREKRRRKLLMDQLIAHEAQEEAYREEQLINRLMRQSQQERRIAVQLMHVRHEKEVLWQNRIFREKQHEERRLKDFQDALDREAALAKQAKIDFEEQFLKEKRFHDQIAVERAQARYEKHYSVCAEILDQIVDLSTKVADYRMLTNNLIPYKLMHDWKELFFNAKPIYEQASVKTLPANPSREQLTELEKRDLLDTNDYEEYKNMVGEWALPEEMVDNLPPSNNCILGHILHRLAEKSLPPRAESTTPELPSFAVKGCLLGKTLSGKTTILRSLQKDFPIQILSIDTLVQEAIQAFHDNEKVSEVLPIQKNDEEDALPVLQEEIKESQDPQHVFSAGPVSDEVLPETEGETMLSANADKTPKAEEVKSSDSFLKLTTRAQLGAKSEQLLKKGKSIPDVLLVDIIVNAINEIPVNQDCILDGFPMTLNQAQLLEEALTGCNRNLTEVERKKAQKSTLAIDPATSKEIPLPSPAFDFVILLDVSDTSSMSRMNDIIAEELSYKTAHEDISQRVAAENQDKDGDQNLRDQIQHRIIGFLDNWPLLEQWFSEPENILIKINAEIDKESLCEKVKEILTTEIAKKKNKVEKKLEEKEAEKKAAASLAELPLPTPPPAPPPEPEKEKEIHQSHVASKTPTAKGKPQSEAPHGKQESLQEGKGKKGETALKRKGSPKGKSSGGKVPVKKSPADSTDTSPVAIVPQPPKPGSEEWVYVNEPVPEEMPLFLVPYWELIENSYINTIKTVLRHLREDQHTVLAYLYEIRTSFQEFLKRPDHKQDFVAQWQADFNSLPDDLWDDEETKAELHQRVNDLRDRLWDICDARKEEAEQERLDIINESWLQDTLGMTMNHFFSLMQAELNRFQDTKRLLQDYYWGMESKIPVEDNKRFTRIPLVQLDSKDNSESQLRIPLVPRISISLETVTPKPKTKSVLKGKMDNSLENVESNFEADEKLVMDTWQQASLAVSHMVAAEIHQRLMEEEKENQPADPKEKSPQMGANKKVKKEPPKKKQEDKKPKGKSPPMAEATPVIVTTEEIAEIKRKNELRVKIKEEHLAALQFEEIATQFRLELIKTKALALLEDLVTKVVDVYKLMEKWLGERYLNEMASTEKLTDVARYHIETSTKIQNELYLSQEDFFINGNIKVFPDPPPSIRPPPVEKEEDGTLTIEQLDSLRDQFLDMAPKGIIGNKAFTDILIDLVTLNLGTNNFPSNWMHLTQPELQELTSLLTVNSEFVDWRKFLLVTSMPWPIPLEEELLETLQKFKAVDKEQLGTITFEQYMQAGLWFTGDEDIKIPENPLEPLPFNRQEHLIEFFFRLFADYEKDPPQLDYTQMLLYFACHPDTVEGVYRALSVAVGTHVFQQVKASIPSAEKTSSTDAGPAEEFPEPEENAAREERKLKDDTEKREQKDEEIPENANNEKMSMETLLKVFKGGSEAQDSNRFASHLKIENIYAEGFIKTFQDLGAKNLEPIEVAVLLKHPFIQDLISNYSDYKFPDIKIILQRSEHVQGSDGERSPSRHTEEKK

SEQ ID NO: 83108 - protein, 1818 aa, Homo sapiens
  Payload ID: 16540
  Gene Symbol: SPEF2
  Gene Name: sperm flagellar 2
  Uniprot ID: Q9C093
  ENSP ID: ENSP00000412125
MSEILCQWLNKELKVSRTVSPKSFAKAFSSGYLLGEVLHKFELQDDFSEFLDSRVSSAKLNNFSRLEPTLNLLGVQFDQNVAHGIITEKPGVATKLLYQLYIALQKKKKSGLTGVEMQTMQRLTNLRLQNMKSDTFQERLRHMIPRQTDFNLMRITYRFQEKYKHVKEDLAHLHFEKLERFQKLKEEQRCFDIEKQYLNRRRQNEIMAKIQAAIIQIPKPASNRTLKALEAQKMMKKKKEAEDVADEIKKFEALIKKDLQAKESASKTSLDTAGQTTTDLLNTYSDDEYIKKIQKRLEEDAFAREQREKRRRKLLMDQLIAHEAQEEAYREEQLINRLMRQSQQERRIAVQLMHVRHEKEVLWQNRIFREKQHEERRLKDFQDALDREAALAKQAKIDFEEQFLKEKRFHDQIAVERAQARYEKHYSVCAEILDQIVDLSTKVADYRMLTNNLIPYKLMHDWKELFFNAKPIYEQASVKTLPANPSREQLTELEKRDLLDTNDYEEYKNMVGEWALPEEMVDNLPPSNNCILGHILHRLAEKSLPPRAESTTPELPSFAVKGCLLGKTLSGKTTILRSLQKDFPIQILSIDTLVQEAIQAFHDNEKVSEVLPIQKNDEEDALPVLQEEIKESQDPQHVFSAGPVSDEVLPETEGANADKTPKAEEVKSSDSFLKLTTRAQLGAKSEQLLKKGKSIPDVLLVDIIVNAINEIPVNQDCILDGFPMTLNQAQLLEEALTGCNRNLTEVERKKAQKSTLAIDPATSKEIPLPSPAFDFVILLDVSDTSSMSRMNDIIAEELSYKTAHEDISQRVAAENQDKDGDQNLRDQIQHRIIGFLDNWPLLEQWFSEPENILIKINAEIDKESLCEKVKEILTTEIAKKKNKVEKKLEEKEAEKKAAASLAELPLPTPPPAPPPEPEKEKEIHQSHVASKTPTAKGKPQSEAPHGKQESLQEGKGKKGETALKRKGSPKGKSSGGKVPVKKSPADSTDTSPVAIVPQPPKPGSEEWVYVNEPVPEEMPLFLVPYWELIENSYINTIKTVLRHLREDQHTVLAYLYEIRTSFQEFLKRPDHKQDFVAQWQADFNSLPDDLWDDEETKAELHQRVNDLRDRLWDICDARKEEAEQERLDIINESWLQDTLGMTMNHFFSLMQAELNRFQDTKRLLQDYYWGMESKIPVEDNKRFTRIPLVQLDSKDNSESQLRIPLVPRISISLETVTPKPKTKSVLKGKMDNSLENVESNFEADEKLVMDTWQQASLAVSHMVAAEIHQRLMEEEKENQPADPKEKSPQMGANKKVKKEPPKKKQEDKKPKGKSPPMAEATPVIVTTEEIAEIKRKNELRVKIKEEHLAALQFEEIATQFRLELIKTKALALLEDLVTKVVDVYKLMEKWLGERYLNEMASTEKLTDVARYHIETSTKIQNELYLSQEDFFINGNIKVFPDPPPSIRPPPVEKEEDGTLTIEQLDSLRDQFLDMAPKGIIGNKAFTDILIDLVTLNLGTNNFPSNWMHLTQPELQELTSLLTVNSEFVDWRKFLLVTSMPWPIPLEEELLETLQKFKAVDKEQLGTITFEQYMQAGLWFTGDEDIKIPENPLEPLPFNRQEHLIEFFFRLFADYEKDPPQLDYTQMLLYFACHPDTVEGVYRALSVAVGTHVFQQVKASIPSAEKTSSTDAGPAEEFPEPEENAAREERKLKDDTEKREQKDEEIPENANNEKMSMETLLKVFKGGSEAQDSNRFASHLKIENIYAEGFIKTFQDLGAKNLEPIEVAVLLKHPFIQDLISNYSDYKFPVHIIYVVEMIVCAKGWAPLPSGKQCARWRN

SEQ ID NO: 83109 - protein, 115 aa, Homo sapiens
  Payload ID: 16540
  Gene Symbol: SPEF2
  Gene Name: sperm flagellar 2
  ENSP ID: ENSP00000421062
QKSTLAIDPATSKEIPLPSPAFDFVILLDVSDTSSMSRMNDIIDQQDPGLSGSLATRVGCNMQFCSARGLWRNLKNIFTEKHTTSKATWATKSCQGWAELKNCPIKLLTKISVNV

SEQ ID NO: 83110 - protein, 943 aa, Homo sapiens
  Payload ID: 16540
  Gene Symbol: SPEF2
  Gene Name: sperm flagellar 2
  ENSP ID: ENSP00000421593
MSEILCQWLNKELKVSRTVSPKSFAKAFSSGYLLGEVLHKFELQDDFSEFLDSRVSSAKLNNFSRLEPTLNLLGVQFDQNVAHGIITEKPGVATKLLYQLYIALQKKKKSGLTGVEMQTMQRLTNLRLQNMKSDTFQERLRHMIPRQTDFNLMRITYRFQEKYKHVKEDLAHLHFEKLERFQKLKEEQRCFDIEKQYLNRRRQNEIMAKIQAAIIQIPKPASNRTLKALEAQKMMKKKKEAEDVADEIKKFEALIKKDLQAKESASKTSLDTAGQTTTDLLNTYSDDEYIKKIQKRLEEDAFAREQREKRRRKLLMDQLIAHEAQEEAYREEQLINRLMRQSQQERRIAVQLMHVRHEKEVLWQNRIFREKQHEERRLKDFQDALDREAALAKQAKIDFEEQFLKEKRFHDQIAVERAQARYEKHYSVCAEILDQIVDLSTKVADYRMLTNNLIPYKLMHDWKELFFNAKPIYEQASVKTLPANPSREQLTELEKRDLLDTNDYEEYKNMVGEWALPEEMVDNLPPSNNCILGHILHRLAEKSLPPRAESTTPELPSFAVKGCLLGKTLSGKTTILRSLQKDFPIQILSIDTLVQEAIQAFHDNEKVSEVLPIQKNDEEDALPVLQEEIKESQDPQHVFSAGPVSDEVLPETEGANADKTPKAEEVKSSDSFLKLTTRAQLGAKSEQLLKKGKSIPDVLLVDIIVNAINEIPVNQDCILDGFPMTLNQAQLLEEALTGCNRNLTEVERKKAQKSTLAIDPATSKEIPLPSPAFDFVILLDVSDTSSMSRMNDIIAEELSYKTAHEDISQRVAAENQDKDGDQNLRDQIQHRIIGFLDNWPLLEQWFSEPENILIKINAEIDKESLCEKVKEILTTEIAKKKNKVEKKLEEKEAEKKAAASLAELPLPTPPPAPPPEPEKEKEIHQSHVASKTPTAKGKPQSGD

SEQ ID NO: 83111 - protein, 388 aa, Homo sapiens
  Payload ID: 16540
  Gene Symbol: SPEF2
  Gene Name: sperm flagellar 2
  ENSP ID: ENSP00000421744
MNLGHVKGIWLQIINTGDKNMVGEWALPEEMVDNLPPSNNCILGHILHRLAEKSLPPRAESTTPELPSFAVKGCLLGKTLSGKTTILRSLQKDFPIQILSIDTLVQEAIQAFHDNEKVSEVLPIQKNDEEDALPVLQEEIKESQDPQHVFSAGPVSDEVLPETEGANADKTPKAEEVKSSDSFLKLTTRAQLGAKSEQLLKKGKSIPDVLLVDIIVNAINEIPVNQDCILDGFPMTLNQAQLLEEALTGCNRNLTEVERKKAQKSTLAIDPATSKEIPLPSPAFDFVILLDVSDTSSMSRMNDIIAEELSYKTAHEDISQRVAAENQDKDGDQNLRDQIQHRIIGFLDNWPLLEQWFSEPENILIKINAEIDKESLCEKVKEILTTEI

SEQ ID NO: 83112 - protein, 120 aa, Homo sapiens
  Payload ID: 16540
  Gene Symbol: SPEF2
  Gene Name: sperm flagellar 2
  ENSP ID: ENSP00000422710
PKPKTKSVLKGKMDNSLENVESNFEADEKLVMDTWQQASLAVSHMVLGLPRCLLFSQHAKPSSSFHEISHSNRKQHQLSKRFCESGRRGPCSTDLTANKISNWALSKSLLGLSAFRLLFL

SEQ ID NO: 83113 - protein, 115 aa, Homo sapiens
  Payload ID: 16540
  Gene Symbol: SPEF2
  Gene Name: sperm flagellar 2
  ENSP ID: ENSP00000423400
  MOD_RES (1)..(1): Any amino acid
XIQNELYLSQEDFFINGNIKVFPDPPPSIRPPPVEKEEDGTLTIEQLDSLRDQFLDMAPKECSENCFQRPSPSTCDAFSNRRQEVASWITGSPPELSQGISCNCSATALSRQRQK

SEQ ID NO: 83114 - protein, 145 aa, Homo sapiens
  Payload ID: 16540
  Gene Symbol: SPEF2
  Gene Name: sperm flagellar 2
  ENSP ID: ENSP00000425448
MSEILCQWLNKELKVSRTVSPKSFAKAFSSGYLLGEVLHKFELQDDFSEFLDSRVSSAKLNNFSRLEPTLNLLGVQFDQNVAHGIITEKPGVATKLLYQLYIALQKKKKSGLTGVEMQTMQRLTNLRLQNMKSDTFQERLGPLIS

SEQ ID NO: 83115 - protein, 240 aa, Homo sapiens
  Payload ID: 16540
  Gene Symbol: SPEF2
  Gene Name: sperm flagellar 2
  ENSP ID: ENSP00000426259
MSEILCQWLNKELKVSRTVSPKSFAKAFSSGYLLGEVLHKFELQDDFSEFLDSRVSSAKLNNFSRLEPTLNLLGVQFDQNVAHGIITEKPGVATKLLYQLYIALQKKKKSGLTGVEMQTMQRLTNLRLQNMKSDTFQEQYLNRRRQNEIMAKIQAAIIQIPKPASNRTLKALEAQKMMKKKKEAEDVADEIKKFEALIKKDLQAKESASKTSLDTAGQTTTDLLNTYSDDEYIKKIQKRL

SEQ ID NO: 83116 - protein, 151 aa, Homo sapiens
  Payload ID: 16540
  Gene Symbol: SPEF2
  Gene Name: sperm flagellar 2
  ENSP ID: ENSP00000426624
  MOD_RES (1)..(1): Any amino acid
XEHLAALQFEEIATQFRLELIKTKALALLEDLVTKVVDVYKLMEKWLGERYLNEMASTEKLTDVARYHIETSTKIQNELYLSQEDFFINGNIKVFPDPPPSIRPPPVEKEEDGTLTIEQLDSLRDQFLDMAPKGLNFSMHIISARLMPRPH

SEQ ID NO: 83117 - protein, 116 aa, Homo sapiens
  Payload ID: 16541
  Gene Symbol: SMCP
  Gene Name: sperm mitochondria-associated cysteine-rich protein
  Uniprot ID: P49901
  ENSP ID: ENSP00000357754
MCDQTKHSKCCPAKGNQCCPPQQNQCCQSKGNQCCPPKQNQCCQPKGSQCCPPKHNHCCQPKPPCCIQARCCGLETKPEVSPLNMESEPNSPQTQDKGCQTQQQPHSPQNESRPSK

SEQ ID NO: 83118 - protein, 97 aa, Homo sapiens; identical to SEQ ID NO: 82706
  Payload ID: 16542
  Gene Symbol: SPANXA1
  Gene Name: sperm protein associated with the nucleus, X-linked, family member A1
  Uniprot ID: Q9NS26
  ENSP ID: ENSP00000359550

SEQ ID NO: 83119 - protein, 97 aa, Homo sapiens; identical to SEQ ID NO: 82706
  Payload ID: 16542
  Gene Symbol: SPANXA1
  Gene Name: sperm protein associated with the nucleus, X-linked, family member A1
  Uniprot ID: Q9NS26
  ENSP ID: ENSP00000484283

SEQ ID NO: 83120 - protein, 1256 aa, Homo sapiens
  Payload ID: 16543
  Gene Symbol: SSFA2
  Gene Name: sperm specific antigen 2
  Uniprot ID: P28290
  ENSP ID: ENSP00000314669
MDRPLSSSAEAEEELEWQVASRRRKAWAKCRSSWQASETEDLSTEATTQDEEEDEEEDLPGAQLPAAGGRGNVPNEKIAIWLKDCRTPLGASLDEQSSSTLKGVLVRNGGSFEDDLSLGAEANHLHESDAQIENCNNILAKERRLQFHQKGRSMNSTGSGKSSGTVSSVSELLELYEEDPEEILYNLGFGRDEPDIASKIPSRFFNSSSFAKGIDIKVFLSAQMQRMEVENPNYALTSRFRQIEVLTTVANAFSSLYSQVSGTPLQRIGSMSSVTSNKETDPPPPLTRSNTANRLMKTLSKLNLCVDKTEKGESSSPSPSAEKGKILNVSVIEESGNKNDQKSQKIMKKKESSSMLATVKEEVSGSSAAVTENADSDRISDEANSNFNQGTENEQSKETQSHESKLGEESGIVESKLDSDFNISSHSELENSSELKSVHISTPEKEPCAPLTIPSIRNIMTQQKDSFEMEEVQSTEGEAPHVPATYQLGLTKSKRDHLLRTASQHSDSSGFAEDSTDCLSLNHLQVQESLQAMGSSADSCDSETTVTSLGEDLATPTAQDQPYFNESEEESLVPLQKGLEKAAAVADKRKSGSQDFPQCNTIENTGTKQSTCSPGDHIIEITEVEEDLFPAETVELLREASAESDVGKSSESEFTQYTTHHILKSLASIEAKCSDMSSENTTGPPSSMDRVNTALQRAQMKVCSLSNQRMGRSLLKSKDLLKQRYLFAKAGYPLRRSQSLPTTLLSPVRVVSSVNVRLSPGKETRCSPPSFTYKYTPEEEQELEKRVMEHDGQSLVKSTIFISPSSVKKEEAPQSEAPRVEECHHGRTPTCSRLAPPPMSQSTCSLHSIHSEWQERPLCEHTRTLSTHSVPNISGATCSAFASPFGCPYSHRHATYPYRVCSVNPPSAIEMQLRRVLHDIRNSLQNLSQYPMMRGPDPAAAPYSTQKSSVLPLYENTFQELQVMRRSLNLFRTQMMDLELAMLRQQTMVYHHMTEEERFEVDQLQGLRNSVRMELQDLELQLEERLLGLEEQLRAVRMPSPFRSSALMGMCGSRSADNLSCPSPLNVMEPVTELMQEQSYLKSELGLGLGEMGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKNVEQDELQQVIREVGMDPISCVILELSMICTGGGVICALEDTCC

SEQ ID NO: 83121 - protein, 768 aa, Homo sapiens
  Payload ID: 16543
  Gene Symbol: SSFA2
  Gene Name: sperm specific antigen 2
  ENSP ID: ENSP00000386916
MTTEDHLLRTASQHSDSSGFAEDSTDCLSLNHLQVQESLQAMGSSADSCDSETTVTSLGEDLATPTAQDQPYFNESEEESLVPLQKGLEKAAAVADKRKSGSQDFPQCNTIENTGTKQSTCSPGDHIIEITEVEEDLFPAETVELLREASAESDVGKSSESEFTQYTTHHILKSLASIEAKCSDMSSENTTGPPSSMDRVNTALQRAQMKVCSLSNQRMGRSLLKSKDLLKQRYLFAKAGYPLRRSQSLPTTLLSPVRVVSSVNVRLSPGKETRCSPPSFTYKYTPEEEQELEKRVMEHDGQSLVKSTIFISPSSVKKEEAPQSEAPRVEECHHGRTPTCSRLAPPPMSQSTCSLHSIHSEWQERPLCEHTRTLSTHSVPNISGATCSAFASPFGCPYSHRHATYPYRVCSVNPPSAIEMQLRRVLHDIRNSLQNLSQYPMMRGPDPAAAPYSTQKSSVLPLYENTFQELQVMRRSLNLFRTQMMDLELAMLRQQTMVYHHMTEEERFEVDQLQGLRNSVRMELQDLELQLEERLLGLEEQLRAVRMPSPFRSSALMGMCGSRSADNLSCPSPLNVMEPVTELMQEQSYLKSELGLGLGEMGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKNVEQDELQQVIREIKESIVGEIRREIVSGLLAAVSSSKASNSKQDYH

SEQ ID NO: 83122 - protein, 1237 aa, Homo sapiens
  Payload ID: 16543
  Gene Symbol: SSFA2
  Gene Name: sperm specific antigen 2
  ENSP ID: ENSP00000387319
MDRPLSSSAEAEEELEWQVASRRRKAWAKCRSSWQASETEDLSTEATTQDEEEDEEEDLPGAQLPAAGGRGNVPNEKIAIWLKDCRTPLGASLDEQSSSTLKGVLVRNGGSFEDDLSLGAEANHLHESDAQIENCNNILAKERRLQFHQKGRSMNSTGSGKSSGTVSSVSELLELYEEDPEEILYNLGFGRDEPDIASKIPSRFFNSSSFAKGIDIKVFLSAQMQRMEVENPNYALTSRFRQIEVLTTVANAFSSLYSQVSGTPLQRIGSMSSVTSNKETDPPPPLTRSNTANRLMKTLSKLNLCVDKTEKGESSSPSPSAEKGKILNVSVIEESGNKNDQKSQKIMKKKESSSMLATVKEEVSGSSAAVTENADSDRISDEANSNFNQGTENEQSKETQSHESKLGEESGIVESKLDSDFNISSHSELENSSELKSVHISTPEKEPCAPLTIPSIRNIMTQQKDSFEMEEVQSTEGEAPHVPATYQLGLTKSKRDHLLRTASQHSDSSGFAEDSTDCLSLNHLQVQESLQAMGSSADSCDSETTVTSLGEDLATPTAQDQPYFNESEEESLVPLQKGLEKAAAVADKRKSGSQDFPQCNTIENTGTKQSTCSPGDHIIEITEVEEDLFPAETVELLREASAESDVGKSSESEFTQYTTHHILKSLASIEAKCSDMSSENTTGPPSSMDRVNTALQRAQMKVCSLSNQRMGRSLLKSKDLLKQRYLFAKAGYPLRRSQSLPTTLLSPVRVVSSVNVRLSPGKETRCSPPSFTYKYTPEEEQELEKRVMEHDGQSLVKSTIFISPSSVKKEEAPQSEAPRVEECHHGRTPTCSRLAPPPMSQSTCSLHSIHSEWQERPLCEHTRTLSTHSVPNISGATCSAFASPFGCPYSHRHATYPYRVCSVNPPSAIEMQLRRVLHDIRNSLQNLSQYPMMRGPDPAAAPYSTQKSSVLPLYENTFQELQVMRRSLNLFRTQMMDLELAMLRQQTMVYHHMTEEERFEVDQLQGLRNSVRMELQDLELQLEERLLGLEEQLRAVRMPSPFRSSALMVTELMQEQSYLKSELGLGLGEMGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKNVEQDELQQVIREIKESIVGEIRREIVSGLLAAVSSSKASNSKQDYH

SEQ ID NO: 83123 - protein, 201 aa, Homo sapiens
  Payload ID: 16543
  Gene Symbol: SSFA2
  Gene Name: sperm specific antigen 2
  ENSP ID: ENSP00000387420
GSRSADNLSCPSPLNVTELMQEQSYLKSELGLGLGEMGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKNVEQDELQQVIREVGMDPISCVILELSMICTGGGVICALEDTCC

SEQ ID NO: 83124 - protein, 1259 aa, Homo sapiens
  Payload ID: 16543
  Gene Symbol: SSFA2
  Gene Name: sperm specific antigen 2
  Uniprot ID: P28290
  ENSP ID: ENSP00000388731
MDRPLSSSAEAEEELEWQVASRRRKAWAKCRSSWQASETEDLSTEATTQDEEEDEEEDLPGAQLPAAGGRGNVPNEKIAIWLKDCRTPLGASLDEQSSSTLKGVLVRNGGSFEDDLSLGAEANHLHESDAQIENCNNILAKERRLQFHQKGRSMNSTGSGKSSGTVSSVSELLELYEEDPEEILYNLGFGRDEPDIASKIPSRFFNSSSFAKGIDIKVFLSAQMQRMEVENPNYALTSRFRQIEVLTTVANAFSSLYSQVSGTPLQRIGSMSSVTSNKETDPPPPLTRSNTANRLMKTLSKLNLCVDKTEKGESSSPSPSAEKGKILNVSVIEESGNKNDQKSQKIMKKKESSSMLATVKEEVSGSSAAVTENADSDRISDEANSNFNQGTENEQSKETQSHESKLGEESGIVESKLDSDFNISSHSELENSSELKSVHISTPEKEPCAPLTIPSIRNIMTQQKDSFEMEEVQSTEGEAPHVPATYQLGLTKSKRDHLLRTASQHSDSSGFAEDSTDCLSLNHLQVQESLQAMGSSADSCDSETTVTSLGEDLATPTAQDQPYFNESEEESLVPLQKGLEKAAAVADKRKSGSQDFPQCNTIENTGTKQSTCSPGDHIIEITEVEEDLFPAETVELLREASAESDVGKSSESEFTQYTTHHILKSLASIEAKCSDMSSENTTGPPSSMDRVNTALQRAQMKVCSLSNQRMGRSLLKSKDLLKQRYLFAKAGYPLRRSQSLPTTLLSPVRVVSSVNVRLSPGKETRCSPPSFTYKYTPEEEQELEKRVMEHDGQSLVKSTIFISPSSVKKEEAPQSEAPRVEECHHGRTPTCSRLAPPPMSQSTCSLHSIHSEWQERPLCEHTRTLSTHSVPNISGATCSAFASPFGCPYSHRHATYPYRVCSVNPPSAIEMQLRRVLHDIRNSLQNLSQYPMMRGPDPAAAPYSTQKSSVLPLYENTFQELQVMRRSLNLFRTQMMDLELAMLRQQTMVYHHMTEEERFEVDQLQGLRNSVRMELQDLELQLEERLLGLEEQLRAVRMPSPFRSSALMGMCGSRSADNLSCPSPLNVMEPVTELMQEQSYLKSELGLGLGEMGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKNVEQDELQQVIREIKESIVGEIRREIVSGLLAAVSSSKASNSKQDYH

SEQ ID NO: 83125 - protein, 46 aa, Homo sapiens
  Payload ID: 16543
  Gene Symbol: SSFA2
  Gene Name: sperm specific antigen 2
  ENSP ID: ENSP00000392049
MEEVLKMICHWELKPTTSMKVMLKLKTAIISWPKREDYSFIRKGEV

SEQ ID NO: 83126 - protein, 46 aa, Homo sapiens; identical to SEQ ID NO: 83125
  Payload ID: 16543
  Gene Symbol: SSFA2
  Gene Name: sperm specific antigen 2
  ENSP ID: ENSP00000403754

SEQ ID NO: 83127 - protein, 46 aa, Homo sapiens; identical to SEQ ID NO: 83125
  Payload ID: 16543
  Gene Symbol: SSFA2
  Gene Name: sperm specific antigen 2
  ENSP ID: ENSP00000415625

SEQ ID NO: 83128 - protein, 448 aa, Homo sapiens
  Payload ID: 16544
  Gene Symbol: SPERT
  Gene Name: spermatid associated
  Uniprot ID: Q8NA61
  ENSP ID: ENSP00000309189
MSPLECSECFGDQLLHRTYTWQLTLHSRPNYTRKRDTRSESLEIPISVVLPQRGTAEPFPRLHNLYSTPRCAQQAALPRLSRRMASQHSYPLNRFSSVPLDPMERPMSQADLELDYNPPRVQLSDEMFVFQDGRWVNENCRLQSPYFSPSASFHHKLHHKRLAKECMLQEENKSLREENKALREENRMLSKENKILQVFWEEHKASLGREESRAPSPLLHKDSASLEVVKKDHVALQVPRGKEDSTLQLLREENRALQQLLEQKQAYWAQAEDTAAPAEESKPAPSPHEEPCSPGLLQDQGSGLSSRFEEPKGPPARQEDSKELRALRKMVSNMSGPSGEEEAKVGPGLPDGCQPLQLLREMRQALQALLKENRLLQEENRTLQVLRAEHRGFQEENKALWENNKLKLQQKLVIDTVTEVTARMEMLIEELYAFMPARSQDPKKPSRV

SEQ ID NO: 83129 - protein, 412 aa, Homo sapiens
  Payload ID: 16544
  Gene Symbol: SPERT
  Gene Name: spermatid associated
  Uniprot ID: Q8NA61
  ENSP ID: ENSP00000368249
MQPEGLKCRMEESNAERGTAEPFPRLHNLYSTPRCAQQAALPRLSRRMASQHSYPLNRFSSVPLDPMERPMSQADLELDYNPPRVQLSDEMFVFQDGRWVNENCRLQSPYFSPSASFHHKLHHKRLAKECMLQEENKSLREENKALREENRMLSKENKILQVFWEEHKASLGREESRAPSPLLHKDSASLEVVKKDHVALQVPRGKEDSTLQLLREENRALQQLLEQKQAYWAQAEDTAAPAEESKPAPSPHEEPCSPGLLQDQGSGLSSRFEEPKGPPARQEDSKELRALRKMVSNMSGPSGEEEAKVGPGLPDGCQPLQLLREMRQALQALLKENRLLQEENRTLQVLRAEHRGFQEENKALWENNKLKLQQKLVIDTVTEVTARMEMLIEELYAFMPARSQDPKKPSRV

SEQ ID NO: 83130 - protein, 160 aa, Homo sapiens
  Payload ID: 16544
  Gene Symbol: SPERT
  Gene Name: spermatid associated
  ENSP ID: ENSP00000435230
MSPLECSECFGDQLLHRTYTWQLTLRGTAEPFPRLHNLYSTPRCAQQAALPRLSRRMASQHSYPLNRFSSVPLDPMERPMSQADLELDYNPPRVQLSDEMFVFQDGRWVNENCRLQSPYFSPSASFHHKLHHKRLAKECMLQEENKSLREENKALREENR

SEQ ID NO: 83131 - protein, 412 aa, Homo sapiens; identical to SEQ ID NO: 83129
  Payload ID: 16544
  Gene Symbol: SPERT
  Gene Name: spermatid associated
  Uniprot ID: Q8NA61
  ENSP ID: ENSP00000480148

SEQ ID NO: 83132 - protein, 309 aa, Homo sapiens
  Payload ID: 16545
  Gene Symbol: SPEM1
  Gene Name: spermatid maturation 1
  Uniprot ID: Q8N4L4
  ENSP ID: ENSP00000315554
MAMVERPRPEWASYHNCNSNSCQDLGNSVLLLLGLIICINISINIVTLLWSRFRGVLYQVFHDTICEKEAPKSSLLRKQTQPPKKQSSPAVHLRCTMDPVMMTVSPPPAHRHRRRGSPTRCAHCPVAWAPDTDDEKPHQYPAICSYHWDVPEDWEGFQHTQGTWVPWSQDAPESPPQTIRFQPTVEERPLKTGIWSELGLRAYVYPVNPPPPSPEAPSHKNGGEGAVPEAEAAQYQPVPAPTLGPAVIPEFSRHRSSGRIVYDARDMRRRLRELTREVEALSGCYPLASGSSTAEETSKNWVYRSLTGR

SEQ ID NO: 83133 - protein, 672 aa, Homo sapiens
  Payload ID: 16546
  Gene Symbol: STRBP
  Gene Name: spermatid perinuclear RNA binding protein
  Uniprot ID: Q96SI9
  ENSP ID: ENSP00000321347
MRSIRSFANDDRHVMVKHSTIYPSPEELEAVQNMVSTVECALKHVSDWLDETNKGTKTEGETEVKKDEAGENYSKDQGGRTLCGVMRIGLVAKGLLIKDDMDLELVLMCKDKPTETLLNTVKDNLPIQIQKLTEEKYQVEQCVNEASIIIRNTKEPTLTLKVILTSPLIRDELEKKDGENVSMKDPPDLLDRQKCLNALASLRHAKWFQARANGLKSCVIVLRILRDLCNRVPTWAPLKGWPLELICEKSIGTCNRPLGAGEALRRVMECLASGILLPGGPGLHDPCERDPTDALSYMTIQQKEDITHSAQHALRLSAFGQIYKVLEMDPLPSSKPFQKYSWSVTDKEGAGSSALKRPFEDGLGDDKDPNKKMKRNLRKILDSKAIDLMNALMRLNQIRPGLQYKLLSQSGPVHAPVFTMSVDVDGTTYEASGPSKKTAKLHVAVKVLQAMGYPTGFDADIECMSSDEKSDNESKNETVSSNSSNNTGNSTTETSSTLEVRTQGPILTASGKNPVMELNEKRRGLKYELISETGGSHDKRFVMEVEVDGQKFRGAGPNKKVAKASAALAALEKLFSGPNAANNKKKKIIPQAKGVVNTAVSAAVQAVRGRGRGTLTRGAFVGATAAPGYIAPGYGTPYGYSTAAPAYGLPKRMVLLPVMKFPTYPVPHYSFF

SEQ ID NO: 83134 - protein, 658 aa, Homo sapiens
  Payload ID: 16546
  Gene Symbol: STRBP
  Gene Name: spermatid perinuclear RNA binding protein
  Uniprot ID: Q96SI9
  ENSP ID: ENSP00000354271
MVKHSTIYPSPEELEAVQNMVSTVECALKHVSDWLDETNKGTKTEGETEVKKDEAGENYSKDQGGRTLCGVMRIGLVAKGLLIKDDMDLELVLMCKDKPTETLLNTVKDNLPIQIQKLTEEKYQVEQCVNEASIIIRNTKEPTLTLKVILTSPLIRDELEKKDGENVSMKDPPDLLDRQKCLNALASLRHAKWFQARANGLKSCVIVLRILRDLCNRVPTWAPLKGWPLELICEKSIGTCNRPLGAGEALRRVMECLASGILLPGGPGLHDPCERDPTDALSYMTIQQKEDITHSAQHALRLSAFGQIYKVLEMDPLPSSKPFQKYSWSVTDKEGAGSSALKRPFEDGLGDDKDPNKKMKRNLRKILDSKAIDLMNALMRLNQIRPGLQYKLLSQSGPVHAPVFTMSVDVDGTTYEASGPSKKTAKLHVAVKVLQAMGYPTGFDADIECMSSDEKSDNESKNETVSSNSSNNTGNSTTETSSTLEVRTQGPILTASGKNPVMELNEKRRGLKYELISETGGSHDKRFVMEVEVDGQKFRGAGPNKKVAKASAALAALEKLFSGPNAANNKKKKIIPQAKGVVNTAVSAAVQAVRGRGRGTLTRGAFVGATAAPGYIAPGYGTPYGYSTAAPAYGLPKRMVLLPVMKFPTYPVPHYSFF

SEQ ID NO: 83135 - protein, 94 aa, Homo sapiens
  Payload ID: 16546
  Gene Symbol: STRBP
  Gene Name: spermatid perinuclear RNA binding protein
  ENSP ID: ENSP00000384292
MRSIRSFANDDRHVMVKHSTIYPSPEELEAVQNMVSTVECALKHVSDWLDETNKGTKTEGETEVKKDEAGENYSKWSDIVWCNEDWPGCKRLAD

SEQ ID NO: 83136 - protein, 672 aa, Homo sapiens; identical to SEQ ID NO: 83133
  Payload ID: 16546
  Gene Symbol: STRBP
  Gene Name: spermatid perinuclear RNA binding protein
  Uniprot ID: Q96SI9
  ENSP ID: ENSP00000415968

SEQ ID NO: 83137 - protein, 89 aa, Homo sapiens
  Payload ID: 16546
  Gene Symbol: STRBP
  Gene Name: spermatid perinuclear RNA binding protein
  ENSP ID: ENSP00000431190
KVAKASAALAALEKLFSGPNAANNKKKKIIPQAKGVVNTAVSAAVQAVRGRGRGTLTRGAFVGATAAPGYIAPGYGTPYGYSTAAPAYG

SEQ ID NO: 83138 - protein, 74 aa, Homo sapiens
  Payload ID: 16546
  Gene Symbol: STRBP
  Gene Name: spermatid perinuclear RNA binding protein
  ENSP ID: ENSP00000431531
MRSIRSFANDDRHVMVKHSTIYPSPEELEAVQNMVSTVECALKHVSDWLDETNKGTKTEGETEVKKDEAGENYS

SEQ ID NO: 83139 - protein, 57 aa, Homo sapiens
  Payload ID: 16546
  Gene Symbol: STRBP
  Gene Name: spermatid perinuclear RNA binding protein
  ENSP ID: ENSP00000432626
AKGVVNTAVSAAVQAVRGRGRGTLTRGAFVGATAAPGYIAPGYGTPYGYSTAAPAYG

SEQ ID NO: 83140 - protein, 84 aa, Homo sapiens
  Payload ID: 16546
  Gene Symbol: STRBP
  Gene Name: spermatid perinuclear RNA binding protein
  ENSP ID: ENSP00000433106
  MOD_RES (1)..(1): Any amino acid
XKGVVNTAVSAAVQAVRGRGRGTLTRGAFVGATAAPGYIAPGYGTPYGYSTAAPAYEATLKEYGSHHLGGKKPMEIGTWGTQES

SEQ ID NO: 83141 - protein, 591 aa, Homo sapiens
  Payload ID: 16547
  Gene Symbol: SPATC1
  Gene Name: spermatogenesis and centriole associated 1
  Uniprot ID: Q76KD6
  ENSP ID: ENSP00000366690
MSLLTNYEGLRHQIERLVRENEELKKLVRLIRENHELKSAIKTQAGGLGISGFTSGLGEATAGLSSRQNNGVFLPPSPAVANERVLEEVGIMALAPLAEMLTSLQPSATPGSLMSPLTGTLSTLLSGPAPTSQSSPLTSFLTSPIAGPLTGTLASSLGLPSTGTLTPSSLVAGPVAMSQSSPLIAPVMGTVAVSLSSPLLSSTATPPGVSQNLLANPMSNLVLPEAPRLRLAEPLRGGPTGPQSPACVVPTATTKVPLSTEPPQSTQDPEPLSMAFAGAPLQTSTPIGAMGTPAPKTAFSFNTSDTQAQPSAAQEQVVPASVPTSPTTSPTVTVLASAPALAPQVATSYTPSSTTHIAQGAPHPPSRMHNSPTQNLPVPHCPPHNAHSPPRTSSSPASVNDSRGPRTTEPSTKSMMEVERKLAHRKTSKFPENPRESKQLAWERLVGEIAFQLDRRILSSIFPERVRLYGFTVSNIPEKIIQASLNPSDHKLDEKLCQRLTQRYVSVMNRLQSLGYNGRVHPALTEQLVNAYGILRERPELAASEGGPYTVDFLQRVVVETVHPGMLADALLLLSCLSQLAHDDGKPMFIW

SEQ ID NO: 83142 - protein, 441 aa, Homo sapiens
  Payload ID: 16547
  Gene Symbol: SPATC1
  Gene Name: spermatogenesis and centriole associated 1
  Uniprot ID: Q76KD6
  ENSP ID: ENSP00000387613
MSLLTNYEGLRHQIERLVRENEELKKLVRLIRENHELKSAIKTQAGGLGISGFTSGLGEATAGLSSRQNNGVFLPPSPAVANERVLEEVGIMALAPLAEMLTSLQPSATPGSLMSPLTGTLSTLLSGPAPTSQSSPLTSFLTSPIAGPLTGTLASSLGLPSTGTLTPSSLVAGPVAMSQSSPLIAPVMGTVAVSLSSPLLSSTATPPGVSQNLLANPMSNLVLPEAPRLRLAEPLRGGPTGPQSPACVVPTATTKVPLSTEPPQSTQDPEPLSMAFAGAPLQTSTPIGAMGTPAPKTAFSFNTSDTQAQPSAAQEQVVPASVPTSPTTSPTVTVLASAPALAPQVATSYTPSSTTHIAQGAPHPPSRMHNSPTQNLPVPHCPPHNAHSPPRTSSSPASVNDSRGPRTTEPSTKSMMEVERKLAHRKTSKFPENPRGFPEPQ

SEQ ID NO: 83143 - protein, 340 aa, Homo sapiens
  Payload ID: 16548
  Gene Symbol: SPATC1L
  Gene Name: spermatogenesis and centriole associated 1-like
  Uniprot ID: Q9H0A9
  ENSP ID: ENSP00000291672
MAEGGELMSRLLSENADLKKQVRLLKENQMLRRLLSQSCQEGGGHDLLPPRAHAYPEAGSPGSGVPDFGRFTSVADTPSQLQTSSLEDLLCSHAPLSSEDDTSPGCAAPSQAPFKAFLSPPEPHSHRGTDRKLSPLLSPLQDSLVDKTLLEPREMVRPKKVCFSESSLPTGDRTRRSYYLNEIQSFAGAEKDARVVGEIAFQLDRRILAYVFPGVTRLYGFTVANIPEKIEQTSTKSLDGSVDERKLRELTQRYLALSARLEKLGYSRDVHPAFSEFLINTYGILKQRPDLRANPLHSSPAALRKLVIDVVPPKFLGDSLLLLNCLCELSKEDGKPLFAW

SEQ ID NO: 83144 - protein, 186 aa, Homo sapiens
  Payload ID: 16548
  Gene Symbol: SPATC1L
  Gene Name: spermatogenesis and centriole associated 1-like
  Uniprot ID: Q9H0A9
  ENSP ID: ENSP00000333869
MVRPKKVCFSESSLPTGDRTRRSYYLNEIQSFAGAEKDARVVGEIAFQLDRRILAYVFPGVTRLYGFTVANIPEKIEQTSTKSLDGSVDERKLRELTQRYLALSARLEKLGYSRDVHPAFSEFLINTYGILKQRPDLRANPLHSSPAALRKLVIDVVPPKFLGDSLLLLNCLCELSKEDGKPLFAW

SEQ ID NO: 83145 - protein, 186 aa, Homo sapiens; identical to SEQ ID NO: 83144
  Payload ID: 16548
  Gene Symbol: SPATC1L
  Gene Name: spermatogenesis and centriole associated 1-like
  Uniprot ID: Q9H0A9
  ENSP ID: ENSP00000478124

SEQ ID NO: 83146 - protein, 340 aa, Homo sapiens; identical to SEQ ID NO: 83143
  Payload ID: 16548
  Gene Symbol: SPATC1L
  Gene Name: spermatogenesis and centriole associated 1-like
  Uniprot ID: Q9H0A9
  ENSP ID: ENSP00000483544

SEQ ID NO: 83147 - protein, 328 aa, Homo sapiens
  Payload ID: 16549
  Gene Symbol: SOHLH1
  Gene Name: spermatogenesis and oogenesis specific basic helix-loop-helix 1
  Uniprot ID: Q5JUK2
  ENSP ID: ENSP00000298466
MASRCSEPYPEVSRIPTVRGCNGSLSGALSCCEDSARGSGPPKAPTVAEGPSSCLRRNVISERERRKRMSLSCERLRALLPQFDGRREDMASVLEMSVQFLRLASALGPSQEQHAILASSKEMWHSLQEDVLQLTLSSQIQAGVPDPGTGASSGTRTPDVKAFLESPWSLDPASASPEPVPHILASSRQWDPASCTSLGTDKCEALLGLCQVRGGLPPFSEPSSLVPWPPGRSLPKAVRPPLSWPPFSQQQTLPVMSGEALGWLGQAGPLAMGAAPLGEPAKEDPMLAQEAGSALGSDVDDGTSFLLTAGPSSWPGEWGPGFRAGPPA

SEQ ID NO: 83148 - protein, 387 aa, Homo sapiens
  Payload ID: 16549
  Gene Symbol: SOHLH1
  Gene Name: spermatogenesis and oogenesis specific basic helix-loop-helix 1
  Uniprot ID: Q5JUK2
  ENSP ID: ENSP00000404438
MASRCSEPYPEVSRIPTVRGCNGSLSGALSCCEDSARGSGPPKAPTVAEGPSSCLRRNVISERERRKRMSLSCERLRALLPQFDGRREDMASVLEMSVQFLRLASALGPSQEQHAILASSKEMWHSLQEDVLQLTLSSQIQAGVPDPGTGASSGTRTPDVKAFLESPWSLDPASASPEPVPHILASSRQWDPASCTSLGTDKCEALLGLCQVRGGLPPFSEPSSLVPWPPGRSLPKAVRPPLSWPPFSQQQTLPVMSGEALGWLGQAGPLAMGAAPLGEPAKEDPMLAQEAGSALGSDVDDGTSFLLTAGPSSWPGSLEGRGGSGPAWAPAESSPLDVGEPGFLGDPELGSQELQDSPLEPWGLDVDCAGLALKDEVESIFPDFFAC

SEQ ID NO: 83149 - protein, 225 aa, Homo sapiens
  Payload ID: 16550
  Gene Symbol: SOHLH2
  Gene Name: spermatogenesis and oogenesis specific basic helix-loop-helix 2
  Uniprot ID: Q9NX45
  ENSP ID: ENSP00000326838
MASSIICQEHCQISGQAKIDILLVGDVTVGYLADTVQKLFANIAEVTITISDTKEAAALLDDCIFNMVLLKVPSSLSAEELEAIKLIRFGKKKNTHSLFVFIIPENFKGCISGHGMDIALTEPLTMEKMSNVVKYWTTCPSNTVKTENATGPEELGLPLQRSYSEHLGYFPTDLFACSESLRNGNGLELNASLSEFEKNKKISLLHSSKEKLRRLYRKHSSFCFW

SEQ ID NO: 83150 - protein, 425 aa, Homo sapiens
  Payload ID: 16550
  Gene Symbol: SOHLH2
  Gene Name: spermatogenesis and oogenesis specific basic helix-loop-helix 2
  Uniprot ID: Q9NX45
  ENSP ID: ENSP00000369210
MASSIICQEHCQISGQAKIDILLVGDVTVGYLADTVQKLFANIAEVTITISDTKEAAALLDDCIFNMVLLKVPSSLSAEELEAIKLIRFGKKKNTHSLFVFIIPENFKGCISGHGMDIALTEPLTMEKMSNVVKYWTTCPSNTVKTENATGPEELGLPLQRSYSEHLGYFPTDLFACSESLRNGNGLELNASLSEFEKNKKISLLHSSKEKLRRERIKYCCEQLRTLLPYVKGRKNDAASVLEATVDYVKYIREKISPAVMAQITEALQSNMRFCKKQQTPIELSLPGTVMAQRENSVMSTYSPERGLQFLTNTCWNGCSTPDAESSLDEAVRVPSSSASENAIGDPYKTHISSAALSLNSLHTVRYYSKVTPSYDATAVTNQNISIHLPSAMPPVSKLLPRHCTSGLGQTCTTHPNCLQQFWAY

SEQ ID NO: 83151 - protein, 190 aa, Homo sapiens
  Payload ID: 16551
  Gene Symbol: SPATA12
  Gene Name: spermatogenesis associated 12
  Uniprot ID: Q7Z6I5
  ENSP ID: ENSP00000335392
MSSSALTCGSTLEKSGDTWEMKALDSSRLVPWPPRGLGSSTQHPNKPHCALASCQGPGVLPGAASALPELTFQGDVCQSETCQRYLQAAISLDIAVSQINLLGRPSSPPALLIQQGSCEQVIHNSTPQFLGMEDGDNERTTGWLWRLCEDIDAEPSSTGCSRSNQLTFTEGCFVRSLSTVYSNTHIHTHL

SEQ ID NO: 83152 - protein, 596 aa, Homo sapiens
  Payload ID: 16552
  Gene Symbol: SPATA13
  Gene Name: spermatogenesis associated 13
  Uniprot ID: Q96N96
  ENSP ID: ENSP00000343631
MGFIIHIQQVKKQRKKLDQGLILKKEKYRKEKKCASLSFEVSSDGGTEPSALVDDNGSEEDFSYEDLCQASPRYLQPGGEQLAINELISDGNVVCAEALWDHVTMDDQELGFKAGDVIQVLEASNKDWWWGRSEDKEAWFPASFVRLRVNQEELSENSSSTPSEEQDEEASQSRHRHCENKQQMRTNVIREIMDTERVYIKHLRDICEGYIRQCRKHTGMFTVAQLATIFGNIEDIYKFQRKFLKDLEKQYNKEEPHLSEIGSCFLQNQEGFAIYSEYCNNHPGACLELANLMKQGKYRHFFEACRLLQQMIDIAIDGFLLTPVQKICKYPLQLAELLKYTTQEHGDYSNIKAAYEAMKNVACLINERKRKLESIDKIARWQVSIVGWEGLDILDRSSELIHSGELTKITKQGKSQQRTFFLFDHQLVSCKKDLLRRDMLYYKGRLDMDEMELVDLGDGRDKDCNLSVKNAFKLVSRTTDEVYLFCAKKQEDKARWLQACADERRRVQEDKEMGMEISENQKKLAMLNAQKAGHGKSKGYNRCPVAPPHQGLHPIHQRHITMPTSVPQQQVFGLAEPKRKSSLFWHTFNRLTPFRK

SEQ ID NO: 83153 - protein, 652 aa, Homo sapiens
  Payload ID: 16552
  Gene Symbol: SPATA13
  Gene Name: spermatogenesis associated 13
  Uniprot ID: Q96N96
  ENSP ID: ENSP00000371527
MTSASPEDQNAPVGCPKGARRRRPISVIGGVSLYGTNQTEELDNLLTQPASRPPMPAHQVPPYKAVSARFRPFTFSQSTPIGLDRVGRRRQMRASNVSSDGGTEPSALVDDNGSEEDFSYEDLCQASPRYLQPGGEQLAINELISDGNVVCAEALWDHVTMDDQELGFKAGDVIQVLEASNKDWWWGRSEDKEAWFPASFVRLRVNQEELSENSSSTPSEEQDEEASQSRHRHCENKQQMRTNVIREIMDTERVYIKHLRDICEGYIRQCRKHTGMFTVAQLATIFGNIEDIYKFQRKFLKDLEKQYNKEEPHLSEIGSCFLQNQEGFAIYSEYCNNHPGACLELANLMKQGKYRHFFEACRLLQQMIDIAIDGFLLTPVQKICKYPLQLAELLKYTTQEHGDYSNIKAAYEAMKNVACLINERKRKLESIDKIARWQVSIVGWEGLDILDRSSELIHSGELTKITKQGKSQQRTFFLFDHQLVSCKKDLLRRDMLYYKGRLDMDEMELVDLGDGRDKDCNLSVKNAFKLVSRTTDEVYLFCAKKQEDKARWLQACADERRRVQEDKEMGMEISENQKKLAMLNAQKAGHGKSKGYNRCPVAPPHQGLHPIHQRHITMPTSVPQQQVFGLAEPKRKSSLFWHTFNRLTPFRK

SEQ ID NO: 83154 - protein, 1277 aa, Homo sapiens
  Payload ID: 16552
  Gene Symbol: SPATA13
  Gene Name: spermatogenesis associated 13
  Uniprot ID: Q96N96
  ENSP ID: ENSP00000371542
MTQAAVRPWAPCLENMTTAPNGLGPGPAAPCAGSDLKDAKMVTSLACGNGVCGCSPGGDTDTQEAKLSPAKLVRLFSTSRKRTGAHPERPHSMVLVGNSSTWNTLASFRKMGSFKKLKSSVLKGIQSREGSNACSKGEASEHGLGKSIPNGAVPGAQASRGSPLAPGPACGALRPAEWGTLDGSDLEDTDDAFQRSTHRSRSLRRAYGLGRICLLDAPQNHATPTIATGQVPAVCEILVRDPENNSMGYRRSKSTDNLAFLKKSSFKRKSTSNLADLRTAHDARVPQRTLSSSSTDSQKLGSGRTKRWRSPIRAKDFDRVFKLVSNVTEAAWRRESPRSGAPSPGEASLRLQAHSRLHDDYSRRVSRSTEQDSRRGGAVMHGTTATCTVAPGFGSATSKGPHLDADTAVFPLETKSSWAVESDSSCTCSSLPSPIVQDVLSKDSCDPNAGSQLTFDPEQPPTPLRPTTPKPQSPQSPQSPGAGSASCHSNHSALSANSEESEGRAEEPAQREPGPVSLQDPLEATHGDEGSKDLLVNIGVAAGPEEKEKEEVVPDGPWRRSSSQDEERTEAQRTPKRRWGSGRRPRPRPFSDYGQLASRSLSIPEDSVAADPQKEDRVDEDPQASMTSASPEDQNAPVGCPKGARRRRPISVIGGVSLYGTNQTEELDNLLTQPASRPPMPAHQVPPYKAVSARFRPFTFSQSTPIGLDRVGRRRQMRASNVSSDGGTEPSALVDDNGSEEDFSYEDLCQASPRYLQPGGEQLAINELISDGNVVCAEALWDHVTMDDQELGFKAGDVIQVLEASNKDWWWGRSEDKEAWFPASFVRLRVNQEELSENSSSTPSEEQDEEASQSRHRHCENKQQMRTNVIREIMDTERVYIKHLRDICEGYIRQCRKHTGMFTVAQLATIFGNIEDIYKFQRKFLKDLEKQYNKEEPHLSEIGSCFLQNQEGFAIYSEYCNNHPGACLELANLMKQGKYRHFFEACRLLQQMIDIAIDGFLLTPVQKICKYPLQLAELLKYTTQEHGDYSNIKAAYEAMKNVACLINERKRKLESIDKIARWQVSIVGWEGLDILDRSSELIHSGELTKITKQGKSQQRTFFLFDHQLVSCKKDLLRRDMLYYKGRLDMDEMELVDLGDGRDKDCNLSVKNAFKLVSRTTDEVYLFCAKKQEDKARWLQACADERRRVQEDKEMGMEISENQKKLAMLNAQKAGHGKSKGYNRCPVAPPHQGLHPIHQRHITMPTSVPQQQVFGLAEPKRKSSLFWHTFNRLTPFRK

SEQ ID NO: 83155 - protein, 574 aa, Homo sapiens
  Payload ID: 16552
  Gene Symbol: SPATA13
  Gene Name: spermatogenesis associated 13
  Uniprot ID: Q96N96
  ENSP ID: ENSP00000382830
MVARGEIARFWSLESLHLVSSDGGTEPSALVDDNGSEEDFSYEDLCQASPRYLQPGGEQLAINELISDGNVVCAEALWDHVTMDDQELGFKAGDVIQVLEASNKDWWWGRSEDKEAWFPASFVRLRVNQEELSENSSSTPSEEQDEEASQSRHRHCENKQQMRTNVIREIMDTERVYIKHLRDICEGYIRQCRKHTGMFTVAQLATIFGNIEDIYKFQRKFLKDLEKQYNKEEPHLSEIGSCFLQNQEGFAIYSEYCNNHPGACLELANLMKQGKYRHFFEACRLLQQMIDIAIDGFLLTPVQKICKYPLQLAELLKYTTQEHGDYSNIKAAYEAMKNVACLINERKRKLESIDKIARWQVSIVGWEGLDILDRSSELIHSGELTKITKQGKSQQRTFFLFDHQLVSCKKDLLRRDMLYYKGRLDMDEMELVDLGDGRDKDCNLSVKNAFKLVSRTTDEVYLFCAKKQEDKARWLQACADERRRVQEDKEMGMEISENQKKLAMLNAQKAGHGKSKGYNRCPVAPPHQGLHPIHQRHITMPTSVPQQQVFGLAEPKRKSSLFWHTFNRLTPFRK

SEQ ID NO: 83156 - protein, 512 aa, Homo sapiens
  Payload ID: 16552
  Gene Symbol: SPATA13
  Gene Name: spermatogenesis associated 13
  ENSP ID: ENSP00000386471
MVARGEIARFWSLESLHLVSSDGGTEPSALVDDNGSEEDFSYEDLCQASPRYLQPGGEQLAINELISDGNVVCAEALWDHVTMDDQELGFKAGDVIQVLEASNKDWWWGRSEDKEAWFPASFVRGYIRQCRKHTGMFTVAQLATIFGNIEDIYKFQRKFLKDLEKQYNKEEPHLSEIGSCFLQNQEGFAIYSEYCNNHPGACLELANLMKQGKYRHFFEACRLLQQMIDIAIDGFLLTPVQKICKYPLQLAELLKYTTQEHGDYSNIKAAYEAMKNVACLINERKRKLESIDKIARWQVSIVGWEGLDILDRSSELIHSGELTKITKQGKSQQRTFFLFDHQLVSCKKDLLRRDMLYYKGRLDMDEMELVDLGDGRDKDCNLSVKNAFKLVSRTTDEVYLFCAKKQEDKARWLQACADERRRVQEDKEMGMEISENQKKLAMLNAQKAGHGKSKGYNRCPVAPPHQGLHPIHQRHITMPTSVPQQQVFGLAEPKRKSSLFWHTFNRLTPFRK

SEQ ID NO: 83157 - protein, 146 aa, Homo sapiens
  Payload ID: 16552
  Gene Symbol: SPATA13
  Gene Name: spermatogenesis associated 13
  ENSP ID: ENSP00000397498
MGFIIHIQQVKKQRKKLDQGLILKKEKYRKEKKCASLSFEVSSDGGTEPSALVDDNGSEEDFSYEDLCQASPRYLQPGGEQLAINELISDGNVVCAEALWDHVTMDDQELGFKAGDVIQVLEASNKDWWWGRSEDKEAWFPASFVR

SEQ ID NO: 83158 - protein, 1277 aa, Homo sapiens; identical to SEQ ID NO: 83154
  Payload ID: 16552
  Gene Symbol: SPATA13
  Gene Name: spermatogenesis associated 13
  Uniprot ID: Q96N96
  ENSP ID: ENSP00000398560

SEQ ID NO: 83159 - protein, 550 aa, Homo sapiens
  Payload ID: 16552
  Gene Symbol: SPATA13
  Gene Name: spermatogenesis associated 13
  ENSP ID: ENSP00000401605
TDFAFFLQPASRPPMPAHQVPPYKAVSARFRPFTFSQSTPIGLDRVGRRRQMRASNVSSDGGTEPSALVDDNGSEEDFSYEDLCQASPRYLQPGGEQLAINELISDGNVVCAEALWDHVTMDDQELGFKAGDVIQVLEASNKDWWWGRSEDKEAWFPASFVRGYIRQCRKHTGMFTVAQLATIFGNIEDIYKFQRKFLKDLEKQYNKEEPHLSEIGSCFLQNQEGFAIYSEYCNNHPGACLELANLMKQGKYRHFFEACRLLQQMIDIAIDGFLLTPVQKICKYPLQLAELLKYTTQEHGDYSNIKAAYEAMKNVACLINERKRKLESIDKIARWQVSIVGWEGLDILDRSSELIHSGELTKITKQGKSQQRTFFLFDHQLVSCKKDLLRRDMLYYKGRLDMDEMELVDLGDGRDKDCNLSVKNAFKLVSRTTDEVYLFCAKKQEDKARWLQACADERRRVQEDKEMGMEISENQKKLAMLNAQKAGHGKSKGYNRCPVAPPHQGLHPIHQRHITMPTSVPQQQVFGLAEPKRKSSLFWHTFNRLTPFRK

SEQ ID NO: 83160 - protein, 23 aa, Homo sapiens
  Payload ID: 16552
  Gene Symbol: SPATA13
  Gene Name: spermatogenesis associated 13
  ENSP ID: ENSP00000477296
MGFIIHIQQVKKQRKKLDQGLIL

SEQ ID NO: 83161 - protein, 23 aa, Homo sapiens
  Payload ID: 16552
  Gene Symbol: SPATA13
  Gene Name: spermatogenesis associated 13
  ENSP ID: ENSP00000477304
MGFIIHIQQVKKQRKKLDQGLIL

SEQ ID NO: 83162 - protein, 569 aa, Homo sapiens
  Payload ID: 16553
  Gene Symbol: SPATA16
  Gene Name: spermatogenesis associated 16
  Uniprot ID: Q9BXB7
  ENSP ID: ENSP00000341765
MDAGSSRSLENAVNRIYHDQLVPKINTSKKMSTLAHPPNILEMSQEIKKNCGGKQVEITLERTKMTKGIKEKQSNDLEKAAFKRKAEGEEKPTRKKQAKITELDNQLITMPLPHIPLKNIMDVEMKLVYIDEMGVRYEFVESFMSTGSQPTCQAAEIVDPLSVHNFSFLPQIDKWLQVALKDASSCYRQKKYALAAGQFRTALELCSKGAVLGEPFDAPAEDIASVASFIETKLVTCYLRMRKPDLALNHAHRSIVLNPAYFRNHLRQATVFRCLERYSEAARSAMIADYMFWLGGGREESISKLIKLYWQAMIEEAITRAESFSVMYTPFATKIRADKIEKVKDAFTKTHPAYAEYMYTDLQALHMLPQTVDWSSFPPQQYLLTLGFKNKDDGKFLEKISSRKLPIFTEHKTPFGLTREDTVRQMETMGKRILPILDFIRSTQLNGSFPASSGVMEKLQYASLLSQLQRVKEQSQVINQAMAELATIPYLQDISQQEAELLQSLMADAMDTLEGRRNNNERVWNMIQKVGQIEDFLYQLEDSFLKTKKLRTARRQKTKMKRLQTVQQR

SEQ ID NO: 83163 - protein, 361 aa, Homo sapiens
  Payload ID: 16554
  Gene Symbol: SPATA17
  Gene Name: spermatogenesis associated 17
  Uniprot ID: Q96L03
  ENSP ID: ENSP00000355900
MATLARLQARSSTVGNQYYFRNSVVDPFRKKENDAAVKIQSWFRGCQVRAYIRHLNRIVTIIQKWWRSFLGRKQYQLTVQVAYYTMMMNLYNAMAVRIQRRWRGYRVRKYLFNYYYLKEYLKVVSETNDAIRKALEEFAEMKEREEKKANLEREEKKRDYQARKMHYLLSTKQIPGIYNSPFRKEPDPWELQLQKAKPLTHRRPKVKQKDSTSLTDWLACTSARSFPRSEILPPINRKQCQGPFRDITEVLEQRYRPLEPTLRVAEPIDELKLAREELRREEWLQNVNDNMFLPFSSYHKNEKYIPSMHLSSKYGPISYKEQFRSENPKKWICDKDFQTVLPSFELFSKYGKLYSKAGQIV

SEQ ID NO: 83164 - protein, 80 aa, Homo sapiens
  Payload ID: 16554
  Gene Symbol: SPATA17
  Gene Name: spermatogenesis associated 17
  ENSP ID: ENSP00000473514
MATLARLQARSSTVGNQYYFRNSVVDPFRKKENDAAVKIQSWFRGCQVRAYIRHLNRIVTIIQKWWRSFLGRKQYQLTVQ

SEQ ID NO: 83165 - protein, 538 aa, Homo sapiens
  Payload ID: 16555
  Gene Symbol: SPATA18
  Gene Name: spermatogenesis associated 18
  Uniprot ID: Q8TC71
  ENSP ID: ENSP00000295213
MAENLKRLVSNETLRTLQEKLDFWLKEYNTNTCDQNLNHCLELIEQVAKVQGQLFGILTAAAQEGGRNDGVETIKSRLLPWLEASFTAASLGKSVDSKVPSLQDTFDRERHKDPSPRDRDMQQLDSNLNSTRSQCNQVQDDLVETEKNLEESKNRSAISLLAAEEEINQLKKQLKSLQAQEDARHRNTDQRSSENRRSEPWSLEERKREQWNSLKQNADQQDTEAMSDYKKQLRNLKEEIAVLSAEKSALQGRSSRSRSPSPAPRSRSCSRSRSASPSTAVKVRRPSPNRSKLSNVARKAALLSRFSDSYSQARLDAQCLLRRCIDKAETVQRIIYIATVEAFHVAKMAFRHFKIHVRKSLTPSYVGSNDFENAVLDYVICHLDLYDSQSSVNDVIRAMNVNPKISFPPVVDFCLLSDFIQEICCIAFAMQALEPPLDIAYGADGEVFNDCKYRRSYDSDFTAPLVLYHVWPALMENDCVIMKGEAVTRRGAFWNSVRSVSRCRSRSLSPICPRSQIGLNTMSRSRSPSPIRCGLPRF

SEQ ID NO: 83166 - protein, 506 aa, Homo sapiens
  Payload ID: 16555
  Gene Symbol: SPATA18
  Gene Name: spermatogenesis associated 18
  Uniprot ID: Q8TC71
  ENSP ID: ENSP00000415309
MAENLKRLVSNETLRTLQEKLDFWLKEYNTNTCDQNLNHCLELIEQVAKVQGQLFGILTAAAQEGGRNDGVETIKSRLLPWLEASFTAASLGKSVDSKVPSLQDTFDRERHKDPSPRDRDMQQLDSNLNSTRSQCNQVQDELKSLQAQEDARHRNTDQRSSENRRSEPWSLEERKREQWNSLKQNADQQDTEAMSDYKKQLRNLKEEIAVLSAEKSALQGRSSRSRSPSPAPRSRSCSRSRSASPSTAVKVRRPSPNRSKLSNVARKAALLSRFSDSYSQARLDAQCLLRRCIDKAETVQRIIYIATVEAFHVAKMAFRHFKIHVRKSLTPSYVGSNDFENAVLDYVICHLDLYDSQSSVNDVIRAMNVNPKISFPPVVDFCLLSDFIQEICCIAFAMQALEPPLDIAYGADGEVFNDCKYRRSYDSDFTAPLVLYHVWPALMENDCVIMKGEAVTRRGAFWNSVRSVSRCRSRSLSPICPRSQIGLNTMSRSRSPSPIRCGLPRF

SEQ ID NO: 83167 - protein, 516 aa, Homo sapiens
  Payload ID: 16555
  Gene Symbol: SPATA18
  Gene Name: spermatogenesis associated 18
  ENSP ID: ENSP00000421204
MAENLKRLVSNETLRTLQEKLDFWLKEYNTNTCDQNLNHCLELIEQVAKVQGQLFGILTAAAQEGGRNDGVETIKSRLLPWLEASFTAASLGKSVDSKVPSLQDTFDRERHKDPSPRDRDMQQLDSNLNSTRSQCNQVQDDLVETEKNLEESKNRSAISLLAAEEEINQLKKQLKSLQAQEDARHRNTDQRSSENRRSEPWSLEERKREQWNSLKQNADQQDTEAMSDYKKQLRNLKEEIAVLSAEKSALQGRSSRSRSPSPAPRSRSCSRSRSASPSTAVKVRRPSPNRSKLSNVARKAALLSRFSDSYSQARLDAQCLLRRCIDKAETVQRIIYIATVEAFHVAKMAFRHFKIHVRKSLTPSYVGSNDFENAVLDYVICHLDLYDSQSSVNDVIRAMNVNPKISFPPVVDFCLLSDFIQEICCIAFAMQALEPPLDIAYGADGEVFNDCKYRRSYDSDFTAPLVLYHVWPALMENDCVIMKGEAVTRRGAFVRWPCIVTIHPKCLIHNGIRCDL

SEQ ID NO: 83168 - protein, 104 aa, Homo sapiens
  Payload ID: 16555
  Gene Symbol: SPATA18
  Gene Name: spermatogenesis associated 18
  ENSP ID: ENSP00000424656
MAENLKRLVSNETLRTLQEKLDFWLKEYNTNTCDQNLNHCLELIEQVAKVQGQLFGILTAAAQEGGRNDGVETIKSRLLPWLEASFTAASLGKSVDSKVPSLQA

SEQ ID NO: 83169 - protein, 88 aa, Homo sapiens
  Payload ID: 16555
  Gene Symbol: SPATA18
  Gene Name: spermatogenesis associated 18
  ENSP ID: ENSP00000424695
MAENLKRLVSNETLRTLQEKLDFWLKEYNEDVMMVWKQSSHAFCLGWRLPLLLLPWENLLTARSPLCRTRLIGRDIKIPVLGIGICNS

SEQ ID NO: 83170 - protein, 31 aa, Homo sapiens
  Payload ID: 16555
  Gene Symbol: SPATA18
  Gene Name: spermatogenesis associated 18
  ENSP ID: ENSP00000426345
MAENLKRLVSNETLRTLQEKLDFWLKEYNSG

SEQ ID NO: 83171 - protein, 167 aa, Homo sapiens
  Payload ID: 16556
  Gene Symbol: SPATA19
  Gene Name: spermatogenesis associated 19
  Uniprot ID: Q7Z5L4
  ENSP ID: ENSP00000299140
MIITTWIVYILARKGVGLPFLPITSSDIDVVESEAVSVLHHWLKKTEEEASRGIKEKLSINHPSQGVREKMSTDSPPTHGQDIHVTRDVVKHHLSKSDLLANQSQEVLEERTRIQFIRWSHTRIFQVPSEMTEDIMRDRIEQVRRSISRLTDVSAQDFSMRPSSSDC

SEQ ID NO: 83172 - protein, 167 aa, Homo sapiens; identical to SEQ ID NO: 83171
  Payload ID: 16556
  Gene Symbol: SPATA19
  Gene Name: spermatogenesis associated 19
  Uniprot ID: Q7Z5L4
  ENSP ID: ENSP00000435248

SEQ ID NO: 83173 - protein, 520 aa, Homo sapiens
  Payload ID: 16557
  Gene Symbol: SPATA2
  Gene Name: spermatogenesis associated 2
  Uniprot ID: Q9UM82
  ENSP ID: ENSP00000289431
MGKPSSMDTKFKDDLFRKYVQFHESKVDTTTSRQRPGSDECLRVAASTLLSLHKVDPFYRFRLIQFYEVVESSLRSLSSSSLRALHGAFSMLETVGINLFLYPWKKEFRSIKTYTGPFVYYVKSTLLEEDIRAILSCMGYTPELGTAYKLRELVETLQVKMVSFELFLAKVECEQMLEIHSQVKDKGYSELDIVSERKSSAEDVRGCSDALRRRAEGREHLTASMSRVALQKSASERAAKDYYKPRVTKPSRSVDAYDSYWESRKPPLKASLSLRKEPVATDVGDDLKDEIIRPSPSLLTMASSPHGSPDVLPPASPSNGPALLRGTYFSTQDDVDLYTDSEPRATYRRQDALRPDVWLLRNDAHSLYHKRSPPAKESALSKCQSCGLSCSSSLCQRCDSLLTCPPASKPSAFPSKASTHDSLAHGASLREKYPGQTQGLDRLPHLHSKSKPSTTPTSRCGFCNRPGATNTCTQCSKVSCDACLSAYHYDPCYKKSELHKFMPNNQLNYKSTQLSHLVYR

SEQ ID NO: 83174 - protein, 520 aa, Homo sapiens; identical to SEQ ID NO: 83173
  Payload ID: 16557
  Gene Symbol: SPATA2
  Gene Name: spermatogenesis associated 2
  Uniprot ID: Q9UM82
  ENSP ID: ENSP00000416799

SEQ ID NO: 83175 - protein, 802 aa, Homo sapiens
  Payload ID: 16558
  Gene Symbol: SPATA20
  Gene Name: spermatogenesis associated 20
  Uniprot ID: Q8TB22
  ENSP ID: ENSP00000006658
MLGARAWLGRVLLLPRAGAGLAASRRCPGVWPRTWPHRSPSRGSSSRDKDRSATVSSSVPMPAGGKGSHPSSTPQRVPNRLIHEKSPYLLQHAYNPVDWYPWGQEAFDKARKENKPIFLSVGYSTCHWCHMMEEESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQGFHRYSTDRQWHVPHFEKMLYDQAQLAVAYSQAFQLSGDEFYSDVAKGILQYVARSLSHRSGGFYSAEDADSPPERGQRPKEGAYYVWTVKEVQQLLPEPVLGATEPLTSGQLLMKHYGLTEAGNISPSQDPKGELQGQNVLTVRYSLELTAARFGLDVEAVRTLLNSGLEKLFQARKHRPKPHLDSKMLAAWNGLMVSGYAVTGAVLGQDRLINYATNGAKFLKRHMFDVASGRLMRTCYTGPGGTVEHSNPPCWGFLEDYAFVVRGLLDLYEASQESAWLEWALRLQDTQDKLFWDSQGGGYFCSEAELGAGLPLRLKDDQDGAEPSANSVSAHNLLRLHGFTGHKDWMDKCVCLLTAFSERMRRVPVALPEMVRALSAQQQTLKQIVICGDRQAKDTKALVQCVHSVYIPNKVLILADGDPSSFLSRQLPFLSTLRRLEDQATAYVCENQACSVPITDPCELRKLLHP

SEQ ID NO: 83176 - protein, 786 aa, Homo sapiens
  Payload ID: 16558
  Gene Symbol: SPATA20
  Gene Name: spermatogenesis associated 20
  Uniprot ID: Q8TB22
  ENSP ID: ENSP00000348878
MLGARAWLGRVLLLPRAGAGLAASRRGSSSRDKDRSATVSSSVPMPAGGKGSHPSSTPQRVPNRLIHEKSPYLLQHAYNPVDWYPWGQEAFDKARKENKPIFLSVGYSTCHWCHMMEEESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQGFHRYSTDRQWHVPHFEKMLYDQAQLAVAYSQAFQLSGDEFYSDVAKGILQYVARSLSHRSGGFYSAEDADSPPERGQRPKEGAYYVWTVKEVQQLLPEPVLGATEPLTSGQLLMKHYGLTEAGNISPSQDPKGELQGQNVLTVRYSLELTAARFGLDVEAVRTLLNSGLEKLFQARKHRPKPHLDSKMLAAWNGLMVSGYAVTGAVLGQDRLINYATNGAKFLKRHMFDVASGRLMRTCYTGPGGTVEHSNPPCWGFLEDYAFVVRGLLDLYEASQESAWLEWALRLQDTQDKLFWDSQGGGYFCSEAELGAGLPLRLKDDQDGAEPSANSVSAHNLLRLHGFTGHKDWMDKCVCLLTAFSERMRRVPVALPEMVRALSAQQQTLKQIVICGDRQAKDTKALVQCVHSVYIPNKVLILADGDPSSFLSRQLPFLSTLRRLEDQATAYVCENQACSVPITDPCELRKLLHP

SEQ ID NO: 83177 - protein, 56 aa, Homo sapiens
  Payload ID: 16558
  Gene Symbol: SPATA20
  Gene Name: spermatogenesis associated 20
  ENSP ID: ENSP00000422378
MLGARAWLGRVLLLPRAGAGLAASRRCPGVWPRTWPHRSPSRPRRLGETNLARSPQ

SEQ ID NO: 83178 - protein, 43 aa, Homo sapiens
  Payload ID: 16558
  Gene Symbol: SPATA20
  Gene Name: spermatogenesis associated 20
  ENSP ID: ENSP00000423643
MLGARAWLGRVLLLPRAGAGLAASRRSACSPTSRLNSLRSLIP

SEQ ID NO: 83179 - protein, 43 aa, Homo sapiens; identical to SEQ ID NO: 83178
  Payload ID: 16558
  Gene Symbol: SPATA20
  Gene Name: spermatogenesis associated 20
  ENSP ID: ENSP00000424215

SEQ ID NO: 83180 - protein, 247 aa, Homo sapiens
  Payload ID: 16558
  Gene Symbol: SPATA20
  Gene Name: spermatogenesis associated 20
  ENSP ID: ENSP00000424538
  MOD_RES (1)..(1): Any amino acid
XESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQTASGTSLTLRRCSMTRHSSLWPIRRPSSSLVMNSTLTWPKASCSTWLGA

SEQ ID NO: 83181 - protein, 110 aa, Homo sapiens
  Payload ID: 16558
  Gene Symbol: SPATA20
  Gene Name: spermatogenesis associated 20
  ENSP ID: ENSP00000425271
  MOD_RES (1)..(1): Any amino acid
XQAQLAVAYSQAFQLSGDEFYSDVAKGILQYVARSLSHRSGGFYSAEDADSPPERGQRPKEGAYYVWTVKEVQQLLPEPVLGATEPLTSGQLLMKHYGLTEAGNISPSQA

SEQ ID NO: 83182 - protein, 43 aa, Homo sapiens; identical to SEQ ID NO: 83178
  Payload ID: 16558
  Gene Symbol: SPATA20
  Gene Name: spermatogenesis associated 20
  ENSP ID: ENSP00000426025

SEQ ID NO: 83183 - protein, 43 aa, Homo sapiens; identical to SEQ ID NO: 83178
  Payload ID: 16558
  Gene Symbol: SPATA20
  Gene Name: spermatogenesis associated 20
  ENSP ID: ENSP00000426228

SEQ ID NO: 83184 - protein, 43 aa, Homo sapiens; identical to SEQ ID NO: 83178
  Payload ID: 16558
  Gene Symbol: SPATA20
  Gene Name: spermatogenesis associated 20
  ENSP ID: ENSP00000426608

SEQ ID NO: 83185 - protein, 67 aa, Homo sapiens
  Payload ID: 16558
  Gene Symbol: SPATA20
  Gene Name: spermatogenesis associated 20
  ENSP ID: ENSP00000427374
MLGARAWLGRVLLLPRAGAGLAASRRCPGVWPRTWPHRSPSRWALSEGVPMSGFLCLSLTWSSPRPY

SEQ ID NO: 83186 - protein, 742 aa, Homo sapiens
  Payload ID: 16558
  Gene Symbol: SPATA20
  Gene Name: spermatogenesis associated 20
  Uniprot ID: Q8TB22
  ENSP ID: ENSP00000483295
MPAGGKGSHPSSTPQRVPNRLIHEKSPYLLQHAYNPVDWYPWGQEAFDKARKENKPIFLSVGYSTCHWCHMMEEESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQGFHRYSTDRQWHVPHFEKMLYDQAQLAVAYSQAFQLSGDEFYSDVAKGILQYVARSLSHRSGGFYSAEDADSPPERGQRPKEGAYYVWTVKEVQQLLPEPVLGATEPLTSGQLLMKHYGLTEAGNISPSQDPKGELQGQNVLTVRYSLELTAARFGLDVEAVRTLLNSGLEKLFQARKHRPKPHLDSKMLAAWNGLMVSGYAVTGAVLGQDRLINYATNGAKFLKRHMFDVASGRLMRTCYTGPGGTVEHSNPPCWGFLEDYAFVVRGLLDLYEASQESAWLEWALRLQDTQDKLFWDSQGGGYFCSEAELGAGLPLRLKDDQDGAEPSANSVSAHNLLRLHGFTGHKDWMDKCVCLLTAFSERMRRVPVALPEMVRALSAQQQTLKQIVICGDRQAKDTKALVQCVHSVYIPNKVLILADGDPSSFLSRQLPFLSTLRRLEDQATAYVCENQACSVPITDPCELRKLLHP

SEQ ID NO: 83187 - protein, 521 aa, Homo sapiens
  Payload ID: 16558
  Gene Symbol: SPATA20
  Gene Name: spermatogenesis associated 20
  ENSP ID: ENSP00000489476
MSHLSSPPKKHKGEHKGHSLPHGSERGSSSRDKDRSATVSSSVPMPAGGKGSHPSSTPQRVPNRLIHEKSPYLLQHAYNPVDWYPWGQEAFDKARKENKPIFLSVGYSTCHWCHMMEEESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQGFHRYSTDRQWHVPHFEKMLYDQAQLAVAYSQAFQLSGDEFYSDVAKGILQYVARSLSHRSGGFYSAEDADSPPERGQRPKEGAYYVWTVKEVQQLLPEPVLGATEPLTSGQLLMKHYGLTEAGNISPSQDPKGELQGQNVLTVRYSLELTAARFGLDVEAVRTLLNSGLEKLFQARKHRPKPHLDSKMLAAWNGGAAHLRPSLSA

SEQ ID NO: 83188 - protein, 786 aa, Homo sapiens
  Payload ID: 16558
  Gene Symbol: SPATA20
  Gene Name: spermatogenesis associated 20
  ENSP ID: ENSP00000489591
MSHLSSPPKKHKGEHKGHSLPHGSERGSSSRDKDRSATVSSSVPMPAGGKGSHPSSTPQRVPNRLIHEKSPYLLQHAYNPVDWYPWGQEAFDKARKENKPIFLSVGYSTCHWCHMMEEESFQNEEIGRLLSEDFVSVKVDREERPDVDKVYMTFVQATSSGGGWPMNVWLTPNLQPFVGGTYFPPEDGLTRVGFRTVLLRIREQWKQNKNTLLENSQRVTTALLARSEISVGDRQLPPSAATVNNRCFQQLDEGYDEEYGGFAEAPKFPTPVILSFLFSYWLSHRLTQDGSRAQQMALHTLKMMANGGIRDHVGQGFHRYSTDRQWHVPHFEKMLYDQAQLAVAYSQAFQLSGDEFYSDVAKGILQYVARSLSHRSGGFYSAEDADSPPERGQRPKEGAYYVWTVKEVQQLLPEPVLGATEPLTSGQLLMKHYGLTEAGNISPSQDPKGELQGQNVLTVRYSLELTAARFGLDVEAVRTLLNSGLEKLFQARKHRPKPHLDSKMLAAWNGLMVSGYAVTGAVLGQDRLINYATNGAKFLKRHMFDVASGRLMRTCYTGPGGTVEHSNPPCWGFLEDYAFVVRGLLDLYEASQESAWLEWALRLQDTQDKLFWDSQGGGYFCSEAELGAGLPLRLKDDQDGAEPSANSVSAHNLLRLHGFTGHKDWMDKCVCLLTAFSERMRRVPVALPEMVRALSAQQQTLKQIVICGDRQAKDTKALVQCVHSVYIPNKVLILADGDPSSFLSRQLPFLSTLRRLEDQATAYVCENQACSVPITDPCELRKLLHP

SEQ ID NO: 83189 - protein, 469 aa, Homo sapiens
  Payload ID: 16559
  Gene Symbol: SPATA21
  Gene Name: spermatogenesis associated 21
  Uniprot ID: Q7Z572
  ENSP ID: ENSP00000335612
MDNRNTQMYTEEEKTVNPFLPSTPGPKKAKGGGEAVETHPAPGPLPPPEVRDIGERREPDRAQQQPQKPAVAAGTQSLGNFRQGFMKCLLEVEKMEASHRRASKARSQTAQKSPRTLTPVPTSAPSLPQTPASVPASGPSWARLPAPGPEPAPMGAPVPTSMPCPVLLGPALDLGWRRMELLHQSSERTLSYAKARQEPEEQSLQKLYQNREKSEEQLTLKQEEAFRSYFEIFNGPGEVDAQSLKNILLLMGFSVTLAQVEDALMSADVNGDGRVDFKDFLAVMTDTRRFFCSVEQNALSDMAPHNPHTLLFEILSLLVEMLALPEAVLEEITNYYQKKLKEGTCKAQEMEAAVGRLRLQKLPYNPQQEESSEVPERKVLSILSRLKQQNYAPNLQSPYAQVPCILLCPQLDKKMVRRQPSNHYALDQCTPPGLDPDIRSPFFQSGSQGNREHNSDSRKWLSSVPARTH

SEQ ID NO: 83190 - protein, 200 aa, Homo sapiens
  Payload ID: 16559
  Gene Symbol: SPATA21
  Gene Name: spermatogenesis associated 21
  ENSP ID: ENSP00000364727
MDNRNTQMYTEGRTKAPGTQPSPGLRITIKRAGVEPIIPGVSKVMFPDASEVGSKKHLSSASRGPEKGPRLRDAFEKGPSELRIQEQGPPARPGKKQPSWVPQEGSQELQAGQDQSELGLLPSWVPEVPEGLQQLGSGKEIKGQQGRQRNRGIGEDQPPESCQAGHGGSRLLIPALLEAEGGRSPEVKTSLANMVKPCLY

SEQ ID NO: 83191 - protein, 160 aa, Homo sapiens
  Payload ID: 16559
  Gene Symbol: SPATA21
  Gene Name: spermatogenesis associated 21
  ENSP ID: ENSP00000420753
SVEQNALSDMAPHNPHTLLFEILSLLVEMLALPEAVLEEITNYYQKKLKEGTCKAQEMEAAVGRLRLQKLPYNPQQEESSEVPERKVLSILSRLKQQNYAPNLQSPYAQVPCILLCPQLDKKMVRRQPSNHYALDQCTPPGLDPDIRSPFFQSGSQGNRV

SEQ ID NO: 83192 - protein, 446 aa, Homo sapiens
  Payload ID: 16559
  Gene Symbol: SPATA21
  Gene Name: spermatogenesis associated 21
  Uniprot ID: Q7Z572
  ENSP ID: ENSP00000440046
MAQPGAVEHACHPSTLGGQGGGSLEEVRDIGERREPDRAQQQPQKPAVAAGTQSLGNFRQGFMKCLLEVEKMEASHRRASKARSQTAQKSPRTLTPVPTSAPSLPQTPASVPASGPSWARLPAPGPEPAPMGAPVPTSMPCPVLLGPALDLGWRRMELLHQSSERTLSYAKARQEPEEQSLQKLYQNREKSEEQLTLKQEEAFRSYFEIFNGPGEVDAQSLKNILLLMGFSVTLAQVEDALMSADVNGDGRVDFKDFLAVMTDTRRFFCSVEQNALSDMAPHNPHTLLFEILSLLVEMLALPEAVLEEITNYYQKKLKEGTCKAQEMEAAVGRLRLQKLPYNPQQEESSEVPERKVLSILSRLKQQNYAPNLQSPYAQVPCILLCPQLDKKMVRRQPSNHYALDQCTPPGLDPDIRSPFFQSGSQGNREHNSDSRKWLSSVPARTH

SEQ ID NO: 83193 - protein, 200 aa, Homo sapiens; identical to SEQ ID NO: 83190
  Payload ID: 16559
  Gene Symbol: SPATA21
  Gene Name: spermatogenesis associated 21
  ENSP ID: ENSP00000483493

SEQ ID NO: 83194 - protein, 269 aa, Homo sapiens
  Payload ID: 16560
  Gene Symbol: SPATA22
  Gene Name: spermatogenesis associated 22
  Uniprot ID: Q8NHS9
  ENSP ID: ENSP00000268981
MKRSLNENSARSTAGCLPVPLFNQKKRNRQPLTSNPLKDDSGISTPSDNYDFPPLPTDWAWEAVNPELAPVMKTVDTGQIPHSVSRPLRSQDSVFNSIQSNTGRSQGGWSYRDGNKNTSLKTWNKNDFKPQCKRTNLVANDGKNSCPVSSGAQQQKQLRIPEPPNLSRNKETELLRQTHSSKISGCTMRGLDKNSALQTLKPNFQQNQYKKQMLDDIPEDNTLKETSLYQLQFKEKASSLRIISAVIESMKYWREHAQKTVLLFEVLGS

SEQ ID NO: 83195 - protein, 320 aa, Homo sapiens
  Payload ID: 16560
  Gene Symbol: SPATA22
  Gene Name: spermatogenesis associated 22
  Uniprot ID: Q8NHS9
  ENSP ID: ENSP00000347541
MKRSLNENSARSTADWAWEAVNPELAPVMKTVDTGQIPHSVSRPLRSQDSVFNSIQSNTGRSQGGWSYRDGNKNTSLKTWNKNDFKPQCKRTNLVANDGKNSCPVSSGAQQQKQLRIPEPPNLSRNKETELLRQTHSSKISGCTMRGLDKNSALQTLKPNFQQNQYKKQMLDDIPEDNTLKETSLYQLQFKEKASSLRIISAVIESMKYWREHAQKTVLLFEVLAVLDSAVTPGPYYSKTFLMRDGKNTLPCVFYEIDRELPRLIRGRVHRCVGNYDQKKNIFQCVSVRPASVSEQKTFQAFVKIADVEMQYYINVMNET

SEQ ID NO: 83196 - protein, 363 aa, Homo sapiens
  Payload ID: 16560
  Gene Symbol: SPATA22
  Gene Name: spermatogenesis associated 22
  Uniprot ID: Q8NHS9
  ENSP ID: ENSP00000380354
MKRSLNENSARSTAGCLPVPLFNQKKRNRQPLTSNPLKDDSGISTPSDNYDFPPLPTDWAWEAVNPELAPVMKTVDTGQIPHSVSRPLRSQDSVFNSIQSNTGRSQGGWSYRDGNKNTSLKTWNKNDFKPQCKRTNLVANDGKNSCPVSSGAQQQKQLRIPEPPNLSRNKETELLRQTHSSKISGCTMRGLDKNSALQTLKPNFQQNQYKKQMLDDIPEDNTLKETSLYQLQFKEKASSLRIISAVIESMKYWREHAQKTVLLFEVLAVLDSAVTPGPYYSKTFLMRDGKNTLPCVFYEIDRELPRLIRGRVHRCVGNYDQKKNIFQCVSVRPASVSEQKTFQAFVKIADVEMQYYINVMNET

SEQ ID NO: 83197 - protein, 347 aa, Homo sapiens
  Payload ID: 16560
  Gene Symbol: SPATA22
  Gene Name: spermatogenesis associated 22
  ENSP ID: ENSP00000441920
MKRSLNENSARSTAGCLPVPLFNQKKRNRQPLTSNPLKDDSDWAWEAVNPELAPVMKTVDTGQIPHSVSRPLRSQDSVFNSIQSNTGRSQGGWSYRDGNKNTSLKTWNKNDFKPQCKRTNLVANDGKNSCPVSSGAQQQKQLRIPEPPNLSRNKETELLRQTHSSKISGCTMRGLDKNSALQTLKPNFQQNQYKKQMLDDIPEDNTLKETSLYQLQFKEKASSLRIISAVIESMKYWREHAQKTVLLFEVLAVLDSAVTPGPYYSKTFLMRDGKNTLPCVFYEIDRELPRLIRGRVHRCVGNYDQKKNIFQCVSVRPASVSEQKTFQAFVKIADVEMQYYINVMNET

SEQ ID NO: 83198 - protein, 85 aa, Homo sapiens
  Payload ID: 16560
  Gene Symbol: SPATA22
  Gene Name: spermatogenesis associated 22
  ENSP ID: ENSP00000458923
MKTVDTGQIPHSVSRPLRSQDSVFNSIQSNTGRSQGGWSYRDGNKNTSLKTWNKNDFKPQCKRTNLVANDGKNSCPVSSGAQQQK

SEQ ID NO: 83199 - protein, 3 aa, Homo sapiens
  Payload ID: 16560
  Gene Symbol: SPATA22
  Gene Name: spermatogenesis associated 22
  ENSP ID: ENSP00000459147
MKR

SEQ ID NO: 83200 - protein, 363 aa, Homo sapiens; identical to SEQ ID NO: 83196
  Payload ID: 16560
  Gene Symbol: SPATA22
  Gene Name: spermatogenesis associated 22
  Uniprot ID: Q8NHS9
  ENSP ID: ENSP00000459329

SEQ ID NO: 83201 - protein, 168 aa, Homo sapiens
  Payload ID: 16560
  Gene Symbol: SPATA22
  Gene Name: spermatogenesis associated 22
  ENSP ID: ENSP00000459552
MKTVDTGQIPHSVSRPLRSQDSVFNSIQSNTGRSQGGWSYRDGNKNTSLKTWNKNDFKPQCKRTNLVANDGKNSCPVSSGAQQQKQLRIPEPPNLSRNKETELLRQTHSSKISGCTMRGLDKNSALQTLKPNFQQNQYKKQMLDDIPEDNTLKETSLYQLQFKEKASS

SEQ ID NO: 83202 - protein, 363 aa, Homo sapiens; identical to SEQ ID NO: 83196
  Payload ID: 16560
  Gene Symbol: SPATA22
  Gene Name: spermatogenesis associated 22
  Uniprot ID: Q8NHS9
  ENSP ID: ENSP00000459580

SEQ ID NO: 83203 - protein, 363 aa, Homo sapiens; identical to SEQ ID NO: 83196
  Payload ID: 16560
  Gene Symbol: SPATA22
  Gene Name: spermatogenesis associated 22
  Uniprot ID: Q8NHS9
  ENSP ID: ENSP00000460187

SEQ ID NO: 83204 - protein, 49 aa, Homo sapiens
  Payload ID: 16560
  Gene Symbol: SPATA22
  Gene Name: spermatogenesis associated 22
  ENSP ID: ENSP00000460692
MKRSLNENSARSTAGCLPVPLFNQKKRNRQPLTSNPLKDDSDWAWEAVN

SEQ ID NO: 83205 - protein, 164 aa, Homo sapiens
  Payload ID: 16560
  Gene Symbol: SPATA22
  Gene Name: spermatogenesis associated 22
  ENSP ID: ENSP00000461180
MKRSLNENSARSTAGCLPVPLFNQKKRNRQPLTSNPLKDDSGISTPSDNYDFPPLPTDWAWEAVNPELAPVMKTVDTGQIPHSVSRPLRSQDSVFNSIQSNTGRSQGGWSYRDGNKNTSLKTWNKNDFKPQCKRTNLVANDGKNSCPVSSGAQQQKQLRIPEPP

SEQ ID NO: 83206 - protein, 209 aa, Homo sapiens
  Payload ID: 16560
  Gene Symbol: SPATA22
  Gene Name: spermatogenesis associated 22
  ENSP ID: ENSP00000461462
MARMMRTRGMMMHNEDNSCLPVPLFNQKKRNRQPLTSNPLKDDSDWAWEAVNPELAPVMKTVDTGQIPHSVSRPLRSQDSVFNSIQSNTGRSQGGWSYRDGNKNTSLKTWNKNDFKPQCKRTNLVANDGKNSCPVSSGAQQQKQLRIPEPPNLSRNKETELLRQTHSSKISGCTMRGLDKNSALQTLKPNFQQNQYKKQMLDDIPEDNT

SEQ ID NO: 83207 - protein, 148 aa, Homo sapiens
  Payload ID: 16560
  Gene Symbol: SPATA22
  Gene Name: spermatogenesis associated 22
  ENSP ID: ENSP00000461722
MKTVDTGQIPHSVSRPLRSQDSVFNSIQSNTGRSQGGWSYRDGNKNTSLKTWNKNDFKPQCKRTNLVANDGKNSCPVSSGAQQQKQLRIPEPPNLSRNKETELLRQTHSSKISGCTMRGLDKNSALQTLKPNFQQNQYKKQMLDDIPE

SEQ ID NO: 83208 - protein, 293 aa, Homo sapiens
  Payload ID: 16561
  Gene Symbol: SPATA24
  Gene Name: spermatogenesis associated 24
  ENSP ID: ENSP00000302917
MATPLGWSKAGSGSVCLALDQLRDVIESQEELIHQLRNVMVLQDENFVSKEEFQAVEKKLVEEKAAHAKTKVLLAKEEEKLQFALGEVEVLSKQLEKEKLAFEKALSSVKSKVLQESSKKDQLITKCNEIESHIIKQEDILNGKENEIKELQQVISQQKQIFSPPPAGSVAGITCLTSGSRSSRRATWPRCWTRSIRKPQGHVRPAATSIPGKNKMAAAFLFSGCNPQPLPSLLWESPASSPCYFPPSWIVVGVHKVGACSLGEELGLCCLVGTTASFGYLIPSYINSPGYPV

SEQ ID NO: 83209 - protein, 188 aa, Homo sapiens
  Payload ID: 16561
  Gene Symbol: SPATA24
  Gene Name: spermatogenesis associated 24
  Uniprot ID: Q86W54
  ENSP ID: ENSP00000400524
MATPLGWSKAGSGSVCLALDQLRDVIESQEELIHQLRNVMVLQDENFVSKEEFQAVEKKLVEEKAAHAKTKVLLAKEEEKLQFALGEVEVLSKQLEKEKLAFEKALSSVKSKVLQESSKKDQLITKCNGRREARALHHGYINGLFPNHPVPVSKAGFHSNTCPQLRIQAGPGGPHLRKGLKGPGRPRK

SEQ ID NO: 83210 - protein, 205 aa, Homo sapiens
  Payload ID: 16561
  Gene Symbol: SPATA24
  Gene Name: spermatogenesis associated 24
  Uniprot ID: Q86W54
  ENSP ID: ENSP00000414920
MATPLGWSKAGSGSVCLALDQLRDVIESQEELIHQLRNVMVLQDENFVSKEEFQAVEKKLVEEKAAHAKTKVLLAKEEEKLQFALGEVEVLSKQLEKEKLAFEKALSSVKSKVLQESSKKDQLITKCNEIESHIIKQEDILNGKENEIKELQQVISQQKQIFRNHMSDFRIQKQQESYMAQVLDQKHKKASGTRQARSHQHPREK

SEQ ID NO: 83211 - protein, 185 aa, Homo sapiens
  Payload ID: 16561
  Gene Symbol: SPATA24
  Gene Name: spermatogenesis associated 24
  ENSP ID: ENSP00000423226
MATPLGWSKAGSGSVCLALDQLRDVIESQEELIHQLRNVMVLQDENFVSKEEFQAVEKKLVEEKAAHAKTKVLLAKEEEKLQFALGEVEVLSKQLEKEKLAFEKAVKSKVLQESSKKDQLITKCNGRREARALHHGYINGLFPNHPVPVSKAGFHSNTCPQLRIQAGPGGPHLRKGLKGPGRPRK

SEQ ID NO: 83212 - protein, 150 aa, Homo sapiens
  Payload ID: 16561
  Gene Symbol: SPATA24
  Gene Name: spermatogenesis associated 24
  ENSP ID: ENSP00000423424
  MOD_RES (1)..(1): Any amino acid
XLGWSKAGSGSVCLALDQLRDVIESQEELIHQLRNVMVLQDENFVSKEEFQAVEKKLVEEKAAHAKTKVLLAKEEEKLQFALGEVEVLSKQLEKEKLAFEKALSSVKSKVLQESSKKDQLITKCNGITCLTSGSRSSRRATWPRCWTRSI

SEQ ID NO: 83213 - protein, 166 aa, Homo sapiens
  Payload ID: 16561
  Gene Symbol: SPATA24
  Gene Name: spermatogenesis associated 24
  ENSP ID: ENSP00000424248
MATPLGWSKAGSGSVCLALDQLRDVIESQEELIHQLRNVEEKAAHAKTKVLLAKEEEKLQFALGEVEVLSKQLEKEKLAFEKALSSVKSKVLQESSKKDQLITKCNGRREARALHHGYINGLFPNHPVPVSKAGFHSNTCPQLRIQAGPGGPHLRKGLKGPGRPRK

SEQ ID NO: 83214 - protein, 153 aa, Homo sapiens
  Payload ID: 16561
  Gene Symbol: SPATA24
  Gene Name: spermatogenesis associated 24
  ENSP ID: ENSP00000426748
KEEFQAVEKKLVEEKAAHAKTKVLLAKEEEKLQFALGEVEVLSKQLEKEKLAFEKAVKSKVLQESSKKDQLITKCNEIESHIIKQEDILNGKENEIKELQQVISQQKQIFRNHMSDFRIQKQQESYMAQVLDQKHKKASGTRQARSHQHPREK

SEQ ID NO: 83215 - protein, 227 aa, Homo sapiens
  Payload ID: 16562
  Gene Symbol: SPATA25
  Gene Name: spermatogenesis associated 25
  Uniprot ID: Q9BR10
  ENSP ID: ENSP00000361597
MSYFRTPQTHPGPLPSGQGGAASPGLSLGLCSPVEPVVVASGGTGPLSQKAEQVAPAAQAWGPALAMPQARGCPGGTSWETLRKEYSRNCHKFPHVRQLESLGWDNGYSRSRAPDLGGPSRPRPLMLCGLSPRVLPVPSEAVGKEASSQPDICILTLAMMIAGIPTVPVPGVREEDLIWAAQAFMMAHPEPEGAVEGARWEQAHAHTASGKMPLVRSKRGQPPGSCL

SEQ ID NO: 83216 - protein, 424 aa, Homo sapiens
  Payload ID: 16563
  Gene Symbol: SPATA2L
  Gene Name: spermatogenesis associated 2-like
  Uniprot ID: Q8IUW3
  ENSP ID: ENSP00000289805
MGSSSLSEDYRQCLERELRRGRAGVCGDPSLRAVLWQILVEDFDLHGALQDDALALLTDGLWGRADLAPALRGLARAFELLELAAVHLYLLPWRKEFTTIKTFSGGYVHVLKGVLSDDLLLKSFQKMGYVRRDSHRLMVTALPPACQLVQVALGCFALRLECEILGEVLAQLGTSVLPAEELLQARRASGDVASCVAWLQQRLAQDEEPPPLPPRGSPAAYRAPLDLYRDLQEDEGSEDASLYGEPSPGPDSPPAELAYRPPLWEQSAKLWGTGGRAWEPPAEELPQASSPPYGALEEGLEPEPSAFSFLSLRRELSRPGDLATPESSAAASPRRIRAEGVPASAYRSVSEPPGYQAHSCLSPGALPTLCCDTCRQLHAAHCAALPACRPGHSLRVLLGDAQRRLWLQRAQMDTLLYNSPGARP

SEQ ID NO: 83217 - protein, 152 aa, Homo sapiens
  Payload ID: 16563
  Gene Symbol: SPATA2L
  Gene Name: spermatogenesis associated 2-like
  Uniprot ID: Q8IUW3
  ENSP ID: ENSP00000334006
MGSSSLSEDYRQCLERELRRGRAGVCGDPSLRAVLWQILVEDFDLHGALQDDALALLTDGLWGRADLAPALRGLARAFELLELAAVHLYLLPWRKEFTTIKTFSGGYVHVLKGVLSDDLLLKSFQKMGYVRRDSHRLMLCWSQSAGLCRVHG

SEQ ID NO: 83218 - protein, 180 aa, Homo sapiens
  Payload ID: 16563
  Gene Symbol: SPATA2L
  Gene Name: spermatogenesis associated 2-like
  ENSP ID: ENSP00000458083
MGSSSLSEDYRQCLERELRRGRAGVCGDPSLRAVLWQILVEDFDLHGALQDDALALLTDGLWGRADLAPALRGLARAFELLELAAVHLYLLPWRKEFTTIKTFSGGYVHVLKGVLSDDLLLKSFQKMGYVRRDSHRLMVTALPPACQLVQVALGCFALRLECEILGEVLAQLGTSVLPAE

SEQ ID NO: 83219 - protein, 192 aa, Homo sapiens
  Payload ID: 16564
  Gene Symbol: SPATA3
  Gene Name: spermatogenesis associated 3
  Uniprot ID: Q8NHX4
  ENSP ID: ENSP00000388741
MKKVKKKRSEARRHRDSTSQHASSNSTSQQPSPESTPQQPSPESTPQQPSPESTPQHSSLETTSRQPAFQALPAPEIRRSSCCLLSPDANVKAAPQSRKAGPLIRAGPHSCSCATCPCSSACWRRLGLCHSRIFDVLLPRDWQMAPGRGLPNLLTFYRKSSRKPSSHRNACPPSPRNCGCGSGGSRSCLLHH

SEQ ID NO: 83220 - protein, 192 aa, Homo sapiens; identical to SEQ ID NO: 83219
  Payload ID: 16564
  Gene Symbol: SPATA3
  Gene Name: spermatogenesis associated 3
  Uniprot ID: Q8NHX4
  ENSP ID: ENSP00000388895

SEQ ID NO: 83221 - protein, 37 aa, Homo sapiens
  Payload ID: 16564
  Gene Symbol: SPATA3
  Gene Name: spermatogenesis associated 3
  ENSP ID: ENSP00000395644
MKKVKKKRASDSRRPAFLLLCHLPLQLRLLASSGAMP

SEQ ID NO: 83222 - protein, 192 aa, Homo sapiens; identical to SEQ ID NO: 83219
  Payload ID: 16564
  Gene Symbol: SPATA3
  Gene Name: spermatogenesis associated 3
  Uniprot ID: Q8NHX4
  ENSP ID: ENSP00000399514

SEQ ID NO: 83223 - protein, 192 aa, Homo sapiens; identical to SEQ ID NO: 83219
  Payload ID: 16564
  Gene Symbol: SPATA3
  Gene Name: spermatogenesis associated 3
  Uniprot ID: Q8NHX4
  ENSP ID: ENSP00000403804

SEQ ID NO: 83224 - protein, 104 aa, Homo sapiens
  Payload ID: 16564
  Gene Symbol: SPATA3
  Gene Name: spermatogenesis associated 3
  ENSP ID: ENSP00000404510
STPQQPSPESTPQQPSPESTPQHSSLETTSRQPAFQALPAPEIRRSSCCLLSPDANVKAAPQSRKAENLQENPPVIVTRVLQALGTVAVALGALGAAYYITESL

SEQ ID NO: 83225 - protein, 87 aa, Homo sapiens
  Payload ID: 16564
  Gene Symbol: SPATA3
  Gene Name: spermatogenesis associated 3
  ENSP ID: ENSP00000411374
  MOD_RES (1)..(1): Any amino acid
XSTPQHSSLETTSRQPAFQALPAPEIRRSSCCLLSPDANVKAAPQSRKAENLQENPPVIVTRVLQALGTVAVALGALGAAYYITESL

SEQ ID NO: 83226 - protein, 6 aa, Homo sapiens
  Payload ID: 16564
  Gene Symbol: SPATA3
  Gene Name: spermatogenesis associated 3
  ENSP ID: ENSP00000436378
  MOD_RES (1)..(1): Any amino acid
XCLLHH

SEQ ID NO: 83227 - protein, 181 aa, Homo sapiens
  Payload ID: 16564
  Gene Symbol: SPATA3
  Gene Name: spermatogenesis associated 3
  ENSP ID: ENSP00000478372
MKKVKKKRSEARRHRDSTSQHASSNSTSQHPESTPQQPSPESTPQHSSLETTSRQPAFQALPAPEIRRSSCCLLSPDANVKAAPQSRKAGPLIRAGPHSCSCATCPCSSACWRRLGLCHSRIFDVLLPRDWQMAPGRGLPNLLTFYRKSSRKPSSHRNACPPSPRNCGCGSGGSRSCLLHH

SEQ ID NO: 83228 - protein, 384 aa, Homo sapiens
  Payload ID: 16565
  Gene Symbol: SPATA32
  Gene Name: spermatogenesis associated 32
  Uniprot ID: Q96LK8
  ENSP ID: ENSP00000331532
MGVTGAHGFPCCGKGSVEVAEMRDDLSQHQIQEEQELEADMLEQKPQLQVDLDLDPDPDPDPELEIGQVPALLESELYPALKLEAELDTEANSNEESDFEEPMQLVCKIESVHSNMGLPTPQTFRPWSLNSNCRSFTEENHVSACHHSISAQTSKHLFWANKLIQASEHSLQRAINMQLNNGSAGQPIRSPLREAIPTNALCSEEQLQIPDAHSAPPTTSSQAPSPLLSSDLPPPIDLTELITFASSLAMASSSRMDLPSLEHMMKAPPQEALEPSTEPLLTTVEEREPENHAETLPEKPREARAPLKSWSQEDKNFAQSYFDFSKPGIKRATIKGQIQLLQPPATSPLLQGSKEDSVPPGKEKENPLLVKIHFKLSAPTIPEK

SEQ ID NO: 83229 - protein, 40 aa, Homo sapiens
  Payload ID: 16565
  Gene Symbol: SPATA32
  Gene Name: spermatogenesis associated 32
  ENSP ID: ENSP00000467344
MGVTGMSRTLPEEGFPGIRNSICKGTGCRKACGTLGVASA

SEQ ID NO: 83230 - protein, 37 aa, Homo sapiens
  Payload ID: 16565
  Gene Symbol: SPATA32
  Gene Name: spermatogenesis associated 32
  ENSP ID: ENSP00000467901
MGVTGAHGFPCCGKGSVEVAEMRDDLSQHQIQEEQEL

SEQ ID NO: 83231 - protein, 139 aa, Homo sapiens
  Payload ID: 16566
  Gene Symbol: SPATA33
  Gene Name: spermatogenesis associated 33
  Uniprot ID: Q96N06
  ENSP ID: ENSP00000301031
MVTHAAGARTFCEEQKKGSTYSVPKSKEKLMEKHSQEARQADRESEKPVDSLHPGAGTAKHPPPAASLEEKPDVKQKSSRKKVVVPQIIITRASNETLVSCSSSGSDQQRTIREPEDWGPYRRHRNPSTADAYNSHLKE

SEQ ID NO: 83232 - protein, 68 aa, Homo sapiens
  Payload ID: 16566
  Gene Symbol: SPATA33
  Gene Name: spermatogenesis associated 33
  ENSP ID: ENSP00000455761
TFCESLPAPRPRRCGDPGLRRRGRWAHPWAFPKAKRNPGKVKEAQALGSPRLRPWARAQGGAGLGGAV

SEQ ID NO: 83233 - protein, 48 aa, Homo sapiens
  Payload ID: 16566
  Gene Symbol: SPATA33
  Gene Name: spermatogenesis associated 33
  ENSP ID: ENSP00000456696
  MOD_RES (1)..(1): Any amino acid
XRRCGDPGLRRRGRWAHPWAFPKAKRNPGKVRSKRRDPPIQFQNLRRS

SEQ ID NO: 83234 - protein, 146 aa, Homo sapiens
  Payload ID: 16566
  Gene Symbol: SPATA33
  Gene Name: spermatogenesis associated 33
  ENSP ID: ENSP00000461933
TPLARGPFVSRSRLRGRGGEEQKKGSTYSVPKSKEKLMEKHSQEARQADRESEKPVDSLHPGAGTAKHPPPAASLEEKPDVKQKSSRKKVVVPQIIITRASNETLVSCSSSGSDQQRTIREPEDWGPYRRHRNPSTADAYNSHLKE

SEQ ID NO: 83235 - protein, 27 aa, Homo sapiens
  Payload ID: 16566
  Gene Symbol: SPATA33
  Gene Name: spermatogenesis associated 33
  ENSP ID: ENSP00000462233
  MOD_RES (1)..(1): Any amino acid
XGTRACVGGGGGLTHGPFQKQRETQER

SEQ ID NO: 83236 - protein, 42 aa, Homo sapiens
  Payload ID: 16566
  Gene Symbol: SPATA33
  Gene Name: spermatogenesis associated 33
  ENSP ID: ENSP00000462319
MEKHSQEARQADRESEKPVDSLHPGAGTAKHPPPAASLEVTG

SEQ ID NO: 83237 - protein, 38 aa, Homo sapiens
  Payload ID: 16566
  Gene Symbol: SPATA33
  Gene Name: spermatogenesis associated 33
  ENSP ID: ENSP00000462403
  MOD_RES (1)..(1): Any amino acid
XSRSRLRGRGGVGTRACVGGGGGLTHGPFQKQRETQER

SEQ ID NO: 83238 - protein, 140 aa, Homo sapiens
  Payload ID: 16566
  Gene Symbol: SPATA33
  Gene Name: spermatogenesis associated 33
  Uniprot ID: Q96N06
  ENSP ID: ENSP00000462996
MGLSKSKEKPRKGEEQKKGSTYSVPKSKEKLMEKHSQEARQADRESEKPVDSLHPGAGTAKHPPPAASLEEKPDVKQKSSRKKVVVPQIIITRASNETLVSCSSSGSDQQRTIREPEDWGPYRRHRNPSTADAYNSHLKE

SEQ ID NO: 83239 - protein, 109 aa, Homo sapiens
  Payload ID: 16566
  Gene Symbol: SPATA33
  Gene Name: spermatogenesis associated 33
  ENSP ID: ENSP00000481797
MEKHSQEARQADRESEKPVDSLHPGAGTAKHPPPAASLEEKPDVKQKSSRKKVVVPQIIITRASNETLVSCSSSGSDQQRTIREPEDWGPYRRHRNPSTADAYNSHLKE

SEQ ID NO: 83240 - protein, 305 aa, Homo sapiens
  Payload ID: 16567
  Gene Symbol: SPATA4
  Gene Name: spermatogenesis associated 4
  Uniprot ID: Q8NEY3
  ENSP ID: ENSP00000280191
MAAAGQEKGYLTQTAAALDKSPSLSPQLAAPIRGRPKKCLVYPHAPKSSRLSRSVLRWLQGLDLSFFPRNINRDFSNGFLIAEIFCIYYPWELELSSFENGTSLKVKLDNWAQLEKFLARKKFKLPKELIHGTIHCKAGVPEILIEEVYTLLTHREIKSIQDDFVNFTDYSYQMRLPLVSRSTVSKSIKDNIRLSELLSNPNMLTNELKAEFLILLHMLQRKLGRKLNPEWFDVKPTVGEVTLNHLPAQASGRRYNLKVKRGRVVPVLPNIGSGGSSHREIHVKQAGQHSYYSAMKPIRNMDKKP

SEQ ID NO: 83241 - protein, 132 aa, Homo sapiens
  Payload ID: 16567
  Gene Symbol: SPATA4
  Gene Name: spermatogenesis associated 4
  ENSP ID: ENSP00000422290
MRLPLVSRSTVSKSIKDNIRLSELLSNPNMLTNELKAEFLILLHMLQRKLGRKLNPEWFDVKPTVGEVTLNHLPAQASGRRYNLKVKRGRVVPVLPNIGSGGSSHREIHVKQAGQHSYYSAMKPIRNMDKKP

SEQ ID NO: 83242 - protein, 76 aa, Homo sapiens
  Payload ID: 16567
  Gene Symbol: SPATA4
  Gene Name: spermatogenesis associated 4
  ENSP ID: ENSP00000425950
KGYLTQTAAALDKSPSLSPQLAAPIRGRPKKCLVYPHAPKSSRLSRSVLRWLQGLDLSFFPRNINRNILYILPLGT

SEQ ID NO: 83243 - protein, 98 aa, Homo sapiens
  Payload ID: 16568
  Gene Symbol: SPATA45
  Gene Name: spermatogenesis associated 45
  Uniprot ID: Q537H7
  ENSP ID: ENSP00000419160
MASINRTIEIMKKHGVSKQHLLEEINKKRESNCLVERSNQVSLLRVQKRHFPDAYQSFTDTTTKEPVPNSGRSSWIKLSLLAHMERKHFPPKNNAIFG

SEQ ID NO: 83244 - protein, 893 aa, Homo sapiens
  Payload ID: 16569
  Gene Symbol: SPATA5
  Gene Name: spermatogenesis associated 5
  Uniprot ID: Q8NB90
  ENSP ID: ENSP00000274008
MSSKKNRKRLNQSAENGSSLPSAASSCAEARAPSAGSDFAATSGTLTVTNLLEKVDDKIPKTFQNSLIHLGLNTMKSANICIGRPVLLTSLNGKQEVYTAWPMAGFPGGKVGLSEMAQKNVGVRPGDAIQVQPLVGAVLQAEEMDVALSDKDMEINEEELTGCILRKLDGKIVLPGNFLYCTFYGRPYKLQVLRVKGADGMILGGPQSDSDTDAQRMAFEQSSMETSSLELSLQLSQLDLEDTQIPTSRSTPYKPIDDRITNKASDVLLDVTQSPGDGSGLMLEEVTGLKCNFESAREGNEQLTEEERLLKFSIGAKCNTDTFYFISSTTRVNFTEIDKNSKEQDNQFKVTYDMIGGLSSQLKAIREIIELPLKQPELFKSYGIPAPRGVLLYGPPGTGKTMIARAVANEVGAYVSVINGPEIISKFYGETEAKLRQIFAEATLRHPSIIFIDELDALCPKREGAQNEVEKRVVASLLTLMDGIGSEVSEGQVLVLGATNRPHALDAALRRPGRFDKEIEIGVPNAQDRLDILQKLLRRVPHLLTEAELLQLANSAHGYVGADLKVLCNEAGLCALRRILKKQPNLPDVKVAGLVKITLKDFLQAMNDIRPSAMREIAIDVPNVSWSDIGGLESIKLKLEQAVEWPLKHPESFIRMGIQPPKGVLLYGPPGCSKTMIAKALANESGLNFLAIKGPELMNKYVGESERAVRETFRKARAVAPSIIFFDELDALAVERGSSLGAGNVADRVLAQLLTEMDGIEQLKDVTILAATNRPDRIDKALMRPGRIDRIIYVPLPDAATRREIFKLQFHSMPVSNEVDLDELILQTDAYSGAEIVAVCREAALLALEEDIQANLIMKRHFTQALSTVTPRIPESLRRFYEDYQEKSGLHTL

SEQ ID NO: 83245 - protein, 753 aa, Homo sapiens
  Payload ID: 16570
  Gene Symbol: SPATA5L1
  Gene Name: spermatogenesis associated 5-like 1
  Uniprot ID: Q9BVQ7
  ENSP ID: ENSP00000305494
MAPDSDPFPEGPLLKLLPLDARDRGTQRCRLGPAALHALGARLGSAVKISLPDGGSCLCTAWPRRDGADGFVQLDPLCASPGAAVGASRSRRSLSLNRLLLVPCPPLRRVAVWPVLRERAGAPGARNTAAVLEAAQELLRNRPISLGHVVVAPPGAPGLVAALHIVGGTPSPDPAGLVTPRTRVSLGGEPPSEAQPQPEVPLGGLSEAADSLRELLRLPLRYPRALTALGLAVPRGVLLAGPPGVGKTQLVRAVAREAGAELLAVSAPALQGSRPGETEENVRRVFQRARELASRGPSLLFLDEMDALCPQRGSRAPESRVVAQVLTLLDGASGDREVVVVGATNRPDALDPALRRPGRFDREVVIGTPTLKQRKEILQVITSKMPISSHVDLGLLAEMTVGYVGADLTALCREAAMHALLHSEKNQDNPVIDEIDFLEAFKNIQPSSFRSVIGLMDIKPVDWEEIGGLEDVKLKLKQSIEWPLKFPWEFVRMGLTQPKGVLLYGPPGCAKTTLVRALATSCHCSFVSVSGADLFSPFVGDSEKVLSQIFRQARASTPAILFLDEIDSILGARSASKTGCDVQERVLSVLLNELDGVGLKTIERRGSKSSQQEFQEVFNRSVMIIAATNRPDVLDTALLRPGRLDKIIYIPPPDHKGRLSILKVCTKTMPIGPDVSLENLAAETCFFSGADLRNLCTEAALLALQENGLDATTVKQEHFLKSLKTVKPSLSCKDLALYENLFKKEGFSNVEGI

SEQ ID NO: 83246 - protein, 258 aa, Homo sapiens
  Payload ID: 16570
  Gene Symbol: SPATA5L1
  Gene Name: spermatogenesis associated 5-like 1
  ENSP ID: ENSP00000431242
  MOD_RES (1)..(1): Any amino acid
XQDNPVIDEIDFLEAFKNIQPSSFRSVIGLMDIKPVDWEEIGGLEDVKLKLKQIFRQARASTPAILFLDEIDSILGARSASKTGCDVQERVLSVLLNELDGVGLKTIERRGSKSSQQEFQEVFNRSVMIIAATNRPDVLDTALLRPGRLDKIIYIPPPDHKGRLSILKVCTKTMPIGPDVSLENLAAETCFFSGADLRNLCTEAALLALQENGLDATTVKQEHFLKSLKTVKPSLSCKDLALYENLFKKEGFSNVEGI

SEQ ID NO: 83247 - protein, 620 aa, Homo sapiens
  Payload ID: 16570
  Gene Symbol: SPATA5L1
  Gene Name: spermatogenesis associated 5-like 1
  Uniprot ID: Q9BVQ7
  ENSP ID: ENSP00000436823
MAPDSDPFPEGPLLKLLPLDARDRGTQRCRLGPAALHALGARLGSAVKISLPDGGSCLCTAWPRRDGADGFVQLDPLCASPGAAVGASRSRRSLSLNRLLLVPCPPLRRVAVWPVLRERAGAPGARNTAAVLEAAQELLRNRPISLGHVVVAPPGAPGLVAALHIVGGTPSPDPAGLVTPRTRVSLGGEPPSEAQPQPEVPLGGLSEAADSLRELLRLPLRYPRALTALGLAVPRGVLLAGPPGVGKTQLVRAVAREAGAELLAVSAPALQGSRPGETEENVRRVFQRARELASRGPSLLFLDEMDALCPQRGSRAPESRVVAQVLTLLDGASGDREVVVVGATNRPDALDPALRRPGRFDREVVIGTPTLKQRKEILQVITSKMPISSHVDLGLLAEMTVGYVGADLTALCREAAMHALLHSEKNQDNPVIDEIDFLEAFKNIQPSSFRSVIGLMDIKPVDWEEIGGLEDVKLKLKQSIEWPLKFPWEFVRMGLTQPKGVLLYGPPGCAKTTLVRALATSCHCSFVSVSGADLFSPFVGDSEKVLSQIFRQARASTPAILFLDEIDSILGARSASKTGCDVQERVLSVLLNELDGVGLKTIERRGSKSSQQGKYKELKK

SEQ ID NO: 83248 - protein, 19 aa, Homo sapiens
  Payload ID: 16570
  Gene Symbol: SPATA5L1
  Gene Name: spermatogenesis associated 5-like 1
  ENSP ID: ENSP00000453091
  MOD_RES (1)..(1): Any amino acid
XLCREAAMHALLHSEKFQV

SEQ ID NO: 83249 - protein, 249 aa, Homo sapiens
  Payload ID: 16571
  Gene Symbol: SPATA6
  Gene Name: spermatogenesis associated 6
  ENSP ID: ENSP00000360907
MQLDKFIYHLAPVEKSHGRLQNRTSRSQKKKSKSPERSKYCINAKNYEQPTISSKSHSPSPYTKRRMCELSEDTRRRLAHLNLGPYEFKKETDKPPFVIRHVDPPSPRADTLLGSSGRDCERDGWSRVHNDHSHLGCCRPKDYKVIRTPHGRDFDDSLEKCEEYLSPRSCSKPRHSARTLLVHSAPSTMPKHSPSPVLNRASLRERFHSDWCSPSNCDEIHDRDERDLEKDDELELKRSLLCRDSAYDS

SEQ ID NO: 83250 - protein, 472 aa, Homo sapiens
  Payload ID: 16571
  Gene Symbol: SPATA6
  Gene Name: spermatogenesis associated 6
  Uniprot ID: Q9NWH7
  ENSP ID: ENSP00000360909
MPKVKALQCALALEISSVTCPGVVLKDKEDIYLSICVFGQYKKTQCVPATFPLVFNARMVFEKVFPDAVDPGDVVTQLEYDTAVFELIQLVPPVGETLSTYDENTRDFMFPGPNQMSGHHDSNRQVTMRRISGLRGNAPRLEFSTTSVITECLISSRKCHTQDKFIYHLAPVEKSHGRLQNRTSRSQKKKSKSPERSKYCINAKNYEQPTISSKSHSPSPYTKRRMCELSEDTRRRLAHLNLGPYEFKKETDKPPFVIRHVDPPSPRADTLLGSSGRDCERDGWSRVHNDHSHLGCCRPKDYKVIRTPHGRDFDDSLEKCEEYLSPRSCSKPRHSARTLLVHSAPSTMPKHSPSPVLNRASLRERFHSDWCSPSNCDEIHDRDERDLEKDDELELKRSLLCRDSAYDSDPEYSSCQQPRGTFHLDDGEYWSNRAASYKGKSHRPIFENSMDKMYRNLYKKACSSASHTQESF

SEQ ID NO: 83251 - protein, 488 aa, Homo sapiens
  Payload ID: 16571
  Gene Symbol: SPATA6
  Gene Name: spermatogenesis associated 6
  Uniprot ID: Q9NWH7
  ENSP ID: ENSP00000360913
MPKVKALQCALALEISSVTCPGVVLKDKEDIYLSICVFGQYKKTQCVPATFPLVFNARMVFEKVFPDAVDPGDVVTQLEYDTAVFELIQLVPPVGETLSTYDENTRDFMFPGPNQMSGHHDSNRQVTMRRISGLRGNAPRLEFSTTSVITECLISSRKCHTQDKFIYHLAPVEKSHGRLQNRTSRSQKKKSKSPERSKYCINAKNYEQPTISSKSHSPSPYTKRRMCELSEDTRRRLAHLNLGPYEFKKETDKPPFVIRHVDPPSPRADTLLGSSGRDCERDGWSRVHNDHSHLGCCRPKDYKVIRTPHGRDFDDSLEKCEEYLSPRSCSKPRHSARTLLVHSAPSTMPKHSPSPVLNRASLRERFHSDWCSPSNCDEIHDRVKNVLKSHQAHQRHLYDERDLEKDDELELKRSLLCRDSAYDSDPEYSSCQQPRGTFHLDDGEYWSNRAASYKGKSHRPIFENSMDKMYRNLYKKACSSASHTQESF

SEQ ID NO: 83252 - protein, 474 aa, Homo sapiens
  Payload ID: 16571
  Gene Symbol: SPATA6
  Gene Name: spermatogenesis associated 6
  ENSP ID: ENSP00000379502
MPKVKALQCALALEISSVTCPGVVLKDKEDIYLSICVFGQYKKTQCVPATFPLVFNARMVFEKVFPDAVDPGDVVTQLELGETLSTYDENTRDFMFPGPNQMSGHHDSNRQVTMRRISGLRGNAPRLEFSTTSVITECLISSRKCHTQDKFIYHLAPVEKSHGRLQNRTSRSQKKKSKSPERSKYCINAKNYEQPTISSKSHSPSPYTKRRMCELSEDTRRRLAHLNLGPYEFKKETDKPPFVIRHVDPPSPRADTLLGSSGRDCERDGWSRVHNDHSHLGCCRPKDYKVIRTPHGRDFDDSLEKCEEYLSPRSCSKPRHSARTLLVHSAPSTMPKHSPSPVLNRASLRERFHSDWCSPSNCDEIHDRVKNVLKSHQAHQRHLYDERDLEKDDELELKRSLLCRDSAYDSDPEYSSCQQPRGTFHLDDGEYWSNRAASYKGKSHRPIFENSMDKMYRNLYKKACSSASHTQESF

SEQ ID NO: 83253 - protein, 86 aa, Homo sapiens
  Payload ID: 16571
  Gene Symbol: SPATA6
  Gene Name: spermatogenesis associated 6
  ENSP ID: ENSP00000474642
MPKVKALQCALALEISSVTCPGVVLKDKEDIYLSICVFGQYKKTQCVPATFPLVFNARMVFEKVFPDAVDPGDVVTQLEWYLSCSG

SEQ ID NO: 83254 - protein, 164 aa, Homo sapiens
  Payload ID: 16571
  Gene Symbol: SPATA6
  Gene Name: spermatogenesis associated 6
  ENSP ID: ENSP00000474844
MNYRRRKDGDKFIYHLAPVEKSHGRLQNRTSRSQKKKSKSPERSKYCINAKNYEQPTISSKSHSPSPYTKRRMCELSEDTRRRLAHLNLGPYEFKKETDKPPFVIRHVDPPSPRADTLLGSSGRDCERDGWSRVHNEYNRSDVLLSVHHTRRSFSSWLLPTQGL

SEQ ID NO: 83255 - protein, 291 aa, Homo sapiens
  Payload ID: 16572
  Gene Symbol: SPATA6L
  Gene Name: spermatogenesis associated 6-like
  ENSP ID: ENSP00000371314
MPLEVVVELQIRAISCPGVFLPGKQDVYLGVYLMNQYLETNSFPSAFPIMIQESMRFEKVFESAVDPGAVVDLLESFLARFELIQLVPPVWDELAYYEENTRDFLFPEPKLTPSHPRRCREVLMKTALGFPGIAPKIEFSTRTAIRECVFLHRNRFLEERHESRRPLSTSHEPIFPLNTIKMKLKENNLNRLPKGMQARAPSQYSTRHFFQDQPAQLNLGNNFKISGGSKPPFVVRHVDSAKPFGENISEHHLRRSRRKSKFSDFPFPTRRGSILVLSPHGRISMRGYAVF

SEQ ID NO: 83256 - protein, 165 aa, Homo sapiens
  Payload ID: 16572
  Gene Symbol: SPATA6L
  Gene Name: spermatogenesis associated 6-like
  Uniprot ID: Q8N4H0
  ENSP ID: ENSP00000384342
MPLEVVVELQIRAISCPGVFLPGKQDVYLGVYLMNQYLETNSFPSAFPIMIQESMRFEKVFESAVDPGAVVDLLESFLARFELIQLVPPVWDELAYYEENTRDFLFPEPKLTPSHPRRCREVLMKTALGFPGIAPKIEFSTRTAIRECVFLHRNRFLVDSKSWLL

SEQ ID NO: 83257 - protein, 334 aa, Homo sapiens
  Payload ID: 16572
  Gene Symbol: SPATA6L
  Gene Name: spermatogenesis associated 6-like
  Uniprot ID: Q8N4H0
  ENSP ID: ENSP00000417063
MPLEVVVELQIRAISCPGVFLPGKQDVYLGVYLMNQYLETNSFPSAFPIMIQESMRFEKGIAPKIEFSTRTAIRECVFLHRNRFLEERHESRRPLSTSHEPIFPLNTIKMKLKENNLNRLPKGMQARAPSQYSTRHFFQDQPAQLNLGNNFKISGGSKPPFVVRHVDSAKPFGENISEHHLRRSRRKSKFSDFPFPTRRASSLDSLAANVKVIKEPDERIVLRSDSSSCLDSSQFGKSSSSKQGDADFHGKASFATYQHSTSPGPLDQPLLRERFHPGSQSTWKNIHERVCSLLTSHRAQLHQNKEDSTSEVNYIIERPSYPLKKYSLHEQRYF

SEQ ID NO: 83258 - protein, 165 aa, Homo sapiens; identical to SEQ ID NO: 83256
  Payload ID: 16572
  Gene Symbol: SPATA6L
  Gene Name: spermatogenesis associated 6-like
  Uniprot ID: Q8N4H0
  ENSP ID: ENSP00000417965

SEQ ID NO: 83259 - protein, 392 aa, Homo sapiens
  Payload ID: 16572
  Gene Symbol: SPATA6L
  Gene Name: spermatogenesis associated 6-like
  Uniprot ID: Q8N4H0
  ENSP ID: ENSP00000418458
MPLEVVVELQIRAISCPGVFLPGKQDVYLGVYLMNQYLETNSFPSAFPIMIQESMRFEKVFESAVDPGAVVDLLEMWDELAYYEENTRDFLFPEPKLTPSHPRRCREVLMKTALGFPGIAPKIEFSTRTAIRECVFLHRNRFLEERHESRRPLSTSHEPIFPLNTIKMKLKENNLNRLPKGMQARAPSQYSTRHFFQDQPAQLNLGNNFKISGGSKPPFVVRHVDSAKPFGENISEHHLRRSRRKSKFSDFPFPTRRASSLDSLAANVKVIKEPDERIVLRSDSSSCLDSSQFGKSSSSKQGDADFHGKASFATYQHSTSPGPLDQPLLRERFHPGSQSTWKNIHERVCSLLTSHRAQLHQNKEDSTSEVNYIIERPSYPLKKYSLHEQRYF

SEQ ID NO: 83260 - protein, 190 aa, Homo sapiens
  Payload ID: 16572
  Gene Symbol: SPATA6L
  Gene Name: spermatogenesis associated 6-like
  ENSP ID: ENSP00000420003
MPLEVVVELQIRAISCPGVFLPGKQDVYLGVYLMNQYLETNSFPSAFPIMIQESMRFEKVFESAVDPGAVVDLLEMWDELAYYEENTRDFLFPEPKLTPSHPRRCREVLMKTALGFPGIAPKIEFSTRTAIRECVFLHRNRFLGWGNKGKMLVQQEHRSLKKKLNRNGTQTSGEGLLSWMLLQEFEGRKT

SEQ ID NO: 83261 - protein, 458 aa, Homo sapiens
  Payload ID: 16573
  Gene Symbol: SPATA7
  Gene Name: spermatogenesis associated 7
  Uniprot ID: Q9P0W8
  ENSP ID: ENSP00000045347
MDGSRRVRATSVLPRYGPPCLFKGHLSTKSNAFCTDSSSLRLSTLQLVKNHMAVHYNKILSAKAAVDCSVPVSVSTSIKYADQQRREKLKKELAQCEKEFKLTKTAMRANYKNNSKSLFNTLQKPSGEPQIEDDMLKEEMNGFSSFARSLVPSSERLHLSLHKSSKVITNGPEKNSSSSPSSVDYAASGPRKLSSGALYGRRPRSTFPNSHRFQLVISKAPSGDLLDKHSELFSNKQLPFTPRTLKTEAKSFLSQYRYYTPAKRKKDFTDQRIEAETQTELSFKSELGTAETKNMTDSEMNIKQASNCVTYDAKEKIAPLPLEGHDSTWDEIKDDALQHSSPRAMCQYSLKPPSTRKIYSDEEELLYLSFIEDVTDEILKLGLFSNRFLERLFERHIKQNKHLEEEKMRHLLHVLKVDLGCTSEENSFSSVKGDNNHDMELSTLKIMEMSIEDCPLDV

SEQ ID NO: 83262 - protein, 567 aa, Homo sapiens
  Payload ID: 16573
  Gene Symbol: SPATA7
  Gene Name: spermatogenesis associated 7
  Uniprot ID: Q9P0W8
  ENSP ID: ENSP00000348991
MDGSRRVRATSVLPRYGPPCLFKGHLSTKSNAAVDCSVPVSVSTSIKYADQQRREKLKKELAQCEKEFKLTKTAMRANYKNNSKSLFNTLQKPSGEPQIEDDMLKEEMNGFSSFARSLVPSSERLHLSLHKSSKVITNGPEKNSSSSPSSVDYAASGPRKLSSGALYGRRPRSTFPNSHRFQLVISKAPSGDLLDKHSELFSNKQLPFTPRTLKTEAKSFLSQYRYYTPAKRKKDFTDQRIEAETQTELSFKSELGTAETKNMTDSEMNIKQASNCVTYDAKEKIAPLPLEGHDSTWDEIKDDALQHSSPRAMCQYSLKPPSTRKIYSDEEELLYLSFIEDVTDEILKLGLFSNRFLERLFERHIKQNKHLEEEKMRHLLHVLKVDLGCTSEENSVKQNDVDMLNVFDFEKAGNSEPNELKNESEVTIQQERQQYQKALDMLLSAPKDENEIFPSPTEFFMPIYKSKHSEGVIIQQVNDETNLETSTLDENHPSISDSLTDRETSVNVIEGDSDPEKVEISNGLCGLNTSPSQSVQFSSVKGDNNHDMELSTLKIMEMSIEDCPLDV

SEQ ID NO: 83263 - protein, 599 aa, Homo sapiens
  Payload ID: 16573
  Gene Symbol: SPATA7
  Gene Name: spermatogenesis associated 7
  Uniprot ID: Q9P0W8
  ENSP ID: ENSP00000377176
MDGSRRVRATSVLPRYGPPCLFKGHLSTKSNAFCTDSSSLRLSTLQLVKNHMAVHYNKILSAKAAVDCSVPVSVSTSIKYADQQRREKLKKELAQCEKEFKLTKTAMRANYKNNSKSLFNTLQKPSGEPQIEDDMLKEEMNGFSSFARSLVPSSERLHLSLHKSSKVITNGPEKNSSSSPSSVDYAASGPRKLSSGALYGRRPRSTFPNSHRFQLVISKAPSGDLLDKHSELFSNKQLPFTPRTLKTEAKSFLSQYRYYTPAKRKKDFTDQRIEAETQTELSFKSELGTAETKNMTDSEMNIKQASNCVTYDAKEKIAPLPLEGHDSTWDEIKDDALQHSSPRAMCQYSLKPPSTRKIYSDEEELLYLSFIEDVTDEILKLGLFSNRFLERLFERHIKQNKHLEEEKMRHLLHVLKVDLGCTSEENSVKQNDVDMLNVFDFEKAGNSEPNELKNESEVTIQQERQQYQKALDMLLSAPKDENEIFPSPTEFFMPIYKSKHSEGVIIQQVNDETNLETSTLDENHPSISDSLTDRETSVNVIEGDSDPEKVEISNGLCGLNTSPSQSVQFSSVKGDNNHDMELSTLKIMEMSIEDCPLDV

SEQ ID NO: 83264 - protein, 85 aa, Homo sapiens
  Payload ID: 16573
  Gene Symbol: SPATA7
  Gene Name: spermatogenesis associated 7
  ENSP ID: ENSP00000450515
MDGSRRVRATSVLPRYGPPCLFKGHLSTKSNAFCTDSSSLRLSTLQLVKNHMAVHYNKILSAKAAVDCSVPVSVSTSIKCLEVLV

SEQ ID NO: 83265 - protein, 228 aa, Homo sapiens
  Payload ID: 16573
  Gene Symbol: SPATA7
  Gene Name: spermatogenesis associated 7
  ENSP ID: ENSP00000450606
MDGSRRVRATSVLPRYGPPCLFKGHLSTKSNAAVDCSVPVSVSTSIKCIHVPWWFAAPINLSSTLDADQQRREKLKKELAQCEKEFKLTKTAMRANYKNNSKSLFNTLQKPSGEPQIEDDMLKEEMNGFSSFARSLVPSSERLHLSLHKSSKVITNGPEKNSSSSPSSVDYAASGPRKLSSGALYGRRPRSTFPNSHRFQLVISKAPSGDLLDKHSELFSNKQLPFTP

SEQ ID NO: 83266 - protein, 46 aa, Homo sapiens
  Payload ID: 16573
  Gene Symbol: SPATA7
  Gene Name: spermatogenesis associated 7
  ENSP ID: ENSP00000450654
MDGSRRGKGQLSGATAASPLAPGGAPSLGSGQLSARPPLGALPTPG

SEQ ID NO: 83267 - protein, 91 aa, Homo sapiens
  Payload ID: 16573
  Gene Symbol: SPATA7
  Gene Name: spermatogenesis associated 7
  ENSP ID: ENSP00000450809
  MOD_RES (1)..(1): Any amino acid
XAMCQYSLKPPSTRKIYSDEEELLYLSFIEDVTDEILKLGLFSNRFLERLFERHIKQNKHLEEEKMRHLLHVLKVDLGCTSEENSVRIPDD

SEQ ID NO: 83268 - protein, 81 aa, Homo sapiens
  Payload ID: 16573
  Gene Symbol: SPATA7
  Gene Name: spermatogenesis associated 7
  ENSP ID: ENSP00000450882
MDGSRRVRATSVLPRYGPPCLFKGHLSTKSNAFCTDSSSLRLSTLQLVKNHMAVHYNKILSAKAAVDCSVPVSVSTSIKCI

SEQ ID NO: 83269 - protein, 76 aa, Homo sapiens
  Payload ID: 16573
  Gene Symbol: SPATA7
  Gene Name: spermatogenesis associated 7
  ENSP ID: ENSP00000451019
SFIEDVTDEILKLGLFSNRFLERLFERHIKQNKHLEEEKMRHLLHVLKVDLGCTSEENSIPDAATTGPKTTPLEDE

SEQ ID NO: 83270 - protein, 567 aa, Homo sapiens; identical to SEQ ID NO: 83262
  Payload ID: 16573
  Gene Symbol: SPATA7
  Gene Name: spermatogenesis associated 7
  Uniprot ID: Q9P0W8
  ENSP ID: ENSP00000451128

SEQ ID NO: 83271 - protein, 42 aa, Homo sapiens
  Payload ID: 16573
  Gene Symbol: SPATA7
  Gene Name: spermatogenesis associated 7
  ENSP ID: ENSP00000451181
MDGSRRVRATSVLPRYGPPCLFKGHLSTKSNGVLEIREFWSL

SEQ ID NO: 83272 - protein, 46 aa, Homo sapiens; identical to SEQ ID NO: 83266
  Payload ID: 16573
  Gene Symbol: SPATA7
  Gene Name: spermatogenesis associated 7
  ENSP ID: ENSP00000451663

SEQ ID NO: 83273 - protein, 86 aa, Homo sapiens
  Payload ID: 16573
  Gene Symbol: SPATA7
  Gene Name: spermatogenesis associated 7
  ENSP ID: ENSP00000451690
MDGSRRVRATSVLPRYGPPCLFKGHLSTKSNAFCTDSSSLRLSTLQLVKNHMAVHYNKILSAKAAVDCSVPVSMQTNNEERNSKRN

SEQ ID NO: 83274 - protein, 53 aa, Homo sapiens
  Payload ID: 16573
  Gene Symbol: SPATA7
  Gene Name: spermatogenesis associated 7
  ENSP ID: ENSP00000452359
MDGSRRVRATSVLPRYGPPCLFKGHLSTKSNAAVDCSVPVSVSTSIKCLEVLV

SEQ ID NO: 83275 - protein, 46 aa, Homo sapiens; identical to SEQ ID NO: 83266
  Payload ID: 16573
  Gene Symbol: SPATA7
  Gene Name: spermatogenesis associated 7
  ENSP ID: ENSP00000452364

SEQ ID NO: 83276 - protein, 138 aa, Homo sapiens
  Payload ID: 16573
  Gene Symbol: SPATA7
  Gene Name: spermatogenesis associated 7
  ENSP ID: ENSP00000452435
MDGSRRAAVDCSVPVSVSTSIKYADQQRREKLKKELAQCEKEFKLTKTAMRANYKNNSKSLFNTLQKPSGEPQIEDDMLKEEMNGFSSFARSLVPSSERLHLSLHKSSKVITNGPEKNSSSSPSSVDYAASGPRKLSS

SEQ ID NO: 83277 - protein, 49 aa, Homo sapiens
  Payload ID: 16573
  Gene Symbol: SPATA7
  Gene Name: spermatogenesis associated 7
  ENSP ID: ENSP00000452546
MDGSRRVRATSVLPRYGPPCLFKGHLSTKSNAAVDCSVPVSVSTSIKCI

SEQ ID NO: 83278 - protein, 105 aa, Homo sapiens
  Payload ID: 16574
  Gene Symbol: SPATA8
  Gene Name: spermatogenesis associated 8
  Uniprot ID: Q6RVD6
  ENSP ID: ENSP00000328149
MAPAGMSGAQDNSCLYQEIAPSFQRLPCPRTSSRHFSEAMTCPCGWRPFKGGPGGLKGPVWPAKEENSCSHGRIQRVQRRRVPSASPLIQKINRRSVLFHPYCWS

SEQ ID NO: 83279 - protein, 68 aa, Homo sapiens
  Payload ID: 16574
  Gene Symbol: SPATA8
  Gene Name: spermatogenesis associated 8
  ENSP ID: ENSP00000453026
MSLRLEAFQGWPRRPQGPGVACKGREQLFSRKDPKGSKAKGAICFPTDSEDKQEKCPVSPILLVLIFQ

SEQ ID NO: 83280 - protein, 254 aa, Homo sapiens
  Payload ID: 16575
  Gene Symbol: SPATA9
  Gene Name: spermatogenesis associated 9
  Uniprot ID: Q9BWV2
  ENSP ID: ENSP00000274432
MPIKPVGWICGQVLKNFSGRIEGIQKAIMDLVDEFKDEFPTILRLSQSNQKREPAQKTSKIRMAIALAKINRATLIRGLNSISRSSKSVAKLLHPQLACRLLELRDISGRLLREVNAPRQPLYNIQVRKGSLFEIISFPAKTALTSIIYASYAALIYLAVCVNAVLKKVKNIFQEEESIRQNREESENCRKAFSEPVLSEPMFAEGEIKAKPYRSLPEKPDISDYPKLLANKQSNNIQVLHSVFDQSAEMNEQI

SEQ ID NO: 83281 - protein, 254 aa, Homo sapiens; identical to SEQ ID NO: 83280
  Payload ID: 16575
  Gene Symbol: SPATA9
  Gene Name: spermatogenesis associated 9
  Uniprot ID: Q9BWV2
  ENSP ID: ENSP00000325491

SEQ ID NO: 83282 - protein, 135 aa, Homo sapiens
  Payload ID: 16575
  Gene Symbol: SPATA9
  Gene Name: spermatogenesis associated 9
  Uniprot ID: Q9BWV2
  ENSP ID: ENSP00000420883
MPIKPVGWICGQVLKNFSGRIEGIQKAIMDLVDEFKDEFPTILRLSQSNQKREPAQKTSKIRMAIALAKINRATLIRGLNSISRSSKSVAKLLHPQLACRLLELRDISGRLLREVNAPRQPLYNIQEKKMGLQLS

SEQ ID NO: 83283 - protein, 178 aa, Homo sapiens
  Payload ID: 16575
  Gene Symbol: SPATA9
  Gene Name: spermatogenesis associated 9
  Uniprot ID: Q9BWV2
  ENSP ID: ENSP00000427257
MPIKPVGWICGQVLKNFSGRIEGIQKAIMDLVDEFKDEFPTILRLSQSNQVRKGSLFEIISFPAKTALTSIIYASYAALIYLAVCVNAVLKKVKNIFQEEESIRQNREESENCRKAFSEPVLSEPMFAEGEIKAKPYRSLPEKPDISDYPKLLANKQSNNIQVLHSVFDQSAEMNEQI

SEQ ID NO: 83284 - protein, 118 aa, Homo sapiens
  Payload ID: 16576
  Gene Symbol: SPATS1
  Gene Name: spermatogenesis associated, serine-rich 1
  ENSP ID: ENSP00000423654
MSPSMLTGNSPRGCRLPSISSTTCGRQLEKVPEKRDSGMTEVERTYSANCSDFLESKGCFANTTPSGKSVSSSSSVETGPSVSEPPGLPRVSAYVDTTADLDRKLSFSHSDHSSEMSL

SEQ ID NO: 83285 - protein, 300 aa, Homo sapiens
  Payload ID: 16576
  Gene Symbol: SPATS1
  Gene Name: spermatogenesis associated, serine-rich 1
  Uniprot ID: Q496A3
  ENSP ID: ENSP00000424400
MSPSMLTGNSPRGCRLPSISSTTCGRQLEKVPEKRDSGMTEVERTYSANCSDFLESKGCFANTTPSGKSVSSSSSVETGPSVSEPPGLPRVSAYVDTTADLDRKLSFSHSDHSSEMSLPEVQKDKYPEEFSLLKLQTKDGHRPEWTFYPRFSSNIHTYHVGKQCFFNGVFLGNKRSLSERTVDKCFGRKKYDIDPRNGIPKLTPGDNPYMYPEQSKGFHKAGSMLPPVNFSIVPYEKKFDTFIPLEPLPQIPNLPFWVKEKANSLKNEIQEVEELDNWQPAVPLMHMLHLSGALDFPRQS

SEQ ID NO: 83286 - protein, 71 aa, Homo sapiens
  Payload ID: 16576
  Gene Symbol: SPATS1
  Gene Name: spermatogenesis associated, serine-rich 1
  ENSP ID: ENSP00000424823
MSPSMLTGNSPRGCRLPSISSTTCGRQLEKVPEKRDSGMTEVERTYKSTTKAESLINYLTGSHSSGEVYYL

SEQ ID NO: 83287 - protein, 300 aa, Homo sapiens; identical to SEQ ID NO: 83285
  Payload ID: 16576
  Gene Symbol: SPATS1
  Gene Name: spermatogenesis associated, serine-rich 1
  Uniprot ID: Q496A3
  ENSP ID: ENSP00000437552

SEQ ID NO: 83288 - protein, 545 aa, Homo sapiens
  Payload ID: 16577
  Gene Symbol: SPATS2
  Gene Name: spermatogenesis associated, serine-rich 2
  Uniprot ID: Q86XZ4
  ENSP ID: ENSP00000326841
MSRKQNQKDSSGFIFDLQSNTVLAQGGAFENMKEKINAVRAIVPNKSNNEIILVLQHFDNCVDKTVQAFMEGSASEVLKEWTVTGKKKNKKKKNKPKPAAEPSNGIPDSSKSVSIQEEQSAPSSEKGGMNGYHVNGAINDTESVDSLSEGLETLSIDARELEDPESAMLDTLDRTGSMLQNGVSDFETKSLTMHSIHNSQQPRNAAKSLSRPTTETQFSNMGMEDVPLATSKKLSSNIEKSVKDLQRCTVSLARYRVVVKEEMDASIKKMKQAFAELESCLMDREVALLAEMDKVKAEAMEILLSRQKKAELLKKMTHVAVQMSEQQLVELRADIKHFVSERKYDEDLGRVARFTCDVETLKKSIDSFGQVSHPKNSYSTRSRCSSVTSVSLSSPSDASAASSSTCASPPSLTSANKKNFAPGETPAAIANSSGQPYQPLREVLPGNRRGGQGYRPQGQKSNDPMNQGRHDSMGRYRNSSWYSSGSRYQSAPSQAPGNTIERGQTHSAGTNGTGVSMEPSPPTPSFKKGLPQRKPRTSQTEAVNS

SEQ ID NO: 83289 - protein, 36 aa, Homo sapiens
  Payload ID: 16577
  Gene Symbol: SPATS2
  Gene Name: spermatogenesis associated, serine-rich 2
  ENSP ID: ENSP00000446900
MSRKQNQKDSSGFIFDLQSNTVLAQGGAFENMKEKV

SEQ ID NO: 83290 - protein, 8 aa, Homo sapiens
  Payload ID: 16577
  Gene Symbol: SPATS2
  Gene Name: spermatogenesis associated, serine-rich 2
  ENSP ID: ENSP00000447131
MSRKQNQK

SEQ ID NO: 83291 - protein, 66 aa, Homo sapiens
  Payload ID: 16577
  Gene Symbol: SPATS2
  Gene Name: spermatogenesis associated, serine-rich 2
  ENSP ID: ENSP00000447296
MSRKQNQKDSSGFIFDLQSNTVLAQGGAFENMKEKINAVRAIVPNKSNNEIILVLQHFDNCVDKTV

SEQ ID NO: 83292 - protein, 34 aa, Homo sapiens
  Payload ID: 16577
  Gene Symbol: SPATS2
  Gene Name: spermatogenesis associated, serine-rich 2
  ENSP ID: ENSP00000447526
MSRKQNQKDSSGFIFDLQSNTVLAQGGAFENMKE

SEQ ID NO: 83293 - protein, 545 aa, Homo sapiens; identical to SEQ ID NO: 83288
  Payload ID: 16577
  Gene Symbol: SPATS2
  Gene Name: spermatogenesis associated, serine-rich 2
  Uniprot ID: Q86XZ4
  ENSP ID: ENSP00000447947

SEQ ID NO: 83294 - protein, 10 aa, Homo sapiens
  Payload ID: 16577
  Gene Symbol: SPATS2
  Gene Name: spermatogenesis associated, serine-rich 2
  ENSP ID: ENSP00000448174
MSRKQNQKDS

SEQ ID NO: 83295 - protein, 545 aa, Homo sapiens; identical to SEQ ID NO: 83288
  Payload ID: 16577
  Gene Symbol: SPATS2
  Gene Name: spermatogenesis associated, serine-rich 2
  Uniprot ID: Q86XZ4
  ENSP ID: ENSP00000448228

SEQ ID NO: 83296 - protein, 295 aa, Homo sapiens
  Payload ID: 16577
  Gene Symbol: SPATS2
  Gene Name: spermatogenesis associated, serine-rich 2
  ENSP ID: ENSP00000448459
MSRKQNQKDSSGFIFDLQSNTVLAQGGAFENMKEKINAVRAIVPNKSNNEIILVLQHFDNCVDKTVQAFMEGSASEVLKEWTVTGKKKNKKKKNKPKPAAEPSNGIPDSSKSVSIQEEQSAPSSEKGGMNGYHVNGAINDTESVDSLSEGLETLSIDARELEDPESAMLDTLDRTGSMLQNGVSDFETKSLTMHSIHNSQQPRNAAKSLSRPTTETQFSNMGMEDVPLATSKKLSSNIEKSVKDLQRCTVSLARYRVVVKEEMDASIKKMKQAFAELESWYSNAARVLGAKYCQV

SEQ ID NO: 83297 - protein, 74 aa, Homo sapiens
  Payload ID: 16577
  Gene Symbol: SPATS2
  Gene Name: spermatogenesis associated, serine-rich 2
  ENSP ID: ENSP00000448522
MSRKQNQKDSSGFIFDLQSNTVLAQGGAFENMKEKINAVRAIVPNKSNNEIILVLQHFDNCVDKTVQAFMEGSA

SEQ ID NO: 83298 - protein, 67 aa, Homo sapiens
  Payload ID: 16577
  Gene Symbol: SPATS2
  Gene Name: spermatogenesis associated, serine-rich 2
  ENSP ID: ENSP00000448830
MSRKQNQKDSSGFIFDLQSNTVLAQGGAFENMKEKINAVRAIVPNKSNNEIILVLQHFDNCVDKTVQ

SEQ ID NO: 83299 - protein, 98 aa, Homo sapiens
  Payload ID: 16577
  Gene Symbol: SPATS2
  Gene Name: spermatogenesis associated, serine-rich 2
  ENSP ID: ENSP00000449406
MSRKQNQKDSSGFIFDLQSNTVLAQGGAFENMKEKINAVRAIVPNKSNNEIILVLQHFDNCVDKTVQAFMEGSASEVLKEWTVTGKKKNKKKKNKPKP

SEQ ID NO: 83300 - protein, 63 aa, Homo sapiens
  Payload ID: 16577
  Gene Symbol: SPATS2
  Gene Name: spermatogenesis associated, serine-rich 2
  ENSP ID: ENSP00000449431
MSRKQNQKDSSGFIFDLQSNTVLAQGGAFENMKEKAGVQWRDLSSLHTSASRVQVILLPQPPV

SEQ ID NO: 83301 - protein, 8 aa, Homo sapiens
  Payload ID: 16577
  Gene Symbol: SPATS2
  Gene Name: spermatogenesis associated, serine-rich 2
  ENSP ID: ENSP00000449509
MSRKQNQK

SEQ ID NO: 83302 - protein, 75 aa, Homo sapiens
  Payload ID: 16577
  Gene Symbol: SPATS2
  Gene Name: spermatogenesis associated, serine-rich 2
  ENSP ID: ENSP00000449615
MSRKQNQKGRRARVNKEGTGGHECWNRLAASVPAGVNSVWAPWQHPGCGVPVTPEAPEGMLQCSSGSAICGRLKC

SEQ ID NO: 83303 - protein, 5 aa, Homo sapiens
  Payload ID: 16577
  Gene Symbol: SPATS2
  Gene Name: spermatogenesis associated, serine-rich 2
  ENSP ID: ENSP00000449623
MSRKQ

SEQ ID NO: 83304 - protein, 33 aa, Homo sapiens
  Payload ID: 16577
  Gene Symbol: SPATS2
  Gene Name: spermatogenesis associated, serine-rich 2
  ENSP ID: ENSP00000449738
MSRKQNQKDSSGFIFDLQSNTVLAQGGAFENMK

SEQ ID NO: 83305 - protein, 558 aa, Homo sapiens
  Payload ID: 16578
  Gene Symbol: SPATS2L
  Gene Name: spermatogenesis associated, serine-rich 2-like
  Uniprot ID: Q9NUQ6
  ENSP ID: ENSP00000351503
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTEGNRLLQQKLSLDGNPKPIHGTTERSDGLQWSAEQPCNPSKPKAKTSPVKSNTPAAHLEIKPDELAKKRGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 83306 - protein, 489 aa, Homo sapiens
  Payload ID: 16578
  Gene Symbol: SPATS2L
  Gene Name: spermatogenesis associated, serine-rich 2-like
  Uniprot ID: Q9NUQ6
  ENSP ID: ENSP00000353989
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 83307 - protein, 566 aa, Homo sapiens
  Payload ID: 16578
  Gene Symbol: SPATS2L
  Gene Name: spermatogenesis associated, serine-rich 2-like
  Uniprot ID: Q9NUQ6
  ENSP ID: ENSP00000386310
MAYSTRSKMAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTEGNRLLQQKLSLDGNPKPIHGTTERSDGLQWSAEQPCNPSKPKAKTSPVKSNTPAAHLEIKPDELAKKRGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 83308 - protein, 558 aa, Homo sapiens; identical to SEQ ID NO: 83305
  Payload ID: 16578
  Gene Symbol: SPATS2L
  Gene Name: spermatogenesis associated, serine-rich 2-like
  Uniprot ID: Q9NUQ6
  ENSP ID: ENSP00000386336

SEQ ID NO: 83309 - protein, 498 aa, Homo sapiens
  Payload ID: 16578
  Gene Symbol: SPATS2L
  Gene Name: spermatogenesis associated, serine-rich 2-like
  ENSP ID: ENSP00000386391
MTGKKKNNKRKRSKSKQHQGNKDAKDKVERPEAGPLQPQPPQIQNGPMNGCEKDSSSTDSANEKPALIPREKKISILEEPSKALRGVTEGNRLLQQKLSLDGNPKPIHGTTERSDGLQWSAEQPCNPSKPKAKTSPVKSNTPAAHLEIKPDELAKKRGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 83310 - protein, 265 aa, Homo sapiens
  Payload ID: 16578
  Gene Symbol: SPATS2L
  Gene Name: spermatogenesis associated, serine-rich 2-like
  ENSP ID: ENSP00000386600
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKA

SEQ ID NO: 83311 - protein, 558 aa, Homo sapiens; identical to SEQ ID NO: 83305
  Payload ID: 16578
  Gene Symbol: SPATS2L
  Gene Name: spermatogenesis associated, serine-rich 2-like
  Uniprot ID: Q9NUQ6
  ENSP ID: ENSP00000386730

SEQ ID NO: 83312 - protein, 558 aa, Homo sapiens; identical to SEQ ID NO: 83305
  Payload ID: 16578
  Gene Symbol: SPATS2L
  Gene Name: spermatogenesis associated, serine-rich 2-like
  Uniprot ID: Q9NUQ6
  ENSP ID: ENSP00000386931

SEQ ID NO: 83313 - protein, 475 aa, Homo sapiens
  Payload ID: 16578
  Gene Symbol: SPATS2L
  Gene Name: spermatogenesis associated, serine-rich 2-like
  ENSP ID: ENSP00000387333
MLKTRWRGLRQGPQPQPPQIQNGPMNGCEKDSSSTDSANEKPALIPREKKISILEEPSKALRGVTEGNRLLQQKLSLDGNPKPIHGTTERSDGLQWSAEQPCNPSKPKAKTSPVKSNTPAAHLEIKPDELAKKRGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 83314 - protein, 188 aa, Homo sapiens
  Payload ID: 16578
  Gene Symbol: SPATS2L
  Gene Name: spermatogenesis associated, serine-rich 2-like
  ENSP ID: ENSP00000389908
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTEGNRLLQQKLSLDGNPKPIHGTTERSDGLQWSAEQPCNPS

SEQ ID NO: 83315 - protein, 193 aa, Homo sapiens
  Payload ID: 16578
  Gene Symbol: SPATS2L
  Gene Name: spermatogenesis associated, serine-rich 2-like
  ENSP ID: ENSP00000390506
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTGPNIEKSVKDLQRCTVSLTRYRVMIKEEVDSSVKKIKAAFAELHN

SEQ ID NO: 83316 - protein, 558 aa, Homo sapiens; identical to SEQ ID NO: 83305
  Payload ID: 16578
  Gene Symbol: SPATS2L
  Gene Name: spermatogenesis associated, serine-rich 2-like
  Uniprot ID: Q9NUQ6
  ENSP ID: ENSP00000391467

SEQ ID NO: 83317 - protein, 139 aa, Homo sapiens
  Payload ID: 16578
  Gene Symbol: SPATS2L
  Gene Name: spermatogenesis associated, serine-rich 2-like
  ENSP ID: ENSP00000396109
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEE

SEQ ID NO: 83318 - protein, 13 aa, Homo sapiens
  Payload ID: 16578
  Gene Symbol: SPATS2L
  Gene Name: spermatogenesis associated, serine-rich 2-like
  ENSP ID: ENSP00000398198
MAELNTHVNVKEK

SEQ ID NO: 83319 - protein, 154 aa, Homo sapiens
  Payload ID: 16578
  Gene Symbol: SPATS2L
  Gene Name: spermatogenesis associated, serine-rich 2-like
  ENSP ID: ENSP00000402559
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTEGNRLL

SEQ ID NO: 83320 - protein, 23 aa, Homo sapiens
  Payload ID: 16578
  Gene Symbol: SPATS2L
  Gene Name: spermatogenesis associated, serine-rich 2-like
  ENSP ID: ENSP00000405506
MAELNTHVNVKEKIYAVRSVVPN

SEQ ID NO: 83321 - protein, 117 aa, Homo sapiens
  Payload ID: 16578
  Gene Symbol: SPATS2L
  Gene Name: spermatogenesis associated, serine-rich 2-like
  ENSP ID: ENSP00000405751
  MOD_RES (1)..(1): Any amino acid
XPNIEKSVKDLQRCTVSLTRYRVMIKEEVDSSVKKIKAAFAELHNCIIDKEVSLMAEMDKVKEEAKSHPVTQAGVQWHNLCSLQAPPPRFTPFSCLSLLSSWDYRRPPPRPANFLGF

SEQ ID NO: 83322 - protein, 94 aa, Homo sapiens
  Payload ID: 16578
  Gene Symbol: SPATS2L
  Gene Name: spermatogenesis associated, serine-rich 2-like
  ENSP ID: ENSP00000406728
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAG

SEQ ID NO: 83323 - protein, 115 aa, Homo sapiens
  Payload ID: 16578
  Gene Symbol: SPATS2L
  Gene Name: spermatogenesis associated, serine-rich 2-like
  ENSP ID: ENSP00000411294
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDS

SEQ ID NO: 83324 - protein, 173 aa, Homo sapiens
  Payload ID: 16578
  Gene Symbol: SPATS2L
  Gene Name: spermatogenesis associated, serine-rich 2-like
  ENSP ID: ENSP00000413142
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTGPNIEKSVKDLQRCTVSLTRYRVMI

SEQ ID NO: 83325 - protein, 238 aa, Homo sapiens
  Payload ID: 16578
  Gene Symbol: SPATS2L
  Gene Name: spermatogenesis associated, serine-rich 2-like
  ENSP ID: ENSP00000413648
MAGGQTNMIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTGPNIEKSVKDLQRCTVSLTRYRVMIKEEVDSSVKKIKAAFAELHNCIIDKEVSLMAEMDKVKEEAMEILTARQKKAEELKRLTDLASQMAEMQLA

SEQ ID NO: 83326 - protein, 588 aa, Homo sapiens
  Payload ID: 16578
  Gene Symbol: SPATS2L
  Gene Name: spermatogenesis associated, serine-rich 2-like
  Uniprot ID: Q9NUQ6
  ENSP ID: ENSP00000482515
MDPFCHSSSETRLLSGTLLWIPRAYSTRSKMAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTEGNRLLQQKLSLDGNPKPIHGTTERSDGLQWSAEQPCNPSKPKAKTSPVKSNTPAAHLEIKPDELAKKRGPNIEKSVKDLQRCTVSLTRYRVMIKEEVDSSVKKIKAAFAELHNCIIDKEVSLMAEMDKVKEEAMEILTARQKKAEELKRLTDLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 83327 - protein, 430 aa, Homo sapiens
  Payload ID: 16579
  Gene Symbol: SPZ1
  Gene Name: spermatogenic leucine zipper 1
  Uniprot ID: Q9BXG8
  ENSP ID: ENSP00000369611
MASSAKSAEMPTISKTVNPTPDPHQEYLDPRITIALFEIGSHSPSSWGSLPFLKNSSHQVTEQQTAQKFNNLLKEIKDILKNMAGFEEKITEAKELFEETNITEDVSAHKENIRGLDKINEMLSTNLPVSLAPEKEDNEKKQEMILETNITEDVSAHKENIRGLDKINEMLSTNLPVSLAPEKEDNEKKQQMIMENQNSENTAQVFARDLVNRLEEKKVLNETQQSQEKAKNRLNVQEETMKIRNNMEQLLQEAEHWSKQHTELSKLIKSYQKSQKDISETLGNNGVGFQTQPNNEVSAKHELEEQVKKLSHDTYSLQLMAALLENECQILQQRVEILKELHHQKQGTLQEKPIQINYKQDKKNQKPSEAKKVEMYKQNKQAMKGTFWKKDRSCRSLDVCLNKKACNTQFNIHVARKALRGKMRSASSLR

SEQ ID NO: 83328 - protein, 234 aa, Homo sapiens
  Payload ID: 16579
  Gene Symbol: SPZ1
  Gene Name: spermatogenic leucine zipper 1
  ENSP ID: ENSP00000426530
MASSAKSAEMPTISKTVNPTPDPHQEYLDPRITIALFEIGSHSPSSWGSLPFLKNSSHQVTEQQTAQKFNNLLKEIKDILKNMAGFEEKITEAKELFEETNITEDVSAHKENIRGLDKINEMLSTNLPVSLAPEKEDNEKKQEMILETNITEDVSAHKENIRGLDKINEMLSTNLPVSLAPEKEDNEKKQQMIMENQNSENTAQVFARDLVNRLEEKKVLNETQQSQEKAKNRL

SEQ ID NO: 83329 - protein, 302 aa, Homo sapiens
  Payload ID: 16580
  Gene Symbol: SRM
  Gene Name: spermidine synthase
  Uniprot ID: P19623
  ENSP ID: ENSP00000366156
MEPGPDGPAASGPAAIREGWFRETCSLWPGQALSLQVEQLLHHRRSRYQDILVFRSKTYGNVLVLDGVIQCTERDEFSYQEMIANLPLCSHPNPRKVLIIGGGDGGVLREVVKHPSVESVVQCEIDEDVIQVSKKFLPGMAIGYSSSKLTLHVGDGFEFMKQNQDAFDVIITDSSDPMGPAESLFKESYYQLMKTALKEDGVLCCQGECQWLHLDLIKEMRQFCQSLFPVVAYAYCTIPTYPSGQIGFMLCSKNPSTNFQEPVQPLTQQQVAQMQLKYYNSDVHRAAFVLPEFARKALNDVS

SEQ ID NO: 83330 - protein, 93 aa, Homo sapiens
  Payload ID: 16580
  Gene Symbol: SRM
  Gene Name: spermidine synthase
  ENSP ID: ENSP00000465687
MEPGPDGPAASGPAAIREGWFRETCSLWPGQALSLQVEQLLHHRRSRYQDILVFRREPRSPTVTPPAVRPMATCWCWTVSSSARRETSSPTRR

SEQ ID NO: 83331 - protein, 83 aa, Homo sapiens
  Payload ID: 16580
  Gene Symbol: SRM
  Gene Name: spermidine synthase
  ENSP ID: ENSP00000465966
  MOD_RES (1)..(1): Any amino acid
XSGQIGFMLCSKNPSTNFQEPVQPLTQQQVAQMQLKYYNSDVHRAAFVLPEFARKVGGLRGWVVGPRDPERPPDWPHVPPGPE

SEQ ID NO: 83332 - protein, 134 aa, Homo sapiens
  Payload ID: 16580
  Gene Symbol: SRM
  Gene Name: spermidine synthase
  ENSP ID: ENSP00000467669
  MOD_RES (1)..(1): Any amino acid
XDGGVLREVVKHPSVESVVQCEIDEVSAGVEPGLSPGSPSGQLCPEMAAHPRARQDVIQVSKKFLPGMAIGYSSSKLTLHVGDGFEFMKQNQDAFDVIITDSSDPMGPAESLFKESYYQLMKTALKEDGVLCCQ

SEQ ID NO: 83333 - protein, 119 aa, Homo sapiens
  Payload ID: 16580
  Gene Symbol: SRM
  Gene Name: spermidine synthase
  ENSP ID: ENSP00000468760
MGRPSSPRAAWGTFSPPQRTQVPDCHSARSKTYGNVLVLDGVIQCTERDEFSYQEMIANLPLCSHPNPRKVLIIGGGDGGVLREVVKHPSVESVVQCEIDEDVIQVSKKFLPGMAIGYS

SEQ ID NO: 83334 - protein, 508 aa, Homo sapiens
  Payload ID: 16581
  Gene Symbol: SATL1
  Gene Name: spermidine/spermine N1-acetyl transferase-like 1
  Uniprot ID: Q86VE3
  ENSP ID: ENSP00000378804
MSPPGMWQPGVQQPGISQQVPSHPDMSQPGMSQQVPSQPGIRQPDTSQSCKNQTDMSQPDANQSSLSDSNQTGIIQPSPSLLGMNQMDMNQWSASLYEMNQVDMKQPSMSQAGMRQSGTNLPDINQPGMKQPGTWQLGRSQPGMWPQSLSELVLSEASISQPGPPQRAPSQSGPRQSSTSQAGTNQSGISQPVMWQLDMRQSGGSQPSMRQVGTSQSGTSQIGMSQPGTWQTGLSQPVPRQPNKSPPGMWQRGMWQPGMSQQVPSQLGMRQPGTSQSSKNQTGMSHPGRGQPGIWEPGPSQPGLSQQDLNQLVLSQPGLSQPGRSQPSVSQMGMRQTSMDYFQIRHAEAGDCPEILRLIKELAACENMLDAMELTAADLLRDGFGDNPLFYCLIAEVNDQQKPSGKLTVGFAMYYFTYDSWTGKVLYLEDFYVTQAYQGLGIGAEMLKRLSQIAITTQCNCMHFLVVIWNQASINYYTSRGALDLSSEEGWHLFRFNREELLDMAWEE

SEQ ID NO: 83335 - protein, 632 aa, Homo sapiens
  Payload ID: 16581
  Gene Symbol: SATL1
  Gene Name: spermidine/spermine N1-acetyl transferase-like 1
  Uniprot ID: Q86VE3
  ENSP ID: ENSP00000425421
MNQSGTNQSSLSDSNQAGINQPSTNSLGMNQMDMNQGSASLYEMNQVDMKQPSMSQAGMRQSGTNLPDINQPDMKQPDTWQLGRSQPGMLQQELSQLVLSKAGISQPDPSQPGPSQSGPSQSRMRQIGTNQSGMSQPVMQQLDSQSGGSQPSMRQVGTSQLGTSQIGMSQPGTWQTGLSQPVLRQPNMSPPGMWQPGVQQPGISQQVPSHPDMSQPGMSQQVPSQPGIRQPDTSQSCKNQTDMSQPDANQSSLSDSNQTGIIQPSPSLLGMNQMDMNQWSASLYEMNQVDMKQPSMSQAGMRQSGTNLPDINQPGMKQPGTWQLGRSQPGMWPQSLSELVLSEASISQPGPPQRAPSQSGPRQSSTSQAGTNQSGISQPVMWQLDMRQSGGSQPSMRQVGTSQSGTSQIGMSQPGTWQTGLSQPVPRQPNKSPPGMWQRGMWQPGMSQQVPSQLGMRQPGTSQSSKNQTGMSHPGRGQPGIWEPGPSQPGLSQQDLNQLVLSQPGLSQPGRSQPSVSQMGMRQTSMDYFQIRHAEAGDCPEILRLIKELAACENMLDAMELTAADLLRDGFGDNPLFYCLIAEVNDQQKPSGKLTVGFAMYYFTYDSWTGKVLYLEDFYVTQAYQDSHHNSM

SEQ ID NO: 83336 - protein, 150 aa, Homo sapiens
  Payload ID: 16582
  Gene Symbol: SAT1
  Gene Name: spermidine/spermine N1-acetyltransferase 1
  ENSP ID: ENSP00000368553
MAKFVIRPATAADCSDILRLIKELAKYEYMEEQVILTEKGNSTVAGRGTSVRCLSPSPRPLPPLLPLLADLLEDGFGEHPFYHCLVAEVPKEHWTPEGNPSPFPEARETKCYVRSSVGCVEPLTTQAEVTENLDRKNSQQVFKLLRKKKN

SEQ ID NO: 83337 - protein, 120 aa, Homo sapiens
  Payload ID: 16582
  Gene Symbol: SAT1
  Gene Name: spermidine/spermine N1-acetyltransferase 1
  ENSP ID: ENSP00000368555
MAKFVIRPATAADCSDILRLIKELAKYEYMEEQVILTEKDLLEDGFGEHPFYHCLVAEVPKEHWTPEGNPSPFPEARETKCYVRSSVGCVEPLTTQAEVTENLDRKNSQQVFKLLRKKKN

SEQ ID NO: 83338 - protein, 143 aa, Homo sapiens
  Payload ID: 16582
  Gene Symbol: SAT1
  Gene Name: spermidine/spermine N1-acetyltransferase 1
  ENSP ID: ENSP00000368556
MAKFVIRPATAADCSDILRLIKELAKYEYMEEQVILTEKGHSIVGFAMYYFTYDPWIGKLLYLEDFFVMSDYRGFGIGSEILKNLSQVAMRCRCSSMHFLVAEWNEPSINFYKRRGASDLSSEEGWRLFKIDKEYLLKMATEE

SEQ ID NO: 83339 - protein, 171 aa, Homo sapiens
  Payload ID: 16582
  Gene Symbol: SAT1
  Gene Name: spermidine/spermine N1-acetyltransferase 1
  Uniprot ID: P21673
  ENSP ID: ENSP00000368572
MAKFVIRPATAADCSDILRLIKELAKYEYMEEQVILTEKDLLEDGFGEHPFYHCLVAEVPKEHWTPEGHSIVGFAMYYFTYDPWIGKLLYLEDFFVMSDYRGFGIGSEILKNLSQVAMRCRCSSMHFLVAEWNEPSINFYKRRGASDLSSEEGWRLFKIDKEYLLKMATEE

SEQ ID NO: 83340 - protein, 170 aa, Homo sapiens
  Payload ID: 16583
  Gene Symbol: SAT2
  Gene Name: spermidine/spermine N1-acetyltransferase family member 2
  Uniprot ID: Q96F10
  ENSP ID: ENSP00000269298
MASVRIREAKEGDCGDILRLIRELAEFEKLSDQVKISEEALRADGFGDNPFYHCLVAEILPAPGKLLGPCVVGYGIYYFIYSTWKGRTIYLEDIYVMPEYRGQGIGSKIIKKVAEVALDKGCSQFRLAVLDWNQRAMDLYKALGAQDLTEAEGWHFFCFQGEATRKLAGK

SEQ ID NO: 83341 - protein, 136 aa, Homo sapiens
  Payload ID: 16583
  Gene Symbol: SAT2
  Gene Name: spermidine/spermine N1-acetyltransferase family member 2
  ENSP ID: ENSP00000458385
MASVRIREAKEGDCGDILRLIRELAEFEKLSDQVKISEEALRADGFGDNPFYHCLVAEILPAPGKLLGQGIGSKIIKKVAEVALDKGCSQFRLAVLDWNQRAMDLYKALGAQDLTEAEGWHFFCFQGEATRKLAGK

SEQ ID NO: 83342 - protein, 41 aa, Homo sapiens
  Payload ID: 16583
  Gene Symbol: SAT2
  Gene Name: spermidine/spermine N1-acetyltransferase family member 2
  ENSP ID: ENSP00000458818
MASVRIREAKEGDCGDILRLIRVKTAGASRIRKTLGSGEDQ

SEQ ID NO: 83343 - protein, 41 aa, Homo sapiens; identical to SEQ ID NO: 83342
  Payload ID: 16583
  Gene Symbol: SAT2
  Gene Name: spermidine/spermine N1-acetyltransferase family member 2
  ENSP ID: ENSP00000459985

SEQ ID NO: 83344 - protein, 532 aa, Homo sapiens
  Payload ID: 16584
  Gene Symbol: SMOX
  Gene Name: spermine oxidase
  Uniprot ID: Q9NWM0
  ENSP ID: ENSP00000278795
MQSCESSGDSADDPLSRGLRRRGQPRVVVIGAGLAGLAAAKALLEQGFTDVTVLEASSHIGGRVQSVKLGHATFELGATWIHGSHGNPIYHLAEANGLLEETTDGERSVGRISLYSKNGVACYLTNHGRRIPKDVVEEFSDLYNEVYNLTQEFFRHDKPVNAESQNSVGVFTREEVRNRIRNDPDDPEATKRLKLAMIQQYLKVESCESSSHSMDEVSLSAFGEWTEIPGAHHIIPSGFMRVVELLAEGIPAHVIQLGKPVRCIHWDQASARPRGPEIEPRGVLKRQYTSFFRPGLPTEKVAAIHRLGIGTTDKIFLEFEEPFWGPECNSLQFVWEDEAESHTLTYPPELWYRKICGFDVLYPPERYGHVLSGWICGEEALVMEKCDDEAVAEICTEMLRQFTGNPNIPKPRRILRSAWGSNPYFRGSYSYTQVGSSGADVEKLAKPLPYTESSKTAHGSSTKQQPGHLFSSKCPEQPLDANRGAVKPMQVLFSGEATHRKYYSTTHGALLSGQREAARLIEMYRDLFQQGT

SEQ ID NO: 83345 - protein, 555 aa, Homo sapiens
  Payload ID: 16584
  Gene Symbol: SMOX
  Gene Name: spermine oxidase
  Uniprot ID: Q9NWM0
  ENSP ID: ENSP00000307252
MQSCESSGDSADDPLSRGLRRRGQPRVVVIGAGLAGLAAAKALLEQGFTDVTVLEASSHIGGRVQSVKLGHATFELGATWIHGSHGNPIYHLAEANGLLEETTDGERSVGRISLYSKNGVACYLTNHGRRIPKDVVEEFSDLYNEVYNLTQEFFRHDKPVNAESQNSVGVFTREEVRNRIRNDPDDPEATKRLKLAMIQQYLKVESCESSSHSMDEVSLSAFGEWTEIPGAHHIIPSGFMRVVELLAEGIPAHVIQLGKPVRCIHWDQASARPRGPEIEPRGEGDHNHDTGEGGQGGEEPRGGRWDEDEQWSVVVECEDCELIPADHVIVTVSLGVLKRQYTSFFRPGLPTEKVAAIHRLGIGTTDKIFLEFEEPFWGPECNSLQFVWEDEAESHTLTYPPELWYRKICGFDVLYPPERYGHVLSGWICGEEALVMEKCDDEAVAEICTEMLRQFTGNPNIPKPRRILRSAWGSNPYFRGSYSYTQVGSSGADVEKLAKPLPYTESSKTAPMQVLFSGEATHRKYYSTTHGALLSGQREAARLIEMYRDLFQQGT

SEQ ID NO: 83346 - protein, 190 aa, Homo sapiens
  Payload ID: 16584
  Gene Symbol: SMOX
  Gene Name: spermine oxidase
  Uniprot ID: Q9NWM0
  ENSP ID: ENSP00000341775
MQSCESSGDSADDPLSRGLRRRGQPRVVVIGAGLAGLAAAKALLEQGFTDVTVLEASSHIGGRVQSVKLGHATFELGATWIHGSHGNPIYHLAEANGLLEETTDGERSVGRISLYSKNGVACYLTNHGRRIPKDVVEEFSDLYNEPMQVLFSGEATHRKYYSTTHGALLSGQREAARLIEMYRDLFQQGT

SEQ ID NO: 83347 - protein, 502 aa, Homo sapiens
  Payload ID: 16584
  Gene Symbol: SMOX
  Gene Name: spermine oxidase
  Uniprot ID: Q9NWM0
  ENSP ID: ENSP00000344595
MQSCESSGDSADDPLSRGLRRRGQPRVVVIGAGLAGLAAAKALLEQGFTDVTVLEASSHIGGRVQSVKLGHATFELGATWIHGSHGNPIYHLAEANGLLEETTDGERSVGRISLYSKNGVACYLTNHGRRIPKDVVEEFSDLYNEVYNLTQEFFRHDKPVNAESQNSVGVFTREEVRNRIRNDPDDPEATKRLKLAMIQQYLKVESCESSSHSMDEVSLSAFGEWTEIPGAHHIIPSGFMRVVELLAEGIPAHVIQLGKPVRCIHWDQASARPRGPEIEPRGVLKRQYTSFFRPGLPTEKVAAIHRLGIGTTDKIFLEFEEPFWGPECNSLQFVWEDEAESHTLTYPPELWYRKICGFDVLYPPERYGHVLSGWICGEEALVMEKCDDEAVAEICTEMLRQFTGNPNIPKPRRILRSAWGSNPYFRGSYSYTQVGSSGADVEKLAKPLPYTESSKTAPMQVLFSGEATHRKYYSTTHGALLSGQREAARLIEMYRDLFQQGT

SEQ ID NO: 83348 - protein, 555 aa, Homo sapiens; identical to SEQ ID NO: 83345
  Payload ID: 16584
  Gene Symbol: SMOX
  Gene Name: spermine oxidase
  Uniprot ID: Q9NWM0
  ENSP ID: ENSP00000368773

SEQ ID NO: 83349 - protein, 442 aa, Homo sapiens
  Payload ID: 16584
  Gene Symbol: SMOX
  Gene Name: spermine oxidase
  ENSP ID: ENSP00000407269
NEVYNLTQEFFRHDKPVNAESQNSVGVFTREEVRNRIRNDPDDPEATKRLKLAMIQQYLKVESCESSSHSMDEVSLSAFGEWTEIPGAHHIIPSGFMRVVELLAEGIPAHVIQLGKPVRCIHWDQASARPRGPEIEPRGEGDHNHDTGEGGQGGEEPRGGRWDEDEQWSVVVECEDCELIPADHVIVTVSLGVLKRQYTSFFRPGLPTEKVAAIHRLGIGTTDKIFLEFEEPFWGPECNSLQFVWEDEAESHTLTYPPELWYRKICGFDVLYPPERYGHVLSGWICGEEALVMEKCDDEAVAEICTEMLRQFTGNPNIPKPRRILRSAWGSNPYFRGSYSYTQVGSSGADVEKLAKPLPYTESSKTAHGSSTKQQPGHLFSSKCPEQPLDANRGAVKPMQVLFSGEATHRKYYSTTHGALLSGQREAARLIEMYRDLFQQGT

SEQ ID NO: 83350 - protein, 585 aa, Homo sapiens
  Payload ID: 16584
  Gene Symbol: SMOX
  Gene Name: spermine oxidase
  Uniprot ID: Q9NWM0
  ENSP ID: ENSP00000478305
MQSCESSGDSADDPLSRGLRRRGQPRVVVIGAGLAGLAAAKALLEQGFTDVTVLEASSHIGGRVQSVKLGHATFELGATWIHGSHGNPIYHLAEANGLLEETTDGERSVGRISLYSKNGVACYLTNHGRRIPKDVVEEFSDLYNEVYNLTQEFFRHDKPVNAESQNSVGVFTREEVRNRIRNDPDDPEATKRLKLAMIQQYLKVESCESSSHSMDEVSLSAFGEWTEIPGAHHIIPSGFMRVVELLAEGIPAHVIQLGKPVRCIHWDQASARPRGPEIEPRGEGDHNHDTGEGGQGGEEPRGGRWDEDEQWSVVVECEDCELIPADHVIVTVSLGVLKRQYTSFFRPGLPTEKVAAIHRLGIGTTDKIFLEFEEPFWGPECNSLQFVWEDEAESHTLTYPPELWYRKICGFDVLYPPERYGHVLSGWICGEEALVMEKCDDEAVAEICTEMLRQFTGNPNIPKPRRILRSAWGSNPYFRGSYSYTQVGSSGADVEKLAKPLPYTESSKTAHGSSTKQQPGHLFSSKCPEQPLDANRGAVKPMQVLFSGEATHRKYYSTTHGALLSGQREAARLIEMYRDLFQQGT

SEQ ID NO: 83351 - protein, 313 aa, Homo sapiens
  Payload ID: 16585
  Gene Symbol: SMS
  Gene Name: spermine synthase
  Uniprot ID: P52788
  ENSP ID: ENSP00000368714
MAAARHSTLDFMLGAKADGETILKGLQSIFQEQGMAESVHTWQDHGYLATYTNKNGRLPPIVRGGAIDRYWPTADGRLVEYDIDEVVYDEDSPYQNIKILHSKQFGNILILSGDVNLAESDLAYTRAIMGSGKEDYTGKDVLILGGGDGGILCEIVKLKPKMVTMVEIDQMVIDGCKKYMRKTCGDVLDNLKGDCYQVLIEDCIPVLKRYAKEGREFDYVINDLTAVPISTSPEEDSTWEFLRLILDLSMKVLKQDGKYFTQGNCVNLTEALSLYEEQLGRLYCPVEFSKEIVCVPSYLELWVFYTVWKKAKP

SEQ ID NO: 83352 - protein, 366 aa, Homo sapiens
  Payload ID: 16585
  Gene Symbol: SMS
  Gene Name: spermine synthase
  Uniprot ID: P52788
  ENSP ID: ENSP00000385746
MAAARHSTLDFMLGAKADGETILKGLQSIFQEQGMAESVHTWQDHGYLATYTNKNGSFANLRIYPHGLVLLDLQSYDGDAQGKEEIDSILNKVEERMKELSQDSTGRVKRLPPIVRGGAIDRYWPTADGRLVEYDIDEVVYDEDSPYQNIKILHSKQFGNILILSGDVNLAESDLAYTRAIMGSGKEDYTGKDVLILGGGDGGILCEIVKLKPKMVTMVEIDQMVIDGCKKYMRKTCGDVLDNLKGDCYQVLIEDCIPVLKRYAKEGREFDYVINDLTAVPISTSPEEDSTWEFLRLILDLSMKVLKQDGKYFTQGNCVNLTEALSLYEEQLGRLYCPVEFSKEIVCVPSYLELWVFYTVWKKAKP

SEQ ID NO: 83353 - protein, 311 aa, Homo sapiens
  Payload ID: 16585
  Gene Symbol: SMS
  Gene Name: spermine synthase
  ENSP ID: ENSP00000407366
  MOD_RES (1)..(1): Any amino acid
XGGRAEAALLLAPRSVPAAARGLQGQSRVPAGRAALPGPGRPPALPRGLAAFALPLGESPGCRARADPPWDEGCRDCGGARRDPRGEPGLGACAERGCPRDLFLFLQAADGETILKGLQSIFQEQGMAESVHTWQDHGYLATYTNKNGSFANLRIYPHGLVLLDLQSYDGDAQGKEEIDSILNKVEERMKELSQDSTGRVKRLPPIVRGGAIDRYWPTADGRLVEYDIDEVVYDEDSPYQNIKILHSKQFGNILILSGDVNLAESDLAYTRAIMGSGKEDYTGKDVLILGGGDGGILCEIVKLKPKMVTMV

SEQ ID NO: 83354 - protein, 287 aa, Homo sapiens
  Payload ID: 16586
  Gene Symbol: STPG1
  Gene Name: sperm-tail PG-rich repeat containing 1
  Uniprot ID: Q5TH74
  ENSP ID: ENSP00000003583
MNALANIPDVPVKYRKNDIPGPGFYNVIHQSPVSNSVSLSKKGTCMFPSMCARLDTIISKYPAANAYTIPSDFISKRDFSNSCSSMFQLPSFMKALKFETPAPNYYNASVSCCKQRNNVCTRAGFMSKTQRGSFAFADKGPPPGHYDINESLVKQSPNTLMSCFKSKTNRGLKLTSTGPGPGYYNPSDCTKVPKKTLFPKNPILNFSAQPSPLPPKPPFPGPGQYEIVDYLGPRKHFISSASFVSNTSRWTAAPPQPGLPGPATYKPELPGKQSFLYNEDKKWIPVL

SEQ ID NO: 83355 - protein, 334 aa, Homo sapiens
  Payload ID: 16586
  Gene Symbol: STPG1
  Gene Name: sperm-tail PG-rich repeat containing 1
  Uniprot ID: Q5TH74
  ENSP ID: ENSP00000337461
MDNSAQKNERTGKHPRRASEVQKGFTAAYPTQSSIPFKSQASVIPESEKKGFNSQAKRFPHKKNDIPGPGFYNVIHQSPVSNSVSLSKKGTCMFPSMCARLDTIISKYPAANAYTIPSDFISKRDFSNSCSSMFQLPSFMKALKFETPAPNYYNASVSCCKQRNNVCTRAGFMSKTQRGSFAFADKGPPPGHYDINESLVKQSPNTLMSCFKSKTNRGLKLTSTGPGPGYYNPSDCTKVPKKTLFPKNPILNFSAQPSPLPPKPPFPGPGQYEIVDYLGPRKHFISSASFVSNTSRWTAAPPQPGLPGPATYKPELPGKQSFLYNEDKKWIPVL

SEQ ID NO: 83356 - protein, 334 aa, Homo sapiens; identical to SEQ ID NO: 83355
  Payload ID: 16586
  Gene Symbol: STPG1
  Gene Name: sperm-tail PG-rich repeat containing 1
  Uniprot ID: Q5TH74
  ENSP ID: ENSP00000363530

SEQ ID NO: 83357 - protein, 144 aa, Homo sapiens
  Payload ID: 16586
  Gene Symbol: STPG1
  Gene Name: sperm-tail PG-rich repeat containing 1
  ENSP ID: ENSP00000392225
  MOD_RES (1)..(1): Any amino acid
XFTAAYPTQSSIPFKSQASVIPESEKKGFNSQAKRFPHKKNDIPGPGFYNVIHQSPVSNSVSLSKKGTCMFPSMCARLDTIISKYPAANAYTIPSDFISKRDFSNSCSSMFQLPSFMKALKFETPAPNYYNVRTLPMLAKYRSN

SEQ ID NO: 83358 - protein, 168 aa, Homo sapiens
  Payload ID: 16586
  Gene Symbol: STPG1
  Gene Name: sperm-tail PG-rich repeat containing 1
  ENSP ID: ENSP00000416176
CARLDTIISKYPAANAYTIPSDFISKRDFSNSCSSMFQLPSFMKALKFETPAPNYYNASVSCCKQRNNVCTRAGFMSKTQRGSFAFADKGPPPGHYDINESLVKQSPNTLMSCFKSKTNRGLKLTSTGPGPGYYNPSDCTKVPKKTLFPGGSKASDLAGHLPKSTQPT

SEQ ID NO: 83359 - protein, 459 aa, Homo sapiens
  Payload ID: 16587
  Gene Symbol: STPG2
  Gene Name: sperm-tail PG-rich repeat containing 2
  Uniprot ID: Q8N412
  ENSP ID: ENSP00000295268
MYDRAPRLLKLAEGGSTEAHVGPGSYQVPFLKQQATGSNAPFLSLTARESTFTIASSIEKAVPGPGHYNVSEAQKISRSPTLTRSVDVPSIPSCGKSYGYHINDDGSIIKCFPPACDSTLGPAYYKPQFDVSNATLKYKGIHFGNSSGRQELPKKSGPGPGQYDIVQKKTSYYENVNIKRDQQQNYCSFIPRLYEIIVLQEKKKRFLPMKSITPAPGTYNEPRTALKSLKKTSGLKNIPFGQSAVRFTQDIRTEEMPGPGFYNVLNNTIIASVRNICSKKQKKSAFGSSVPRTFFSVQKEACATPGPADYQEFWHSQGVGISDELPNLTNKYAAFLSRAKRTMKVPDMVIPAPGSYDVHKSYEMSQVKHKYMPPRSLVAKRKHASFLSATPRCLEKVTDGPGPAAYNPVLRKSCPIPLFVKASKRFEESKEITPGPATYEISQEKKKGNLIGEMAADIM

SEQ ID NO: 83360 - protein, 186 aa, Homo sapiens
  Payload ID: 16587
  Gene Symbol: STPG2
  Gene Name: sperm-tail PG-rich repeat containing 2
  ENSP ID: ENSP00000428346
GSSVPRTFFSVQKEACATPGPADYQEFWHSQGVGISDELPNLTNKYAAFLSRAKRTMKVPDMVIPAPGSYDVHKSYEMSQVKHKYMPPRSLVAKRKHASFLSATPRCLEKVTDGPGPAAYNPVLRKSCPIPLFVKASKRFEESKEITPGPATYEMNNTEESPRGLRTYYMEHGGDKTISSGMTRIA

SEQ ID NO: 83361 - protein, 116 aa, Homo sapiens
  Payload ID: 16588
  Gene Symbol: SPX
  Gene Name: spexin hormone
  Uniprot ID: Q9BT56
  ENSP ID: ENSP00000256969
MKGLRSLAATTLALFLVFVFLGNSSCAPQRLLERRNWTPQAMLYLKGAQGRRFISDQSRRKDLSDRPLPERRSPNPQLLTIPEAATILLASLQKSPEDEEKNFDQTRFLEDSLLNW

SEQ ID NO: 83362 - protein, 36 aa, Homo sapiens
  Payload ID: 16588
  Gene Symbol: SPX
  Gene Name: spexin hormone
  ENSP ID: ENSP00000440877
MLYLKGAQGRRFISDQSRRKDLSDRPLPDEAQIPNY

SEQ ID NO: 83363 - protein, 1400 aa, Homo sapiens
  Payload ID: 16589
  Gene Symbol: SCAPER
  Gene Name: S-phase cyclin A-associated protein in the ER
  Uniprot ID: Q9BY12
  ENSP ID: ENSP00000326924
MMASFQRSNSHDKVRRIVAEEGRTARNLIAWSVPLESKDDDGKPKCQTGGKSKRTIQGTHKTTKQSTAVDCKITSSTTGDKHFDKSPTKTRHPRKIDLRARYWAFLFDNLRRAVDEIYVTCESDQSVVECKEVLMMLDNYVRDFKALIDWIQLQEKLEKTDAQSRPTSLAWEVKKMSPGRHVIPSPSTDRINVTSNARRSLNFGGSTGTVPAPRLAPTGVSWADKVKAHHTGSTASSEITPAQSCPPMTVQKASRKNERKDAEGWETVQRGRPIRSRSTAVMPKVSLATEATRSKDDSDKENVCLLPDESIQKGQFVGDGTSNTIESHPKDSLHSCDHPLAEKTQFTVSTLDDVKNSGSIRDNYVRTSEISAVHIDTECVSVMLQAGTPPLQVNEEKFPAEKARIENEMDPSDISNSMAEVLAKKEELADRLEKANEEAIASAIAEEEQLTREIEAEENNDINIETDNDSDFSASMGSGSVSFCGMSMDWNDVLADYEARESWRQNTSWGDIVEEEPARPPGHGIHMHEKLSSPSRKRTIAESKKKHEEKQMKAQQLREKLREEKTLKLQKLLEREKDVRKWKEELLDQRRRMMEEKLLHAEFKREVQLQAIVKKAQEEEAKVNEIAFINTLEAQNKRHDVLSKLKEYEQRLNELQEERQRRQEEKQARDEAVQERKRALEAERQARVEELLMKRKEQEARIEQQRQEKEKAREDAARERARDREERLAALTAAQQEAMEELQKKIQLKHDESIRRHMEQIEQRKEKAAELSSGRHANTDYAPKLTPYERKKQCSLCNVLISSEVYLFSHVKGRKHQQAVRENTSIQGRELSDEEVEHLSLKKYIIDIVVESTAPAEALKDGEERQKNKKKAKKIKARMNFRAKEYESLMETKNSGSDSPYKAKLQRLAKDLLKQVQVQDSGSWANNKVSALDRTLGEITRILEKENVADQIAFQAAGGLTALEHILQAVVPATNVNTVLRIPPKSLCNAINVYNLTCNNCSENCSDVLFSNKITFLMDLLIHQLTVYVPDENNTILGRNTNKQVFEGLTTGLLKVSAVVLGCLIANRPDGNCQPATPKIPTQEMKNKPSQGDPFNNRVQDLISYVVNMGLIDKLCACFLSVQGPVDENPKMAIFLQHAAGLLHAMCTLCFAVTGRSYSIFDNNRQDPTGLTAALQATDLAGVLHMLYCVLFHGTILDPSTASPKENYTQNTIQVAIQSLRFFNSFAALHLPAFQSIVGAEGLSLAFRHMASSLLGHCSQVSCESLLHEVIVCVGYFTVNHPDNQVIVQSGRHPTVLQKLCQLPFQYFSDPRLIKVLFPSLIAACYNNHQNKIILEQEMSCVLLATFIQDLAQTPGQAENQPYQPKGKCLGSQDYLELANRFPQQAWEEARQFFLKKEKK

SEQ ID NO: 83364 - protein, 1154 aa, Homo sapiens
  Payload ID: 16589
  Gene Symbol: SCAPER
  Gene Name: S-phase cyclin A-associated protein in the ER
  Uniprot ID: Q9BY12
  ENSP ID: ENSP00000442190
MKTKYIFCNITERKDAEGWETVQRGRPIRSRSTAVMPKVSLATEATRSKDDSDKENVCLLPDESIQKGQFVGDGTSNTIESHPKDSLHSCDHPLAEKTQFTVSTLDDVKNSGSIRDNYVRTSEISAVHIDTECVSVMLQAGTPPLQVNEEKFPAEKARIENEMDPSDISNSMAEVLAKKEELADRLEKANEEAIASAIAEEEQLTREIEAEENNDINIETDNDSDFSASMGSGSVSFCGMSMDWNDVLADYEARESWRQNTSWGDIVEEEPARPPGHGIHMHEKLSSPSRKRTIAESKKKHEEKQMKAQQLREKLREEKTLKLQKLLEREKDVRKWKEELLDQRRRMMEEKLLHAEFKREVQLQAIVKKAQEEEAKVNEIAFINTLEAQNKRHDVLSKLKEYEQRLNELQEERQRRQEEKQARDEAVQERKRALEAERQARVEELLMKRKEQEARIEQQRQEKEKAREDAARERARDREERLAALTAAQQEAMEELQKKIQLKHDESIRRHMEQIEQRKEKAAELSSGRHANTDYAPKLTPYERKKQCSLCNVLISSEVYLFSHVKGRKHQQAVRENTSIQGRELSDEEVEHLSLKKYIIDIVVESTAPAEALKDGEERQKNKKKAKKIKARMNFRAKEYESLMETKNSGSDSPYKAKLQRLAKDLLKQVQVQDSGSWANNKVSALDRTLGEITRILEKENVADQIAFQAAGGLTALEHILQAVVPATNVNTVLRIPPKSLCNAINVYNLTCNNCSENCSDVLFSNKITFLMDLLIHQLTVYVPDENNTILGRNTNKQVFEGLTTGLLKVSAVVLGCLIANRPDGNCQPATPKIPTQEMKNKPSQGDPFNNRVQDLISYVVNMGLIDKLCACFLSVQGPVDENPKMAIFLQHAAGLLHAMCTLCFAVTGRSYSIFDNNRQDPTGLTAALQATDLAGVLHMLYCVLFHGTILDPSTASPKENYTQNTIQVAIQSLRFFNSFAALHLPAFQSIVGAEGLSLAFRHMASSLLGHCSQVSCESLLHEVIVCVGYFTVNHPDNQVIVQSGRHPTVLQKLCQLPFQYFSDPRLIKVLFPSLIAACYNNHQNKIILEQEMSCVLLATFIQDLAQTPGQAENQPYQPKGKCLGSQDYLELANRFPQQAWEEARQFFLKKEKK

SEQ ID NO: 83365 - protein, 1400 aa, Homo sapiens; identical to SEQ ID NO: 83363
  Payload ID: 16589
  Gene Symbol: SCAPER
  Gene Name: S-phase cyclin A-associated protein in the ER
  Uniprot ID: Q9BY12
  ENSP ID: ENSP00000454973

SEQ ID NO: 83366 - protein, 111 aa, Homo sapiens
  Payload ID: 16589
  Gene Symbol: SCAPER
  Gene Name: S-phase cyclin A-associated protein in the ER
  ENSP ID: ENSP00000455231
MMASFQRSNSHDKVRRIVAEEGRTARNLIAWSVPLESKDDDGKPKCQTGGKSKRTIQGTHKTTKQSTAVDCKITSSTTGDKHFDKSPTKTRHPRKIDLRARYWAFLFDNLR

SEQ ID NO: 83367 - protein, 747 aa, Homo sapiens
  Payload ID: 16589
  Gene Symbol: SCAPER
  Gene Name: S-phase cyclin A-associated protein in the ER
  ENSP ID: ENSP00000455378
MMASFQRSNSHDKVRRIVAEEGRTARNLIAWSVPLESKDDDGKPKCQTGGKSKRTIQGTHKTTKQSTAVDCKITSSTTGDKHFDKSPTKTRHPRKIDLRARYWAFLFDNLRRAVDEIYVTCESDQSVVECKEVLMMLDNYVRDFKALIDWIQLQEKLEKTDAQSRPTSLAWEVKKMSPGRHVIPSPSTDRINVTSNARRSLNFGGSTGTVPAPRLAPTGVSWADKVKAHHTGSTASSEITPAQSCPPMTVQKASRKNERKDAEGWETVQRGRPIRSRSTAVMPKVSLATEATRSKDDSDKENVCLLPDESIQKGQFVGDGTSNTIESHPKDSLHSCDHPLAEKTQFTVSTLDDVKNSGSIRDNYVRTSEISAVHIDTECVSVMLQAGTPPLQVNEEKFPAEKARIENEMDPSDISNVSAANLSMAEVLAKKEELADRLEKANEEAIASAIAEEEQLTREIEAEENNDINIETDNDSDFSASMGSGSVSFCGMSMDWNDVLADYEARESWRQNTSWGDIVEEEPARPPGHGIHMHEKLSSPSRKRTIAESKKKHEEKQMKAQQLREKLREEKTLKLQKLLEREKDVRKWKEELLDQRRRMMEEKLLHAEFKREVQLQAIVKKAQEEEAKVNEIAFINTLEAQNKRHDVLSKLKEYEQRLNELQEERQRRQEEKQARDEAVQERKRALEAERQARVEELLMKRKEQEARIEQQRQEKEKAREDAARERARDREERLAALTAAQQEAMEE

SEQ ID NO: 83368 - protein, 75 aa, Homo sapiens
  Payload ID: 16589
  Gene Symbol: SCAPER
  Gene Name: S-phase cyclin A-associated protein in the ER
  ENSP ID: ENSP00000455623
MMASFQRSNSHDKVRRIVAEEGRTARNLIAWSVPLESKDDDGKPKCQTGGKSKRTIQGTHKTTKQLFEESPYFFP

SEQ ID NO: 83369 - protein, 154 aa, Homo sapiens
  Payload ID: 16589
  Gene Symbol: SCAPER
  Gene Name: S-phase cyclin A-associated protein in the ER
  ENSP ID: ENSP00000455751
MMASFQRSNSHDKVRRIVAEEGRTARNLIAWSVPLESKDDDGKPKCQTGGKSKRTIQGTHKTTKQEVLMMLDNYVRDFKALIDWIQLQEKLEKTDAQSRPTSLAWEVKKMSPGRHVIPSPSTDRINVTSNARRSLNFGGSTGTVPAPRLAPTGV

SEQ ID NO: 83370 - protein, 115 aa, Homo sapiens
  Payload ID: 16589
  Gene Symbol: SCAPER
  Gene Name: S-phase cyclin A-associated protein in the ER
  ENSP ID: ENSP00000456065
MMLDNYVRDFKALIDWIQLQEKLEKTDAQSRPTSLAWEVKKMSPGRHVIPSPSTDRINVTSNARRSLNFGGSTGTVPAPRLAPTGVSWADKVKAHHTGSTASSEITPAQSCPPMT

SEQ ID NO: 83371 - protein, 767 aa, Homo sapiens
  Payload ID: 16589
  Gene Symbol: SCAPER
  Gene Name: S-phase cyclin A-associated protein in the ER
  ENSP ID: ENSP00000456508
MMASFQRSNSHDKVRRIVAEEGRTARNLIAWSVPLESKDDDGKPKCQTGGKSKRTIQGTHKTTKQSTAVDCKITSSTTGDKHFDKSPTKTRHPRKIDLRARYWAFLFDNLRRAVDEIYVTCESDQSVVECKEVLMMLDNYVRDFKALIDWIQLQEKLEKTDAQSRPTSLAWEVKKMSPGRHVIPSPSTDRINVTSNARRSLNFGGSTGTVPAPRLAPTGVSWADKVKAHHTGSTASSEITPAQSCPPMTVQKASRKNERKDAEGWETVQRGRPIRSRSTAVMPKVSLATEATRSKDDSDKENVCLLPDESIQKGQFVGDGTSNTIESHPKDSLHSCDHPLAEKTQFTVSTLDDVKNSGSIRDNYVRTSEISAVHIDTECVSVMLQAGTPPLQVNEEKFPAEKARIENEMDPSDISNVSAANLSMAEVLAKKEELADRLEKANEEAIASAIAEEEQLTREIEAEENNDINIETDNDSDFSASMGSGSVSFCGMSMDWNDVLADYEARESWRQNTSWGDIVEEEPARPPGHGIHMHEKLSSPSRKRTIAESKKKHEEKQMKAQQLREKLREEKTLKLQKLLEREKDVRKWKEELLDQRRRMMEEKLLHAEFKREVQLQAIVKKAQEEEAKVNEIAFINTLEAQNKRHDVLSKLKEYEQRLNELQEERQRRQEEKQARDEAVQERKRALEAERQARVEELLMKRKEQEARIEQQRQEKEKAREDAARERARDREERLAALTAAQQEAMEELQKKIQLKHDESIRRHMEQI

SEQ ID NO: 83372 - protein, 191 aa, Homo sapiens
  Payload ID: 16589
  Gene Symbol: SCAPER
  Gene Name: S-phase cyclin A-associated protein in the ER
  ENSP ID: ENSP00000456987
SRSTAVMPKVSLATEATRSKDDSDKENVCLLPDESIQKGQFVGDGTSNTIESHPKDSLHSCDHPLAEKTQNFLQDPVWNYSVHLFTVSTLDDVKNSGSIRDNYVRTSEISAVHIDTECVSVMLQAGTPPLQVNEEKFPAEKARIENEMDPSDISNSMAEVLAKKEELADRLEKANEEAIASAIAEEEQLTR

SEQ ID NO: 83373 - protein, 99 aa, Homo sapiens
  Payload ID: 16589
  Gene Symbol: SCAPER
  Gene Name: S-phase cyclin A-associated protein in the ER
  ENSP ID: ENSP00000457234
  MOD_RES (1)..(1): Any amino acid
XFRAKEYESLMETKNSGSDSPYKAKLQRLAKDLLKQVQVQDSGSWANNKVSALDRTLGEITRILEKEVYTVWKAMHISTRQDIHKCSMAALFIITTYGK

SEQ ID NO: 83374 - protein, 60 aa, Homo sapiens
  Payload ID: 16589
  Gene Symbol: SCAPER
  Gene Name: S-phase cyclin A-associated protein in the ER
  ENSP ID: ENSP00000457382
MMLDNYVRDFKALIDWIQLQEKLEKTDAQSRPTSLAWEVKKMSPGRHVIPSPSTDRINVT

SEQ ID NO: 83375 - protein, 62 aa, Homo sapiens
  Payload ID: 16589
  Gene Symbol: SCAPER
  Gene Name: S-phase cyclin A-associated protein in the ER
  ENSP ID: ENSP00000457434
RRSLNFGGSTGTVPAPRLAPTGVSWADKVKAHHTGSTASSEITPAQSCPPMTVQKASRKNGK

SEQ ID NO: 83376 - protein, 163 aa, Homo sapiens
  Payload ID: 16590
  Gene Symbol: SKP1
  Gene Name: S-phase kinase-associated protein 1
  Uniprot ID: P63208
  ENSP ID: ENSP00000231487
MPSIKLQSSDGEIFEVDVEIAKQSVTIKTMLEDLGMDDEGDDDPVPLPNVNAAILKKVIQWCTHHKDDPPPPEDDENKEKRTDDIPVWDQEFLKVDQGTLFELILAANYLDIKGLLDVTCKTVANMIKGKTPEEIRKTFNIKNDFTEEEEAQVRKENQWCEEK

SEQ ID NO: 83377 - protein, 158 aa, Homo sapiens
  Payload ID: 16590
  Gene Symbol: SKP1
  Gene Name: S-phase kinase-associated protein 1
  ENSP ID: ENSP00000331708
MPSIKLQSSDGEIFEVDVEIAKQSVTIKTMLEDLGMDDEGDDDPVPLPNVNAAILKKVIQWCTHHKDDPPPPEDDENKEKRTDDIPVWDQEFLKVDQGTLFELILAANYLDIKGLLDVTCKTVANMIKGKTPEEIRKTFNIKNDFTEEEEAQQGRIKT

SEQ ID NO: 83378 - protein, 18 aa, Homo sapiens
  Payload ID: 16590
  Gene Symbol: SKP1
  Gene Name: S-phase kinase-associated protein 1
  ENSP ID: ENSP00000428962
MPSIKLQSSDGEIFEVDV

SEQ ID NO: 83379 - protein, 142 aa, Homo sapiens
  Payload ID: 16590
  Gene Symbol: SKP1
  Gene Name: S-phase kinase-associated protein 1
  ENSP ID: ENSP00000429415
MPSIKLQSSDGEIFEVDVEIAKQSVTIKTMLEDLGMDDEGDDDPVPLPNVNAAILKKVIQWCTHHKDDPPPPEDDENKEKRTDDIPVWDQEFLKVDQGTLFELILAANYLDIKGLLDVTCKTVANMIKGKTPEEIRKTFNIK

SEQ ID NO: 83380 - protein, 160 aa, Homo sapiens
  Payload ID: 16590
  Gene Symbol: SKP1
  Gene Name: S-phase kinase-associated protein 1
  Uniprot ID: P63208
  ENSP ID: ENSP00000429472
MPSIKLQSSDGEIFEVDVEIAKQSVTIKTMLEDLGMDDEGDDDPVPLPNVNAAILKKVIQWCTHHKDDPPPPEDDENKEKRTDDIPVWDQEFLKVDQGTLFELILAANYLDIKGLLDVTCKTVANMIKGKTPEEIRKTFNIKNDFTEEEEAQVGSTQFCL

SEQ ID NO: 83381 - protein, 163 aa, Homo sapiens; identical to SEQ ID NO: 83376
  Payload ID: 16590
  Gene Symbol: SKP1
  Gene Name: S-phase kinase-associated protein 1
  Uniprot ID: P63208
  ENSP ID: ENSP00000429686

SEQ ID NO: 83382 - protein, 163 aa, Homo sapiens; identical to SEQ ID NO: 83376
  Payload ID: 16590
  Gene Symbol: SKP1
  Gene Name: S-phase kinase-associated protein 1
  Uniprot ID: P63208
  ENSP ID: ENSP00000429961

SEQ ID NO: 83383 - protein, 41 aa, Homo sapiens
  Payload ID: 16590
  Gene Symbol: SKP1
  Gene Name: S-phase kinase-associated protein 1
  ENSP ID: ENSP00000429995
MPSIKLQSSDGEIFEVDVEIAKQSVTIKTMLEVTVHQVPIE

SEQ ID NO: 83384 - protein, 102 aa, Homo sapiens
  Payload ID: 16590
  Gene Symbol: SKP1
  Gene Name: S-phase kinase-associated protein 1
  ENSP ID: ENSP00000429996
MPSIKLQSSDGEIFEVDVEIAKQSVTIKTMLEDLGMDDEGDDDPVPLPNVNAAILKKVIQWCTHHKDDPPPPEDDENKEKRTDDIPVWDQEFLKVDQGTLFE

SEQ ID NO: 83385 - protein, 39 aa, Homo sapiens
  Payload ID: 16590
  Gene Symbol: SKP1
  Gene Name: S-phase kinase-associated protein 1
  ENSP ID: ENSP00000430885
MPSIKLQSSDGEIFEVDVEIAKQSVTIKTMLEGHPFCIV

SEQ ID NO: 83386 - protein, 163 aa, Homo sapiens
  Payload ID: 16590
  Gene Symbol: SKP1
  Gene Name: S-phase kinase-associated protein 1
  ENSP ID: ENSP00000431067
MPSIKLQSSDGEIFEVDVEIAKQSVTIKTMLEDLGMDDEGDDDPVPLPNVNAAILKKVIQWCTHHKDDPPPPEDDENKEKRTDDIPVWDQEFLKYTLRKTTVSLQAANYLDIKGLLDVTCKTVANMIKGKTPEEIRKTFNIKNDFTEEEEAQVRKENQWCEEK

SEQ ID NO: 83387 - protein, 410 aa, Homo sapiens
  Payload ID: 16591
  Gene Symbol: SKP2
  Gene Name: S-phase kinase-associated protein 2, E3 ubiquitin protein ligase
  Uniprot ID: Q13309
  ENSP ID: ENSP00000274254
MHRKHLQEIPDLSSNVATSFTWGWDSSKTSELLSGMGVSALEKEEPDSENIPQELLSNLGHPESPPRKRLKSKGSDKDFVIVRRPKLNRENFPGVSWDSLPDELLLGIFSCLCLPELLKVSGVCKRWYRLASDESLWQTLDLTGKNLHPDVTGRLLSQGVIAFRCPRSFMDQPLAEHFSPFRVQHMDLSNSVIEVSTLHGILSQCSKLQNLSLEGLRLSDPIVNTLAKNSNLVRLNLSGCSGFSEFALQTLLSSCSRLDELNLSWCFDFTEKHVQVAVAHVSETITQLNLSGYRKNLQKSDLSTLVRRCPNLVHLDLSDSVMLKNDCFQEFFQLNYLQHLSLSRCYDIIPETLLLVTRAGVRIRLDSDIGCPQTYRTSKLKSSHKLFCQHVRVICIFVCDFYFYRLVLKQ

SEQ ID NO: 83388 - protein, 424 aa, Homo sapiens
  Payload ID: 16591
  Gene Symbol: SKP2
  Gene Name: S-phase kinase-associated protein 2, E3 ubiquitin protein ligase
  Uniprot ID: Q13309
  ENSP ID: ENSP00000274255
MHRKHLQEIPDLSSNVATSFTWGWDSSKTSELLSGMGVSALEKEEPDSENIPQELLSNLGHPESPPRKRLKSKGSDKDFVIVRRPKLNRENFPGVSWDSLPDELLLGIFSCLCLPELLKVSGVCKRWYRLASDESLWQTLDLTGKNLHPDVTGRLLSQGVIAFRCPRSFMDQPLAEHFSPFRVQHMDLSNSVIEVSTLHGILSQCSKLQNLSLEGLRLSDPIVNTLAKNSNLVRLNLSGCSGFSEFALQTLLSSCSRLDELNLSWCFDFTEKHVQVAVAHVSETITQLNLSGYRKNLQKSDLSTLVRRCPNLVHLDLSDSVMLKNDCFQEFFQLNYLQHLSLSRCYDIIPETLLELGEIPTLKTLQVFGIVPDGTLQLLKEALPHLQINCSHFTTIARPTIGNKKNQEIWGIKCRLTLQKPSCL

SEQ ID NO: 83389 - protein, 217 aa, Homo sapiens
  Payload ID: 16591
  Gene Symbol: SKP2
  Gene Name: S-phase kinase-associated protein 2, E3 ubiquitin protein ligase
  ENSP ID: ENSP00000421941
MHRKHLQEIPDLSSNVATSFTWGWDSSKTSELLSGMGVSALEKEEPDSENIPQELLSNLGHPESPPRKRLKSKGSDKDFVIVRRPKLNRENFPDLSTLVRRCPNLVHLDLSDSVMLKNDCFQEFFQLNYLQHLSLSRCYDIIPETLLELGEIPTLKTLQVFGIVPDGTLQLLKEALPHLQINCSHFTTIARPTIGNKKNQEIWGIKCRLTLQKPSCL

SEQ ID NO: 83390 - protein, 255 aa, Homo sapiens
  Payload ID: 16591
  Gene Symbol: SKP2
  Gene Name: S-phase kinase-associated protein 2, E3 ubiquitin protein ligase
  ENSP ID: ENSP00000423188
MHRKHLQEIPDLSSNVATSFTWGWDSSKTSELLSGMGVSALEKEEPDSENIPQELLSNLGHPESPPRKRLKSKGSDKDFVIVRRPKLNRENFPGVSWDSLPDELLLGIFSCLCLPELLKVSGVCKRWYRLASDESLWQTLDLTGKNLHPDVTGRLLSQGVIAFRCPRSFMDQPLAEHFSTLAKNSNLVRLNLSGCSGFSEFALQTLLSSCSRLDELNLSWCFDFTEKHVQVAVAHVSETITQLNLSGYRKNLQKS

SEQ ID NO: 83391 - protein, 80 aa, Homo sapiens
  Payload ID: 16591
  Gene Symbol: SKP2
  Gene Name: S-phase kinase-associated protein 2, E3 ubiquitin protein ligase
  ENSP ID: ENSP00000424234
SNLGHPESPPRKRLKSKGSDKDFVIVRRPKLNRENFPGVSWDSLPDELLLGIFSCLCLPELLKVSGVCKRWYRLASLYFS

SEQ ID NO: 83392 - protein, 102 aa, Homo sapiens
  Payload ID: 16591
  Gene Symbol: SKP2
  Gene Name: S-phase kinase-associated protein 2, E3 ubiquitin protein ligase
  ENSP ID: ENSP00000426004
MHRKHLQEIPDLSSNVATSFTWGWDSSKTSELLSGMGVSALEKEEPDSENIPQELLSNLGHPESPPRKRLKSKGSDKDFVIVRRPKLNRENFPGLMSLYGRP

SEQ ID NO: 83393 - protein, 102 aa, Homo sapiens; identical to SEQ ID NO: 83392
  Payload ID: 16591
  Gene Symbol: SKP2
  Gene Name: S-phase kinase-associated protein 2, E3 ubiquitin protein ligase
  ENSP ID: ENSP00000426675

SEQ ID NO: 83394 - protein, 435 aa, Homo sapiens
  Payload ID: 16591
  Gene Symbol: SKP2
  Gene Name: S-phase kinase-associated protein 2, E3 ubiquitin protein ligase
  ENSP ID: ENSP00000443492
MHVFTPGPADAMHRKHLQEIPDLSSNVATSFTWGWDSSKTSELLSGMGVSALEKEEPDSENIPQELLSNLGHPESPPRKRLKSKGSDKDFVIVRRPKLNRENFPGVSWDSLPDELLLGIFSCLCLPELLKVSGVCKRWYRLASDESLWQTLDLTGKNLHPDVTGRLLSQGVIAFRCPRSFMDQPLAEHFSPFRVQHMDLSNSVIEVSTLHGILSQCSKLQNLSLEGLRLSDPIVNTLAKNSNLVRLNLSGCSGFSEFALQTLLSSCSRLDELNLSWCFDFTEKHVQVAVAHVSETITQLNLSGYRKNLQKSDLSTLVRRCPNLVHLDLSDSVMLKNDCFQEFFQLNYLQHLSLSRCYDIIPETLLELGEIPTLKTLQVFGIVPDGTLQLLKEALPHLQINCSHFTTIARPTIGNKKNQEIWGIKCRLTLQKPSCL

SEQ ID NO: 83395 - protein, 210 aa, Homo sapiens
  Payload ID: 16591
  Gene Symbol: SKP2
  Gene Name: S-phase kinase-associated protein 2, E3 ubiquitin protein ligase
  Uniprot ID: Q13309
  ENSP ID: ENSP00000478031
MDQPLAEHFSTLAKNSNLVRLNLSGCSGFSEFALQTLLSSCSRLDELNLSWCFDFTEKHVQVAVAHVSETITQLNLSGYRKNLQKSDLSTLVRRCPNLVHLDLSDSVMLKNDCFQEFFQLNYLQHLSLSRCYDIIPETLLELGEIPTLKTLQVFGIVPDGTLQLLKEALPHLQINCSHFTTIARPTIGNKKNQEIWGIKCRLTLQKPSCL

SEQ ID NO: 83396 - protein, 63 aa, Homo sapiens
  Payload ID: 16592
  Gene Symbol: SPHAR
  Gene Name: S-phase response (cyclin related)
  Uniprot ID: Q15513
  ENSP ID: ENSP00000355649
MTRIKISVCICFRYFEFCFFYALNILFQKVSEANSQTELLLRPHCKNILFNVSFMIDLQAAHF

SEQ ID NO: 83397 - protein, 631 aa, Homo sapiens
  Payload ID: 16593
  Gene Symbol: SMPD1
  Gene Name: sphingomyelin phosphodiesterase 1, acid lysosomal
  Uniprot ID: P17405
  ENSP ID: ENSP00000340409
MPRYGASLRQSCPRSGREQGQDGTAGAPGLLWMGLVLALALALALALALSDSRVLWAPAEAHPLSPQGHPARLHRIVPRLRDVFGWGNLTCPICKGLFTAINLGLKKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRIGGFYALSPYPGLRLISLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 83398 - protein, 52 aa, Homo sapiens
  Payload ID: 16593
  Gene Symbol: SMPD1
  Gene Name: sphingomyelin phosphodiesterase 1, acid lysosomal
  ENSP ID: ENSP00000431479
MVYWTGDIPAHDVWHQTRQDQLRALTTVTALVRKFLGPVPVYPAVGNHESTP

SEQ ID NO: 83399 - protein, 171 aa, Homo sapiens
  Payload ID: 16593
  Gene Symbol: SMPD1
  Gene Name: sphingomyelin phosphodiesterase 1, acid lysosomal
  ENSP ID: ENSP00000432625
MPRYGASLRQSCPRSGREQGQDGTAGAPGLLWMGLVLALALALALALALSDSRVLWAPAEAHPLSPQGHPARLHRIVPRLRDVFGWGNLTCPICKGLFTAINLGLKKEPNVARVGSVAIKLCNLLKIAPPAVCQSIVHLFEDDMVENWGVLCSFPIPRSPPHLSQYEFLFP

SEQ ID NO: 83400 - protein, 402 aa, Homo sapiens
  Payload ID: 16593
  Gene Symbol: SMPD1
  Gene Name: sphingomyelin phosphodiesterase 1, acid lysosomal
  ENSP ID: ENSP00000434353
MPRYGASLRQSCPRSGREQGQDGTAGAPGLLWMGLVLALALALALALALSDSRVLWAPAEAHPLSPQGHPARLHRIVPRLRDVFGWGNLTCPICKGLFTAINLGLKKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRYLSSVETQEGKRKNWGVLCSFPIPRSPPHLSQYEFLFP

SEQ ID NO: 83401 - protein, 630 aa, Homo sapiens
  Payload ID: 16593
  Gene Symbol: SMPD1
  Gene Name: sphingomyelin phosphodiesterase 1, acid lysosomal
  Uniprot ID: P17405
  ENSP ID: ENSP00000435350
MPRYGASLRQSCPRSGREQGQDGTAGAPGLLWMGLVLALALALALALALSDSRVLWAPAEAHPLSPQGHPARLHRIVPRLRDVFGWGNLTCPICKGLFTAINLGLKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRIGGFYALSPYPGLRLISLNMNFCSRENFWLLINSTDPAGQLQWLVGELQAAEDRGDKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 83402 - protein, 366 aa, Homo sapiens
  Payload ID: 16593
  Gene Symbol: SMPD1
  Gene Name: sphingomyelin phosphodiesterase 1, acid lysosomal
  ENSP ID: ENSP00000435950
MPRYGASLRQSCPRSGREQGQDGTAGAPGLLWMGLVLALALALALALALSDSRVLWAPAEAHPLSPQGHPARLHRIVPRLRDVFGWGNLTCPICKGLFTAINLGLKKEPNVARVGSVAIKLCNLLKIAPPAVCQSIVHLFEDDMVEVWRRSVLSPSEACGLLLGSTCGHWDIFSSWNISLPTVPKPPPKPPSPPAPGAPVSRILFLTDLHWDHDYLEGTDPDCADPLCCRRGSGLPPASRPGAGYWGEYSKCDLPLRTLESLLSGLGPAGPFDMVYWTGDIPAHDVWHQTRQDQLRALTTVTALVRKFLGPVPVYPAVGNHESTPVNSFPPPFIEGNHSSRWLYEAMAKAWEPWLPAEALRTLRCI

SEQ ID NO: 83403 - protein, 317 aa, Homo sapiens
  Payload ID: 16593
  Gene Symbol: SMPD1
  Gene Name: sphingomyelin phosphodiesterase 1, acid lysosomal
  ENSP ID: ENSP00000436278
  MOD_RES (1)..(1): Any amino acid
XFDMVYWTGDIPAHDVWHQTRQDQLRALTTVTALVRKFLGPVPVYPAVGNHESTPVNSFPPPFIEGNHSSRWLYEAMAKAWEPWLPAEALRTLRYLSSVETQEGKRKVHIIGHIPPGHCLKSWSWNYYRIVARYENTLAAQFFGHTHVDEFEVFYDEETLSRPLAVAFLAPSATTYIGLNPGYRVYQIDGNYSGSSHVVLDHETYILNLTQANIPGAIPHWQLLYRARETYGLPNTLPTAWHNLVYRMRGDMQLFQTFWFLYHKGHPPSEPCGTPCRLATLCAQLSARADSPALCRHLMPDGSLPEAQSLWPRPLFC

SEQ ID NO: 83404 - protein, 423 aa, Homo sapiens
  Payload ID: 16594
  Gene Symbol: SMPD2
  Gene Name: sphingomyelin phosphodiesterase 2, neutral membrane (neutral sphingomyelinase)
  Uniprot ID: O60906
  ENSP ID: ENSP00000258052
MKPNFSLRLRIFNLNCWGIPYLSKHRADRMRRLGDFLNQESFDLALLEEVWSEQDFQYLRQKLSPTYPAAHHFRSGIIGSGLCVFSKHPIQELTQHIYTLNGYPYMIHHGDWFSGKAVGLLVLHLSGMVLNAYVTHLHAEYNRQKDIYLAHRVAQAWELAQFIHHTSKKADVVLLCGDLNMHPEDLGCCLLKEWTGLHDAYLETRDFKGSEEGNTMVPKNCYVSQQELKPFPFGVRIDYVLYKAVSGFYISCKSFETTTGFDPHRGTPLSDHEALMATLFVRHSPPQQNPSSTHGPAERSPLMCVLKEAWTELGLGMAQARWWATFASYVIGLGLLLLALLCVLAAGGGAGEAAILLWTPSVGLVLWAGAFYLFHVQEVNGLYRAQAELQHVLGRAREAQDLGPEPQPALLLGQQEGDRTKEQ

SEQ ID NO: 83405 - protein, 204 aa, Homo sapiens
  Payload ID: 16594
  Gene Symbol: SMPD2
  Gene Name: sphingomyelin phosphodiesterase 2, neutral membrane (neutral sphingomyelinase)
  ENSP ID: ENSP00000399731
  MOD_RES (1)..(1): Any amino acid
XIYLAHRVAQAWELAQFIQCVSLGLKWEVGWDPGAEGEQGPSHGEELVMEELPPHQPGSPSHTSKKADVVLLCGDLNMHPEDLGCCLLKEWTGLHDAYLETRDFKGSEEGNTMVPKNCYVSQQELKPFPFGVRIDYVLYKAVSGFYISCKSFETTTGFDPHRGTPLSDHEALMATLFVRHSPPQQNPSSTHGPAERSPLMCVLK

SEQ ID NO: 83406 - protein, 655 aa, Homo sapiens
  Payload ID: 16595
  Gene Symbol: SMPD3
  Gene Name: sphingomyelin phosphodiesterase 3, neutral membrane (neutral sphingomyelinase II)
  Uniprot ID: Q9NY59
  ENSP ID: ENSP00000219334
MVLYTTPFPNSCLSALHCVSWALIFPCYWLVDRLAASFIPTTYEKRQRADDPCCLQLLCTALFTPIYLALLVASLPFAFLGFLFWSPLQSARRPYIYSRLEDKGLAGGAALLSEWKGTGPGKSFCFATANVCLLPDSLARVNNLFNTQARAKEIGQRIRNGAARPQIKIYIDSPTNTSISAASFSSLVSPQGGDGVARAVPGSIKRTASVEYKGDGGRHPGDEAANGPASGDPVDSSSPEDACIVRIGGEEGGRPPEADDPVPGGQARNGAGGGPRGQTPNHNQQDGDSGSLGSPSASRESLVKGRAGPDTSASGEPGANSKLLYKASVVKKAAARRRRHPDEAFDHEVSAFFPANLDFLCLQEVFDKRAATKLKEQLHGYFEYILYDVGVYGCQGCCSFKCLNSGLLFASRYPIMDVAYHCYPNKCNDDALASKGALFLKVQVGSTPQDQRIVGYIACTHLHAPQEDSAIRCGQLDLLQDWLADFRKSTSSSSAANPEELVAFDVVCGDFNFDNCSSDDKLEQQHSLFTHYRDPCRLGPGEEKPWAIGTLLDTNGLYDEDVCTPDNLQKVLESEEGRREYLAFPTSKSSGQKGRKELLKGNGRRIDYMLHAEEGLCPDWKAEVEEFSFITQLSGLTDHLPVAMRLMVSSGEEEA

SEQ ID NO: 83407 - protein, 647 aa, Homo sapiens
  Payload ID: 16595
  Gene Symbol: SMPD3
  Gene Name: sphingomyelin phosphodiesterase 3, neutral membrane (neutral sphingomyelinase II)
  Uniprot ID: Q9NY59
  ENSP ID: ENSP00000455955
MVLYTTPFPNSCLSALHCVSWALIFPCYWLVDRLAASFIPTTYEKRQRADDPCCLQLLCTALFTPIYLALLVASLPFAFLGFLFWSPLQSARRPYIYSRLEDKGLAGGAALLSEWKGTGPGKSFCFATANVCLLPDSLARVNNLFNTQARAKEIGQRIRNGAARPQIKIYIDSPTNTSISAASFSSLVSPQGGDGVARAVPGSIKRTASVEYKGDGGRHPGDEAANGPASGDPVDSSSPEDACIVRIGGEEGGRPPEADDPVPGGQARNGAGGGPRGQTPNHNQQDGDSGSLGSPSASRESLVKGRAGPDTSASGEPGANSKLLYKASVVKKAAARRRRHPDEAFDHEVSAFFPANLDFLCLQEVFDKRAATKLKEQLHGYFEYILYDVGVYGCQGCCSFKCLNSGLLFASRYPIMDVAYHCYPNKCNDDALASKGALFLKVQVGSTPQDQRIVGYIACTHLHAPQEDSAIRCGQLDLLQDWLADFRKSTSSSSAANPEELVAFDVVCGDFNFDNCSSDDKLEQQHSLFTHYRDPCRLGPGTLLDTNGLYDEDVCTPDNLQKVLESEEGRREYLAFPTSKSSGQKGRKELLKGNGRRIDYMLHAEEGLCPDWKAEVEEFSFITQLSGLTDHLPVAMRLMVSSGEEEA

SEQ ID NO: 83408 - protein, 93 aa, Homo sapiens
  Payload ID: 16595
  Gene Symbol: SMPD3
  Gene Name: sphingomyelin phosphodiesterase 3, neutral membrane (neutral sphingomyelinase II)
  ENSP ID: ENSP00000457236
MVLYTTPFPNSCLSALHCVSWALIFPCYWLVDRLAASFIPTTYEKRQRADDPCCLQLLCTALFTPIYLALLVASLPFAFLGFLFWSPLQSARR

SEQ ID NO: 83409 - protein, 638 aa, Homo sapiens
  Payload ID: 16595
  Gene Symbol: SMPD3
  Gene Name: sphingomyelin phosphodiesterase 3, neutral membrane (neutral sphingomyelinase II)
  ENSP ID: ENSP00000457422
MVLYTTPFPNSCLSALHCVSWALIFPCYWLVDRLAASFIPTTYEKRQRADDPCCLQLLCTALFTPIYLALLVASLPFAFLGFLFWSPLQSARRPYIYSRLEDKGLAGGAALLSEWKGTGPGKSFCFATANVCLLPDSLARVNNLFNTQARAKEIGQRIRNGAARPQIKIYIDSPTNTSISAASFSSLVSPQGGDGVARAVPGSIKRTASVEYKGDGGRHPGDEAANGPASGDPVDSSSPEDACIVRIGGEEGGRPPEADDPVPGGQARNGAGGGPRGQTPNHNQQDGDSGSLGSPSASRESLVKGRAGPDTSASGEPGANSKLLYKASVVKKAAARRRRHPDEAFDHEVSAFFPANLDFLCLQEVFDKRAATKLKEQLHGYFEYILYDVGVYGCQGCCSFKCLNSGLLFASRYPIMDVAYHCYPNKCNDDALASKGALFLKVQVGSTPQDQRIVGYIACTHLHAPQEDSAIRCGQLDLLQDWLADFRKSTSSSSAANPEELVAFDVVCGDFNFDNCSSDDKLEQQHSLFTHYRDPCRLGPGEEKPWAIGTLLDTNGLYDEDVCTPDNLQNKSSGQKGRKELLKGNGRRIDYMLHAEEGLCPDWKAEVEEFSFITQLSGLTDHLPVAMRLMVSSGEEEA

SEQ ID NO: 83410 - protein, 207 aa, Homo sapiens
  Payload ID: 16595
  Gene Symbol: SMPD3
  Gene Name: sphingomyelin phosphodiesterase 3, neutral membrane (neutral sphingomyelinase II)
  ENSP ID: ENSP00000459317
  MOD_RES (1)..(1): Any amino acid
XAARAAAASSVSTAASSLPAATPSWTWPITVTPTSVTTMPWPLRELCFSRCRWEAHLRTKESSGTSPAHTCMPRKRTAPSGVGSWTCFRTGWLISENLPPRPAQPTPRSWWHLTSSVEISTLITAPLTTSWSSNTPCSPTTGTPAAWGLVRRSRGPSVLCWTRTACTMRMCAPPTTCRRSWRVRRAAGSTWRFPPARARARRGGRSC

SEQ ID NO: 83411 - protein, 837 aa, Homo sapiens
  Payload ID: 16596
  Gene Symbol: SMPD4
  Gene Name: sphingomyelin phosphodiesterase 4, neutral membrane (neutral sphingomyelinase-3)
  ENSP ID: ENSP00000259217
MTTFGAVAEWRLPSLRRATLWIPQWFAKKAIFNSPLEAAMAFPHLQQPSFLLASLKADSINKPFAQQCQDLVKVIEDFPAKELHTIFPWLVESIFGSLDGVLVGWNLRCLQGRVNPVEYSIVMEFLDPGGPMMKLVYKLQAEDYKFDFPVSYLPGPVKASIQECILPDSPLYHNKVQFTPTGGLGLNLALNPFEYYIFFFALSLITQKPLPVSLHVRTSDCAYFILVDRYLSWFLPTEGSVPPPLSSSPGGTSPSPPPRTPAIPFASYGLHHTSLLKRHISHQTSVNADPASHEIWRSETLLQVFVEMWLHHYSLEMYQKMQSPHAKESFTPTEEHVLVVRLLLKHLHAFANSLKPEQASPSAHSHATSPLEEFKRAAVPRFVQQKLYLFLQHCFGHWPLDASFRAVLEMWLSYLQPWRYAPDKQAPGSDSQPRCVSEKWAPFVQENLLMYTKLFVGFLNRALRTDLVSPKHALMVFRVAKVFAQPNLAEMIQKGEQLFLEPELVIPHRQHRLFTAPTFTGSFLSPWPPAVTDASFKVKSHVYSLEGQDCKYTPMFGPEARTLVLRLAQLITQAKHTAKSISDQCAESPAGHSFLSWLGFSSMDTNGSYTANDLDEMGQDSVRKTDEYLEKALEYLRQIFRLSEAQLRQFTLALGTTQDENGKKQLPDCIVGEDGLILTPLGRYQIINGLRRFEIEYQGDPELQPIRSYEIASLVRTLFRLSSAINHRFAGQMAALCSRDDFLGSFCRYHLTEPGLASRHLLSPVGRRQVAGHTRGPRLSLRFLGSYRTLVSLLLAFFVASLFCVGPLPCTLLLTLGYVLYASAMTLLTERGKLHQP

SEQ ID NO: 83412 - protein, 866 aa, Homo sapiens
  Payload ID: 16596
  Gene Symbol: SMPD4
  Gene Name: sphingomyelin phosphodiesterase 4, neutral membrane (neutral sphingomyelinase-3)
  ENSP ID: ENSP00000386531
MTTFGAVAEWRLPSLRRATLWIPQWFAKKAIFNSPLEAAMAFPHLQQPSFLLASLKADSINKPFAQQCQDLVKVIEDFPAKELHTIFPWLVESIFGSLDGVLVGWNLRCLQGRVNPVEYSIVMEFLDPGGPMMKLVYKLQAEDYKFDFPVSYLPGPVKASIQECILPDSPLYHNKVQFTPTGGLGLNLALNPFEYYIFFFALSLITQKPLPVSLHVRTSDCAYFILVDRYLSWFLPTEGSVPPPLSSSPGGTSPSPPPRTPAIPFASYGLHHTSLLKRHISHQTSVNADPASHEIWRSETLLQVFVEMWLHHYSLEMYQKMQSPHAKLEVLHYRLSVSSALYSPAQPSLQALHAYQESFTPTEEHVLVVRLLLKHLHAFANSLKPEQASPSAHSHATSPLEEFKRAAVPRFVQQKLYLFLQHCFGHWPLDASFRAVLEMWLSYLQPWRYAPDKQAPGSDSQPRCVSEKWAPFVQENLLMYTKLFVGFLNRALRTDLVSPKHALMVFRVAKVFAQPNLAEMIQKGEQLFLEPELVIPHRQHRLFTAPTFTGSFLSPWPPAVTDASFKVKSHVYSLEGQDCKYTPMFGPEARTLVLRLAQLITQAKHTAKSISDQCAESPAGHSFLSWLGFSSMDTNGSYTANDLDEMGQDSVRKTDEYLEKALEYLRQIFRLSEAQLRQFTLALGTTQDENGKKQLPDCIVGEDGLILTPLGRYQIINGLRRFEIEYQGDPELQPIRSYEIASLVRTLFRLSSAINHRFAGQMAALCSRDDFLGSFCRYHLTEPGLASRHLLSPVGRRQVAGHTRGPRLSLRFLGSYRTLVSLLLAFFVASLFCVGPLPCTLLLTLGYVLYASAMTLLTERGKLHQP

SEQ ID NO: 83413 - protein, 88 aa, Homo sapiens
  Payload ID: 16596
  Gene Symbol: SMPD4
  Gene Name: sphingomyelin phosphodiesterase 4, neutral membrane (neutral sphingomyelinase-3)
  ENSP ID: ENSP00000393791
MWLHHYSLEMYQKMQSPHAKESFTPTEEHVLVVRLLLKHLHAFANSLKPEQASPSAHSHATSPLEEFKRIALATGPWTHRSELSWRCG

SEQ ID NO: 83414 - protein, 313 aa, Homo sapiens
  Payload ID: 16596
  Gene Symbol: SMPD4
  Gene Name: sphingomyelin phosphodiesterase 4, neutral membrane (neutral sphingomyelinase-3)
  ENSP ID: ENSP00000397078
KRAAVPRFVQQKLYLFLQHCFGHWPLDASFRAVLEMWLSYLQPWRYAPDKQAPGSDSQPRCVSEKWAPFVQENLLMYTKLFVGFLNRALRTDLVSPKHALMVFRVAKVFAQPNLAEMIQKGEQLFLEPELVIPHRQHRLFTAPTFTGSFLSPWPPAVTDASFKVKSHVYSLEGQDCKYTPMFGPEARTLVLRLAQLITQAKHTAKSISDQCAESPAGHSFLSWLGFSSMDTNGSYTANDLDEMGQDSVRKTDEYLEKALEYLRQIFRFAGQMAALCSRDDFLGSFCRYHLTEPGLASRHLLSPVGRRQVAGHT

SEQ ID NO: 83415 - protein, 56 aa, Homo sapiens
  Payload ID: 16596
  Gene Symbol: SMPD4
  Gene Name: sphingomyelin phosphodiesterase 4, neutral membrane (neutral sphingomyelinase-3)
  ENSP ID: ENSP00000397278
MAFPHLQQPSFLLASLKADSINKPFAQQCQDLVKVIEDFPAKDTSHTLCFLWPPPH

SEQ ID NO: 83416 - protein, 741 aa, Homo sapiens
  Payload ID: 16596
  Gene Symbol: SMPD4
  Gene Name: sphingomyelin phosphodiesterase 4, neutral membrane (neutral sphingomyelinase-3)
  ENSP ID: ENSP00000401648
  MOD_RES (1)..(1): Any amino acid
XHNKVQFTPTGGLGLNLALNPFEYYIFFFALSLITQKPLPVSLHVRTSDCAYFILVDRYLSWFLPTEGSVPPPLSSSPGGTSPSPPPRTPAIPFASYGLHHTSLLKRHISHQTSVNADPASHEIWRSETLLQVFVEMWLHHYSLEMYQKMQSPHAKLEVLHYRLSVSSALYSPAQPSLQALHAYQESFTPTEEHVLVVRLLLKHLHAFANSLKPEQASPSAHSHATSPLEEFKRMGLNLPEVPSALPRRSQPSLMGALGSSVSRASLLGKQQVTLPIPCRAAVPRFVQQKLYLFLQHCFGHWPLDASFRAVLEMWLSYLQPWRYAPDKQAPGSDSQPRCVSEKWAPFVQENLLMYTKLFVGFLNRALRTDLVSPKHALMVFRVAKVFAQPNLAEMIQKGEQLFLEPELVIPHRQHRLFTAPTFTGSFLSPWPPAVTDASFKVKSHVYSLEGQDCKYTPMFGPEARTLVLRLAQLITQAKHTAKSISDQCAESPAGHSFLSWLGFSSMDTNGSYTANDLDEMGQDSVRKTDEYLEKALEYLRQIFRLSEAQLRQFTLALGTTQDENGKKQLPDCIVGEDGLILTPLGRYQIINGLRRFEIEYQGDPELQPIRSYEIASLVRTLFRLSSAINHRFAGQMAALCSRDDFLGSFCRYHLTEPGLASRHLLSPVGRRQVAGHTRGPRLSLRFLGSYRTLVSLLLAFFVASLFCVGPLPCTLLLTLGYVLYASAMTLLTERGKLHQP

SEQ ID NO: 83417 - protein, 57 aa, Homo sapiens
  Payload ID: 16596
  Gene Symbol: SMPD4
  Gene Name: sphingomyelin phosphodiesterase 4, neutral membrane (neutral sphingomyelinase-3)
  ENSP ID: ENSP00000403002
MAFPHLQQPSFLLASLKADSINKPFAQQCQDLVKVIEDFPAKMVSSLAGTSAAYRGA

SEQ ID NO: 83418 - protein, 211 aa, Homo sapiens
  Payload ID: 16596
  Gene Symbol: SMPD4
  Gene Name: sphingomyelin phosphodiesterase 4, neutral membrane (neutral sphingomyelinase-3)
  ENSP ID: ENSP00000403915
VSEKWAPFVQENLLMYTKLFVGFLNRALRTDLVSPKHALMVFRVAKVFAQPNLAEMIQKGEQLFLEPELVIPHRQHRLFTAPTFTGSFLSPWPPAVTDASFKVLRLAQLITQAKHTAKSISDQCAESPAGHSFLSWLGFSSMDTNGSYTANDLDEMGQDSVRKTDEYLEKALEYLRQIFRLSEAQLRQFTLALGTTQDENGKKQLPDCIVG

SEQ ID NO: 83419 - protein, 764 aa, Homo sapiens
  Payload ID: 16596
  Gene Symbol: SMPD4
  Gene Name: sphingomyelin phosphodiesterase 4, neutral membrane (neutral sphingomyelinase-3)
  Uniprot ID: Q9NXE4
  ENSP ID: ENSP00000405187
MTTFGAVAEWRLPSLRRATLWIPQWFAKKAIFNSPLEAAMAFPHLQQPSFLLASLKADSINKPFAQQCQDLVKVIEDFPAKGPVKASIQECILPDSPLYHNKVQFTPTGGLGLNLALNPFEYYIFFFALSLITQKPLPVSLHVRTSDCAYFILVDRYLSWFLPTEGSVPPPLSSSPGGTSPSPPPRTPAIPFASYGLHHTSLLKRHISHQTSVNADPASHEIWRSETLLQVFVEMWLHHYSLEMYQKMQSPHAKESFTPTEEHVLVVRLLLKHLHAFANSLKPEQASPSAHSHATSPLEEFKRAAVPRFVQQKLYLFLQHCFGHWPLDASFRAVLEMWLSYLQPWRYAPDKQAPGSDSQPRCVSEKWAPFVQENLLMYTKLFVGFLNRALRTDLVSPKHALMVFRVAKVFAQPNLAEMIQKGEQLFLEPELVIPHRQHRLFTAPTFTGSFLSPWPPAVTDASFKVKSHVYSLEGQDCKYTPMFGPEARTLVLRLAQLITQAKHTAKSISDQCAESPAGHSFLSWLGFSSMDTNGSYTANDLDEMGQDSVRKTDEYLEKALEYLRQIFRLSEAQLRQFTLALGTTQDENGKKQLPDCIVGEDGLILTPLGRYQIINGLRRFEIEYQGDPELQPIRSYEIASLVRTLFRLSSAINHRFAGQMAALCSRDDFLGSFCRYHLTEPGLASRHLLSPVGRRQVAGHTRGPRLSLRFLGSYRTLVSLLLAFFVASLFCVGPLPCTLLLTLGYVLYASAMTLLTERGKLHQP

SEQ ID NO: 83420 - protein, 265 aa, Homo sapiens
  Payload ID: 16596
  Gene Symbol: SMPD4
  Gene Name: sphingomyelin phosphodiesterase 4, neutral membrane (neutral sphingomyelinase-3)
  ENSP ID: ENSP00000405363
FILVDRYLSWFLPTEGSVPPPLSSSPGGTSPSPPPRTPAIPFASYGLHHTSLLKRHISHQTSVNADPASHEIWRSETLLQVFVEMWLHHYSLEMYQKMQSPHAKESFTPTEEHVLVVRLLLKHLHAFANSLKPEQASPSAHSHATSPLEEFKRAAVPRFVQQKLYLFLQHCFGHWPLDASFRAVLEMWLSYLQPWRYAPDKQAPGSDSQPRAPFVQENLLMYTKLFVGFLNRALRTDLVSPKHALMVFRVAKVFAQPNLAEMIQK

SEQ ID NO: 83421 - protein, 274 aa, Homo sapiens
  Payload ID: 16596
  Gene Symbol: SMPD4
  Gene Name: sphingomyelin phosphodiesterase 4, neutral membrane (neutral sphingomyelinase-3)
  ENSP ID: ENSP00000406325
  MOD_RES (1)..(1): Any amino acid
XVSLHVRTSDCAYFILVDRYLSWFLPTEGSVPPPLSSSPGGTSPSPPPRTPAIPFASYGLHHTSLLKRHISHQTSVNADPASHEIWRSETLLQVFVEMWLHHYSLEMYQKMQSPHAKVLEMWLSYLQPWRYAPDKQAPGSDSQPRCVSEKWAPFVQENLLMYTKLFVGFLNRALRTDLVSPKHALMVFRVAKVFAQPNLAEMIQKGEQLFLEPELVIPHRQHRLFTAPTFTGSFLSPWPPAVTDASFKVKSHVYSLEGQDCKYTPMFGPEARTL

SEQ ID NO: 83422 - protein, 135 aa, Homo sapiens
  Payload ID: 16596
  Gene Symbol: SMPD4
  Gene Name: sphingomyelin phosphodiesterase 4, neutral membrane (neutral sphingomyelinase-3)
  ENSP ID: ENSP00000406458
MAFPHLQQPSFLLASLKADSINKPFAQQCQDLVKVIEDFPAKELHTIFPWLVESIFGSLDGVLVGWNLRCLQGRVNPVEYSIVMEFLDPGGPMMKLVYKLQAEDYKFDFPVSYLPGPVKASIQECILPDSPLYHN

SEQ ID NO: 83423 - protein, 50 aa, Homo sapiens
  Payload ID: 16596
  Gene Symbol: SMPD4
  Gene Name: sphingomyelin phosphodiesterase 4, neutral membrane (neutral sphingomyelinase-3)
  ENSP ID: ENSP00000407591
MAFPHLQQPSFLLASLKADSINKPFAQQCQDLVKVIEDFPAKWPNDEVGL

SEQ ID NO: 83424 - protein, 56 aa, Homo sapiens; identical to SEQ ID NO: 83415
  Payload ID: 16596
  Gene Symbol: SMPD4
  Gene Name: sphingomyelin phosphodiesterase 4, neutral membrane (neutral sphingomyelinase-3)
  ENSP ID: ENSP00000416208

SEQ ID NO: 83425 - protein, 453 aa, Homo sapiens
  Payload ID: 16597
  Gene Symbol: SMPDL3A
  Gene Name: sphingomyelin phosphodiesterase, acid-like 3A
  Uniprot ID: Q92484
  ENSP ID: ENSP00000357425
MALVRALVCCLLTAWHCRSGLGLPVAPAGGRNPPPAIGQFWHVTDLHLDPTYHITDDHTKVCASSKGANASNPGPFGDVLCDSPYQLILSAFDFIKNSGQEASFMIWTGDSPPHVPVPELSTDTVINVITNMTTTIQSLFPNLQVFPALGNHDYWPQDQLPVVTSKVYNAVANLWKPWLDEEAISTLRKGGFYSQKVTTNPNLRIISLNTNLYYGPNIMTLNKTDPANQFEWLESTLNNSQQNKEKVYIIAHVPVGYLPSSQNITAMREYYNEKLIDIFQKYSDVIAGQFYGHTHRDSIMVLSDKKGSPVNSLFVAPAVTPVKSVLEKQTNNPGIRLFQYDPRDYKLLDMLQYYLNLTEANLKGESIWKLEYILTQTYDIEDLQPESLYGLAKQFTILDSKQFIKYYNYFFVSYDSSVTCDKTCKAFQICAIMNLDNISYADCLKQLYIKHNY

SEQ ID NO: 83426 - protein, 322 aa, Homo sapiens
  Payload ID: 16597
  Gene Symbol: SMPDL3A
  Gene Name: sphingomyelin phosphodiesterase, acid-like 3A
  Uniprot ID: Q92484
  ENSP ID: ENSP00000442152
MTTTIQSLFPNLQVFPALGNHDYWPQDQLPVVTSKVYNAVANLWKPWLDEEAISTLRKGGFYSQKVTTNPNLRIISLNTNLYYGPNIMTLNKTDPANQFEWLESTLNNSQQNKEKVYIIAHVPVGYLPSSQNITAMREYYNEKLIDIFQKYSDVIAGQFYGHTHRDSIMVLSDKKGSPVNSLFVAPAVTPVKSVLEKQTNNPGIRLFQYDPRDYKLLDMLQYYLNLTEANLKGESIWKLEYILTQTYDIEDLQPESLYGLAKQFTILDSKQFIKYYNYFFVSYDSSVTCDKTCKAFQICAIMNLDNISYADCLKQLYIKHNY

SEQ ID NO: 83427 - protein, 373 aa, Homo sapiens
  Payload ID: 16598
  Gene Symbol: SMPDL3B
  Gene Name: sphingomyelin phosphodiesterase, acid-like 3B
  Uniprot ID: Q92485
  ENSP ID: ENSP00000362995
MRLLAWLIFLANWGGARAEPGKFWHIADLHLDPDYKVSKDPFQVCPSAGSQPVPDAGPWGDYLCDSPWALINSSIYAMKEIEPEPDFILWTGDDTPHVPDEKLGEAAVLEIVERLTKLIREVFPDTKVYAALGNHDFHPKNQFPAGSNNIYNQIAELWKPWLSNESIALFKKGAFYCEKLPGPSGAGRIVVLNTNLYYTSNALTADMADPGQQFQWLEDVLTDASKAGDMVYIVGHVPPGFFEKTQNKAWFREGFNEKYLKVVRKHHRVIAGQFFGHHHTDSFRMLYDDAGVPISAMFITPGVTPWKTTLPGVVNGANNPAIRVFEYDRATLSLKVRSPAEARGGGWEGLKCITTFPHSQLIHLPLTTEPQEG

SEQ ID NO: 83428 - protein, 455 aa, Homo sapiens
  Payload ID: 16598
  Gene Symbol: SMPDL3B
  Gene Name: sphingomyelin phosphodiesterase, acid-like 3B
  Uniprot ID: Q92485
  ENSP ID: ENSP00000363001
MRLLAWLIFLANWGGARAEPGKFWHIADLHLDPDYKVSKDPFQVCPSAGSQPVPDAGPWGDYLCDSPWALINSSIYAMKEIEPEPDFILWTGDDTPHVPDEKLGEAAVLEIVERLTKLIREVFPDTKVYAALGNHDFHPKNQFPAGSNNIYNQIAELWKPWLSNESIALFKKGAFYCEKLPGPSGAGRIVVLNTNLYYTSNALTADMADPGQQFQWLEDVLTDASKAGDMVYIVGHVPPGFFEKTQNKAWFREGFNEKYLKVVRKHHRVIAGQFFGHHHTDSFRMLYDDAGVPISAMFITPGVTPWKTTLPGVVNGANNPAIRVFEYDRATLSLKDMVTYFMNLSQANAQGTPRWELEYQLTEAYGVPDASAHSMHTVLDRIAGDQSTLQRYYVYNSVSYSAGVCDEACSMQHVCAMRQVDIDAYTTCLYASGTTPVPQLPLLLMALLGLCTLVL

SEQ ID NO: 83429 - protein, 269 aa, Homo sapiens
  Payload ID: 16598
  Gene Symbol: SMPDL3B
  Gene Name: sphingomyelin phosphodiesterase, acid-like 3B
  ENSP ID: ENSP00000388092
MRLLAWLIFLANWGGARAEPEEAQGPCAQEKGKGPPPTSILASLAPGLEAGKFWHIADLHLDPDYKVSKDPFQVCPSAGSQPVPDAGPWGDYLCDSPWALINSSIYAMKEIEPEPDFILWTGDDTPHVPDEKLGEAAVLEIVERLTKLIREVFPDTKVYAALGNHDFHPKNQFPAGSNNIYNQIAELWKPWLSNESIALFKKGAFYCEKLPGPSGAGRIVVLNTNLYYTSNALTADMADPGQQFQWLEDVLTDASKAGDMVYIVGHVPP

SEQ ID NO: 83430 - protein, 102 aa, Homo sapiens
  Payload ID: 16598
  Gene Symbol: SMPDL3B
  Gene Name: sphingomyelin phosphodiesterase, acid-like 3B
  ENSP ID: ENSP00000449057
MRLLAWLIFLANWGGARAEPGKFWHIADLHLDPDYKVSKDPFQVCPSAGSQPVPDAGPWGDYLCDSPWALINSSIYAMKEIEPEPDFILWTGAVPSFSSAAS

SEQ ID NO: 83431 - protein, 407 aa, Homo sapiens
  Payload ID: 16598
  Gene Symbol: SMPDL3B
  Gene Name: sphingomyelin phosphodiesterase, acid-like 3B
  ENSP ID: ENSP00000449450
MRLLAWLIFLANWGGARAEPGKFWHIADLHLDPDYKVSKDPFQVCPSAGSQPVPDAGPWGDYLCDSPWALINSSIYAMKEIEPEPDFILWTGDDTPHVPDEKLGEAAVLEIVERLTKLIREVFPGAFYCEKLPGPSGAGRIVVLNTNLYYTSNALTADMADPGQQFQWLEDVLTDASKAGDMVYIVGHVPPGFFEKTQNKAWFREGFNEKYLKVVRKHHRVIAGQFFGHHHTDSFRMLYDDAGVPISAMFITPGVTPWKTTLPGVVNGANNPAIRVFEYDRATLSLKDMVTYFMNLSQANAQGTPRWELEYQLTEAYGVPDASAHSMHTVLDRIAGDQSTLQRYYVYNSVSYSAGVCDEACSMQHVCAMRQVDIDAYTTCLYASGTTPVPQLPLLLMALLGLCTLVL

SEQ ID NO: 83432 - protein, 413 aa, Homo sapiens
  Payload ID: 16599
  Gene Symbol: SGMS1
  Gene Name: sphingomyelin synthase 1
  ENSP ID: ENSP00000354829
MKEVVYWSPKKVADWLLENAMPEYCEPLEHFTGQDLINLTQEDFKKPPLCRVSSDNGQRLLDMIETLKMEHHLEAHKNGHANGHLNIGVDIPTPDGSFSIKIKPNGMPNGYRKEMIKIPMPELERSQYPMEWGKTFLAFLYALSCFVLTTVMISVVHERVPPKEVQPPLPDTFFDHFNRVQWAFSICEINGMILVGLWLIQWLLLKYKSIISRRFFCIVGTLYLYRCITMYVTTLPVPGMHFNCSPKLFGDWEAQLRRIMKLIAGGGLSITGSHNMCGDYLYSGHTVMLTLTYLFIKEYSPRRLWWYHWICWLLSVVGIFCILLAHDHYTVDVVVAYYITTRLFWWYHTMANQQVLKEASQMNLLARVWWYRPFQYFEKNVQGIVPRSYHWPFPWPVVHLSRQVKYSRLVNDT

SEQ ID NO: 83433 - protein, 241 aa, Homo sapiens
  Payload ID: 16599
  Gene Symbol: SGMS1
  Gene Name: sphingomyelin synthase 1
  ENSP ID: ENSP00000355235
MKEVVYWSPKKVADWLLENAMPEYCEPLEHFTGQDLINLTQEDFKKPPLCRVSSDNGQRLLDMIETLKMEHHLEAHKNGHANGHLNIGVDIPTPDGSFSIKIKPNGMPNGYRKEMIKIPMPELERSQYPMEWGKTFLAFLYALSCFVLTTVMISVVHERVPPKEVQPPLPDTFFDHFNRVQWAFSICEINGMILVGLWLIQWLLLKYKDVGNESRVVMIFLSIVHPVLLLGSIAGFLSLSL

SEQ ID NO: 83434 - protein, 219 aa, Homo sapiens
  Payload ID: 16599
  Gene Symbol: SGMS1
  Gene Name: sphingomyelin synthase 1
  ENSP ID: ENSP00000406795
MKEVVYWSPKKVADWLLENAMPEYCEPLEHFTGQDLINLTQEDFKKPPLCRVSSDNGQRLLDMIETLKMEHHLEAHKNGHANGHLNIGVDIPTPDGSFSIKIKPNGMPNGYRKEMIKIPMPELERSQYPMEWGKTFLAFLYALSCFVLTTVMISVVHERVPPKEVQPPLPDTFFDHFNRVQWAFSICEINGMILVGLWLIQWLLLKYNFSETGKPNCEE

SEQ ID NO: 83435 - protein, 35 aa, Homo sapiens
  Payload ID: 16599
  Gene Symbol: SGMS1
  Gene Name: sphingomyelin synthase 1
  ENSP ID: ENSP00000473668
MYVTTLPVPGMHFNCSPKLFGDWEAQLRRIMKLIA

SEQ ID NO: 83436 - protein, 12 aa, Homo sapiens
  Payload ID: 16599
  Gene Symbol: SGMS1
  Gene Name: sphingomyelin synthase 1
  ENSP ID: ENSP00000475427
LWLIQWLLLKYK

SEQ ID NO: 83437 - protein, 241 aa, Homo sapiens; identical to SEQ ID NO: 83433
  Payload ID: 16599
  Gene Symbol: SGMS1
  Gene Name: sphingomyelin synthase 1
  ENSP ID: ENSP00000479633

SEQ ID NO: 83438 - protein, 241 aa, Homo sapiens; identical to SEQ ID NO: 83433
  Payload ID: 16599
  Gene Symbol: SGMS1
  Gene Name: sphingomyelin synthase 1
  ENSP ID: ENSP00000486310

SEQ ID NO: 83439 - protein, 365 aa, Homo sapiens
  Payload ID: 16600
  Gene Symbol: SGMS2
  Gene Name: sphingomyelin synthase 2
  Uniprot ID: Q8NHU3
  ENSP ID: ENSP00000351981
MDIIETAKLEEHLENQPSDPTNTYARPAEPVEEENKNGNGKPKSLSSGLRKGTKKYPDYIQIAMPTESRNKFPLEWWKTGIAFIYAVFNLVLTTVMITVVHERVPPKELSPPLPDKFFDYIDRVKWAFSVSEINGIILVGLWITQWLFLRYKSIVGRRFCFIIGTLYLYRCITMYVTTLPVPGMHFQCAPKLNGDSQAKVQRILRLISGGGLSITGSHILCGDFLFSGHTVTLTLTYLFIKEYSPRHFWWYHLICWLLSAAGIICILVAHEHYTIDVIIAYYITTRLFWWYHSMANEKNLKVSSQTNFLSRAWWFPIFYFFEKNVQGSIPCCFSWPLSWPPGCFKSSCKKYSRVQKIGEDNEKST

SEQ ID NO: 83440 - protein, 365 aa, Homo sapiens; identical to SEQ ID NO: 83439
  Payload ID: 16600
  Gene Symbol: SGMS2
  Gene Name: sphingomyelin synthase 2
  Uniprot ID: Q8NHU3
  ENSP ID: ENSP00000378176

SEQ ID NO: 83441 - protein, 365 aa, Homo sapiens; identical to SEQ ID NO: 83439
  Payload ID: 16600
  Gene Symbol: SGMS2
  Gene Name: sphingomyelin synthase 2
  Uniprot ID: Q8NHU3
  ENSP ID: ENSP00000378178

SEQ ID NO: 83442 - protein, 125 aa, Homo sapiens
  Payload ID: 16600
  Gene Symbol: SGMS2
  Gene Name: sphingomyelin synthase 2
  ENSP ID: ENSP00000428176
MYVTTLPVPGMHFQCAPKLNGDSQAKVQRILRLISGGGLSITGSHILCGDFLFSGHTVTLTLTYLFIKEYSPRHFWWYHLICWLLSAAGIICILVAHEHYTIDVIIAYYITTRLFWWYHSMANEK

SEQ ID NO: 83443 - protein, 34 aa, Homo sapiens
  Payload ID: 16600
  Gene Symbol: SGMS2
  Gene Name: sphingomyelin synthase 2
  ENSP ID: ENSP00000428294
MDIIETAKLEEHLENQPSDPTNTYARPAEPVEEE

SEQ ID NO: 83444 - protein, 44 aa, Homo sapiens
  Payload ID: 16600
  Gene Symbol: SGMS2
  Gene Name: sphingomyelin synthase 2
  ENSP ID: ENSP00000430172
MDIIETAKLEEHLENQPSDPTNTYARPAEPVEEENKNGNGKPKS

SEQ ID NO: 83445 - protein, 470 aa, Homo sapiens
  Payload ID: 16601
  Gene Symbol: SPHK1
  Gene Name: sphingosine kinase 1
  Uniprot ID: Q9NYA1
  ENSP ID: ENSP00000313681
MSAQVLGFLRSWTPLPLAAPRGPAAAGNDAGAPAATAPGGEGEPHSRPCDARLGSTDKELKAGAAATGSAPTAPGTPWQREPRVEVMDPAGGPRGVLPRPCRVLVLLNPRGGKGKALQLFRSHVQPLLAEAEISFTLMLTERRNHARELVRSEELGRWDALVVMSGDGLMHEVVNGLMERPDWETAIQKPLCSLPAGSGNALAASLNHYAGYEQVTNEDLLTNCTLLLCRRLLSPMNLLSLHTASGLRLFSVLSLAWGFIADVDLESEKYRRLGEMRFTLGTFLRLAALRTYRGRLAYLPVGRVGSKTPASPVVVQQGPVDAHLVPLEEPVPSHWTVVPDEDFVLVLALLHSHLGSEMFAAPMGRCAAGVMHLFYVRAGVSRAMLLRLFLAMEKGRHMEYECPYLVYVPVVAFRLEPKDGKGVFAVDGELMVSEAVQGQVHPNYFWMVSGCVEPPPSWKPQQMPPPEEPL

SEQ ID NO: 83446 - protein, 384 aa, Homo sapiens
  Payload ID: 16601
  Gene Symbol: SPHK1
  Gene Name: sphingosine kinase 1
  Uniprot ID: Q9NYA1
  ENSP ID: ENSP00000376285
MDPAGGPRGVLPRPCRVLVLLNPRGGKGKALQLFRSHVQPLLAEAEISFTLMLTERRNHARELVRSEELGRWDALVVMSGDGLMHEVVNGLMERPDWETAIQKPLCSLPAGSGNALAASLNHYAGYEQVTNEDLLTNCTLLLCRRLLSPMNLLSLHTASGLRLFSVLSLAWGFIADVDLESEKYRRLGEMRFTLGTFLRLAALRTYRGRLAYLPVGRVGSKTPASPVVVQQGPVDAHLVPLEEPVPSHWTVVPDEDFVLVLALLHSHLGSEMFAAPMGRCAAGVMHLFYVRAGVSRAMLLRLFLAMEKGRHMEYECPYLVYVPVVAFRLEPKDGKGVFAVDGELMVSEAVQGQVHPNYFWMVSGCVEPPPSWKPQQMPPPEEPL

SEQ ID NO: 83447 - protein, 384 aa, Homo sapiens; identical to SEQ ID NO: 83446
  Payload ID: 16601
  Gene Symbol: SPHK1
  Gene Name: sphingosine kinase 1
  Uniprot ID: Q9NYA1
  ENSP ID: ENSP00000440970

SEQ ID NO: 83448 - protein, 111 aa, Homo sapiens
  Payload ID: 16601
  Gene Symbol: SPHK1
  Gene Name: sphingosine kinase 1
  ENSP ID: ENSP00000465002
MDPAGGPRGVLPRPCRVLVLLNPRGGKGKALQLFRSHVQPLLAEAEISFTLMLTERRNHARELVRSEELGRWDALVVMSGDGLMHEVVNGLMERPDWETAIQKPLCSLPAG

SEQ ID NO: 83449 - protein, 384 aa, Homo sapiens; identical to SEQ ID NO: 83446
  Payload ID: 16601
  Gene Symbol: SPHK1
  Gene Name: sphingosine kinase 1
  Uniprot ID: Q9NYA1
  ENSP ID: ENSP00000465726

SEQ ID NO: 83450 - protein, 152 aa, Homo sapiens
  Payload ID: 16601
  Gene Symbol: SPHK1
  Gene Name: sphingosine kinase 1
  ENSP ID: ENSP00000466422
MDPAGGPRGVLPRPCRVLVLLNPRGGKGKALQLFRSHVQPLLAEAEISFTLMLTERRNHARELVRSEELGRWDALVVMSGDGLMHEVVNGLMERPDWETAIQKPLCSLPAGSGNALAASLNHYAGYEQVTNEDLLTNCTLLLCRRLLSPMNL

SEQ ID NO: 83451 - protein, 5 aa, Homo sapiens
  Payload ID: 16601
  Gene Symbol: SPHK1
  Gene Name: sphingosine kinase 1
  ENSP ID: ENSP00000468474
MDPAG

SEQ ID NO: 83452 - protein, 398 aa, Homo sapiens
  Payload ID: 16601
  Gene Symbol: SPHK1
  Gene Name: sphingosine kinase 1
  Uniprot ID: Q9NYA1
  ENSP ID: ENSP00000468547
MDPVVGCGRGLFGFVFSAGGPRGVLPRPCRVLVLLNPRGGKGKALQLFRSHVQPLLAEAEISFTLMLTERRNHARELVRSEELGRWDALVVMSGDGLMHEVVNGLMERPDWETAIQKPLCSLPAGSGNALAASLNHYAGYEQVTNEDLLTNCTLLLCRRLLSPMNLLSLHTASGLRLFSVLSLAWGFIADVDLESEKYRRLGEMRFTLGTFLRLAALRTYRGRLAYLPVGRVGSKTPASPVVVQQGPVDAHLVPLEEPVPSHWTVVPDEDFVLVLALLHSHLGSEMFAAPMGRCAAGVMHLFYVRAGVSRAMLLRLFLAMEKGRHMEYECPYLVYVPVVAFRLEPKDGKGVFAVDGELMVSEAVQGQVHPNYFWMVSGCVEPPPSWKPQQMPPPEEPL

SEQ ID NO: 83453 - protein, 654 aa, Homo sapiens
  Payload ID: 16602
  Gene Symbol: SPHK2
  Gene Name: sphingosine kinase 2
  Uniprot ID: Q9NRA0
  ENSP ID: ENSP00000245222
MNGHLEAEEQQDQRPDQELTGSWGHGPRSTLVRAKAMAPPPPPLAASTPLLHGEFGSYPARGPRFALTLTSQALHIQRLRPKPEARPRGGLVPLAEVSGCCTLRSRSPSDSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGGFEPALGLDLLLNCSLLLCRGGGHPLDLLSVTLASGSRCFSFLSVAWGFVSDVDIQSERFRALGSARFTLGTVLGLATLHTYRGRLSYLPATVEPASPTPAHSLPRAKSELTLTPDPAPPMAHSPLHRSVSDLPLPLPQPALASPGSPEPLPILSLNGGGPELAGDWGGAGDAPLSPDPLLSSPPGSPKAALHSPVSEGAPVIPPSSGLPLPTPDARVGASTCGPPDHLLPPLGTPLPPDWVTLEGDFVLMLAISPSHLGADLVAAPHARFDDGLVHLCWVRSGISRAALLRLFLAMERGSHFSLGCPQLGYAAARAFRLEPLTPRGVLTVDGEQVEYGPLQAQMHPGIGTLLTGPPGCPGREP

SEQ ID NO: 83454 - protein, 448 aa, Homo sapiens
  Payload ID: 16602
  Gene Symbol: SPHK2
  Gene Name: sphingosine kinase 2
  ENSP ID: ENSP00000341091
MISEAGLSFNLIQTERQNHARELVQGLSLSEWDGIVTVSGDGLLHEVLNGLLDRPDWEEAVKMPVGILPCGSGNALAGAVNQHGGFEPALGLDLLLNCSLLLCRGGGHPLDLLSVTLASGSRCFSFLSVAWGFVSDVDIQSERFRALGSARFTLGTVLGLATLHTYRGRLSYLPATVEPASPTPAHSLPRAKSELTLTPDPAPPMAHSPLHRSVSDLPLPLPQPALASPGSPEPLPILSLNGGGPELAGDWGGAGDAPLSPDPLLSSPPGSPKAALHSPVSEGAPVIPPSSGLPLPTPDARVGASTCGPPDHLLPPLGTPLPPDWVTLEGDFVLMLAISPSHLGADLVAAPHARFDDGLVHLCWVRSGISRAALLRLFLAMERGSHFSLGCPQLGYAAARAFRLEPLTPRGVLTVDGEQVEYGPLQAQMHPGIGTLLTGPPGCPGREP

SEQ ID NO: 83455 - protein, 49 aa, Homo sapiens
  Payload ID: 16602
  Gene Symbol: SPHK2
  Gene Name: sphingosine kinase 2
  ENSP ID: ENSP00000410044
MNGHLEAEEQQDQRSPLTCYLGRPGCFYWSIPLGVGAWPGSGVRTTCFP

SEQ ID NO: 83456 - protein, 654 aa, Homo sapiens; identical to SEQ ID NO: 83453
  Payload ID: 16602
  Gene Symbol: SPHK2
  Gene Name: sphingosine kinase 2
  Uniprot ID: Q9NRA0
  ENSP ID: ENSP00000469158

SEQ ID NO: 83457 - protein, 133 aa, Homo sapiens
  Payload ID: 16602
  Gene Symbol: SPHK2
  Gene Name: sphingosine kinase 2
  ENSP ID: ENSP00000469448
MAPPPPPLAASTPLLHGEFGSYPARGPRFALTLTSQALHIQRLRPKPEARPRGGLVPLAEVSGCCTLRSRSPSDSAAYFCIYTYPRGRRGARRRATRTFRADGAATYEENRAEAQRWATALTCLLRGLPLPGD

SEQ ID NO: 83458 - protein, 595 aa, Homo sapiens
  Payload ID: 16602
  Gene Symbol: SPHK2
  Gene Name: sphingosine kinase 2
  Uniprot ID: Q9NRA0
  ENSP ID: ENSP00000470092
MNGHLEAEEQQDQALHIQRLRPKPEARPRGGLVPLAEVSGCCTLRSRSPSDSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGGFEPALGLDLLLNCSLLLCRGGGHPLDLLSVTLASGSRCFSFLSVAWGFVSDVDIQSERFRALGSARFTLGTVLGLATLHTYRGRLSYLPATVEPASPTPAHSLPRAKSELTLTPDPAPPMAHSPLHRSVSDLPLPLPQPALASPGSPEPLPILSLNGGGPELAGDWGGAGDAPLSPDPLLSSPPGSPKAALHSPVSEGAPVIPPSSGLPLPTPDARVGASTCGPPDHLLPPLGTPLPPDWVTLEGDFVLMLAISPSHLGADLVAAPHARFDDGLVHLCWVRSGISRAALLRLFLAMERGSHFSLGCPQLGYAAARAFRLEPLTPRGVLTVDGEQVEYGPLQAQMHPGIGTLLTGPPGCPGREP

SEQ ID NO: 83459 - protein, 72 aa, Homo sapiens
  Payload ID: 16602
  Gene Symbol: SPHK2
  Gene Name: sphingosine kinase 2
  ENSP ID: ENSP00000470679
MAPPPPPLAASTPLLHGEFGSYPARGPRFALTLTSQALHIQRLRPKPEARPRGGLVPLAEVSGCCTLRSRSP

SEQ ID NO: 83460 - protein, 349 aa, Homo sapiens
  Payload ID: 16602
  Gene Symbol: SPHK2
  Gene Name: sphingosine kinase 2
  ENSP ID: ENSP00000471111
MAPPPPPLAASTPLLHGEFGSYPARGPRFALTLTSQALHIQRLRPKPEARPRGGLVPLAEVSGCCTLRSRSPSDSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGGPREDSDSSTSSSACPLWTTARSCPRAAASMPGSCPLLPQQLALGFSRFIQDRVNGGGGRIGSLTCRGHTQRTLPAPAREGGGSLFLKNINVFIC

SEQ ID NO: 83461 - protein, 255 aa, Homo sapiens
  Payload ID: 16602
  Gene Symbol: SPHK2
  Gene Name: sphingosine kinase 2
  ENSP ID: ENSP00000471180
MAPPPPPLAASTPLLHGEFGSYPARGPRFALTLTSQALHIQRLRPKPEARPRGGLVPLAEVSGCCTLRSRSPSDSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGG

SEQ ID NO: 83462 - protein, 618 aa, Homo sapiens
  Payload ID: 16602
  Gene Symbol: SPHK2
  Gene Name: sphingosine kinase 2
  Uniprot ID: Q9NRA0
  ENSP ID: ENSP00000471205
MAPPPPPLAASTPLLHGEFGSYPARGPRFALTLTSQALHIQRLRPKPEARPRGGLVPLAEVSGCCTLRSRSPSDSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGGFEPALGLDLLLNCSLLLCRGGGHPLDLLSVTLASGSRCFSFLSVAWGFVSDVDIQSERFRALGSARFTLGTVLGLATLHTYRGRLSYLPATVEPASPTPAHSLPRAKSELTLTPDPAPPMAHSPLHRSVSDLPLPLPQPALASPGSPEPLPILSLNGGGPELAGDWGGAGDAPLSPDPLLSSPPGSPKAALHSPVSEGAPVIPPSSGLPLPTPDARVGASTCGPPDHLLPPLGTPLPPDWVTLEGDFVLMLAISPSHLGADLVAAPHARFDDGLVHLCWVRSGISRAALLRLFLAMERGSHFSLGCPQLGYAAARAFRLEPLTPRGVLTVDGEQVEYGPLQAQMHPGIGTLLTGPPGCPGREP

SEQ ID NO: 83463 - protein, 663 aa, Homo sapiens
  Payload ID: 16602
  Gene Symbol: SPHK2
  Gene Name: sphingosine kinase 2
  ENSP ID: ENSP00000472983
MAPPPPPLAASTPLLHGEFGSYPARGPRFALTLTSQALHIQRLRPKPEARPRGGLVPLAEVSGCCTLRSRSPSDSAAYFCIYTYPRGRRGARRRATRTFRADGAATYEENRAEAQRWATALTCLLRGLPLPGDGEITPDLLPRPPRLLLLVNPFGGRGLAWQWCKNHVLPMISEAGLSFNLIQTERQNHARELVQGLSLSEWDGIVTVSGDGLLHEVLNGLLDRPDWEEAVKMPVGILPCGSGNALAGAVNQHGGFEPALGLDLLLNCSLLLCRGGGHPLDLLSVTLASGSRCFSFLSVAWGFVSDVDIQSERFRALGSARFTLGTVLGLATLHTYRGRLSYLPATVEPASPTPAHSLPRAKSELTLTPDPAPPMAHSPLHRSVSDLPLPLPQPALASPGSPEPLPILSLNGGGPELAGDWGGAGDAPLSPDPLLSSPPGSPKAALHSPVSEGAPVIPPSSGLPLPTPDARVGASTCGPPDHLLPPLGTPLPPDWVTLEGDFVLMLAISPSHLGADLVAAPHARFDDGLVHLCWVRSGISRAALLRLFLAMERGSHFSLGCPQLGYAAARAFRLEPLTPRGVLTVDGEQVEYGPLQAQMHPGIARGRTQTPALPAAPALYGRQPGAAHGLQPVCQGAALFFHNSWLWGSQDLFRIVLTEAVGG

SEQ ID NO: 83464 - protein, 202 aa, Homo sapiens
  Payload ID: 16603
  Gene Symbol: SGPL1
  Gene Name: sphingosine-1-phosphate lyase 1
  ENSP ID: ENSP00000299297
ILEVYSTKAKNYVNGHCTKYEPWQLIAWSVVWTLLIVWGYEFVFQPESLWSRFKKKCFKLTRKMPIIGRKIQDKLNKTKDDISKNMSFLKVDKEYVKALPSQGLSSSAVLEKLKEYSSMDAFWQEGRASGTVYSGEEKLTELLVKAYGDFAWSNPLHPDIFPGLRKIEAEIVRIACSLFNGGPDSCGCEALFLFCFSNMLAP

SEQ ID NO: 83465 - protein, 568 aa, Homo sapiens
  Payload ID: 16603
  Gene Symbol: SGPL1
  Gene Name: sphingosine-1-phosphate lyase 1
  Uniprot ID: O95470
  ENSP ID: ENSP00000362298
MPSTDLLMLKAFEPYLEILEVYSTKAKNYVNGHCTKYEPWQLIAWSVVWTLLIVWGYEFVFQPESLWSRFKKKCFKLTRKMPIIGRKIQDKLNKTKDDISKNMSFLKVDKEYVKALPSQGLSSSAVLEKLKEYSSMDAFWQEGRASGTVYSGEEKLTELLVKAYGDFAWSNPLHPDIFPGLRKIEAEIVRIACSLFNGGPDSCGCVTSGGTESILMACKAYRDLAFEKGIKTPEIVAPQSAHAAFNKAASYFGMKIVRVPLTKMMEVDVRAMRRAISRNTAMLVCSTPQFPHGVIDPVPEVAKLAVKYKIPLHVDACLGGFLIVFMEKAGYPLEHPFDFRVKGVTSISADTHKYGYAPKGSSLVLYSDKKYRNYQFFVDTDWQGGIYASPTIAGSRPGGISAACWAALMHFGENGYVEATKQIIKTARFLKSELENIKGIFVFGNPQLSVIALGSRDFDIYRLSNLMTAKGWNLNQLQFPPSIHFCITLLHARKRVAIQFLKDIRESVTQIMKNPKAKTTGMGAIYGMAQTTVDRNMVAELSSVFLDSLYSTDTVTQGSQMNGSPKPH

SEQ ID NO: 83466 - protein, 135 aa, Homo sapiens
  Payload ID: 16603
  Gene Symbol: SGPL1
  Gene Name: sphingosine-1-phosphate lyase 1
  ENSP ID: ENSP00000386549
  MOD_RES (1)..(1): Any amino acid
XIQDKLNKTKDDISKNMSFLKVDKEYVKALPSQGLSSSAVLEKLKEYSSMDAFWQEGRASGTVYSGEEKLTELLVKAYGDFAWSNPLHPDIFPGLRKIEAEIVRIACSLFNGGPDSCGCVSICKGHPIALFFRLK

SEQ ID NO: 83467 - protein, 441 aa, Homo sapiens
  Payload ID: 16604
  Gene Symbol: SGPP1
  Gene Name: sphingosine-1-phosphate phosphatase 1
  Uniprot ID: Q9BX95
  ENSP ID: ENSP00000247225
MSLRQRLAQLVGRLQDPQKVARFQRLCGVEAPPRRSADRREDEKAEAPLAGDPRLRGRQPGAPGGPQPPGSDRNQCPAKPDGGGAPNGVRNGLAAELGPASPRRAGALRRNSLTGEEGQLARVSNWPLYCLFCFGTELGNELFYILFFPFWIWNLDPLVGRRLVVIWVLVMYLGQCTKDIIRWPRPASPPVVKLEVFYNSEYSMPSTHAMSGTAIPISMVLLTYGRWQYPLIYGLILIPCWCSLVCLSRIYMGMHSILDIIAGFLYTILILAVFYPFVDLIDNFNQTHKYAPFIIIGLHLALGIFSFTLDTWSTSRGDTAEILGSGAGIACGSHVTYNMGLVLDPSLDTLPLAGPPITVTLFGKAILRILIGMVFVLIIRDVMKKITIPLACKIFNIPCDDIRKARQHMEVELPYRYITYGMVGFSITFFVPYIFFFIGIS

SEQ ID NO: 83468 - protein, 399 aa, Homo sapiens
  Payload ID: 16605
  Gene Symbol: SGPP2
  Gene Name: sphingosine-1-phosphate phosphatase 2
  Uniprot ID: Q8IWX5
  ENSP ID: ENSP00000315137
MAELLRSLQDSQLVARFQRRCGLFPAPDEGPRENGADPTERAARVPGVEHLPAANGKGGEAPANGLRRAAAPEAYVQKYVVKNYFYYYLFQFSAALGQEVFYITFLPFTHWNIDPYLSRRLIIIWVLVMYIGQVAKDVLKWPRPSSPPVVKLEKRLIAEYGMPSTHAMAATAIAFTLLISTMDRYQYPFVLGLVMAVVFSTLVCLSRLYTGMHTVLDVLGGVLITALLIVLTYPAWTFIDCLDSASPLFPVCVIVVPFFLCYNYPVSDYYSPTRADTTTILAAGAGVTIGFWINHFFQLVSKPAESLPVIQNIPPLTTYMLVLGLTKFAVGIVLILLVRQLVQNLSLQVLYSWFKVVTRNKEARRRLEIEVPYKFVTYTSVGICATTFVPMLHRFLGLP

SEQ ID NO: 83469 - protein, 382 aa, Homo sapiens
  Payload ID: 16606
  Gene Symbol: S1PR1
  Gene Name: sphingosine-1-phosphate receptor 1
  Uniprot ID: P21453
  ENSP ID: ENSP00000305416
MGPTSVPLVKAHRSSVSDYVNYDIIVRHYNYTGKLNISADKENSIKLTSVVFILICCFIILENIFVLLTIWKTKKFHRPMYYFIGNLALSDLLAGVAYTANLLLSGATTYKLTPAQWFLREGSMFVALSASVFSLLAIAIERYITMLKMKLHNGSNNFRLFLLISACWVISLILGGLPIMGWNCISALSSCSTVLPLYHKHYILFCTTVFTLLLLSIVILYCRIYSLVRTRSRRLTFRKNISKASRSSEKSLALLKTVIIVLSVFIACWAPLFILLLLDVGCKVKTCDILFRAEYFLVLAVLNSGTNPIIYTLTNKEMRRAFIRIMSCCKCPSGDSAGKFKRPIIAGMEFSRSKSDNSSHPQKDEGDNPETIMSSGNVNSSS

SEQ ID NO: 83470 - protein, 353 aa, Homo sapiens
  Payload ID: 16607
  Gene Symbol: S1PR2
  Gene Name: sphingosine-1-phosphate receptor 2
  Uniprot ID: O95136
  ENSP ID: ENSP00000466933
MGSLYSEYLNPNKVQEHYNYTKETLETQETTSRQVASAFIVILCCAIVVENLLVLIAVARNSKFHSAMYLFLGNLAASDLLAGVAFVANTLLSGSVTLRLTPVQWFAREGSAFITLSASVFSLLAIAIERHVAIAKVKLYGSDKSCRMLLLIGASWLISLVLGGLPILGWNCLGHLEACSTVLPLYAKHYVLCVVTIFSIILLAIVALYVRIYCVVRSSHADMAAPQTLALLKTVTIVLGVFIVCWLPAFSILLLDYACPVHSCPILYKAHYFFAVSTLNSLLNPVIYTWRSRDLRREVLRPLQCWRPGVGVQGRRRGGTPGHHLLPLRSSSSLERGMHMPTSPTFLEGNTVV

SEQ ID NO: 83471 - protein, 378 aa, Homo sapiens
  Payload ID: 16608
  Gene Symbol: S1PR3
  Gene Name: sphingosine-1-phosphate receptor 3
  Uniprot ID: Q99500
  ENSP ID: ENSP00000350878
MATALPPRLQPVRGNETLREHYQYVGKLAGRLKEASEGSTLTTVLFLVICSFIVLENLMVLIAIWKNNKFHNRMYFFIGNLALCDLLAGIAYKVNILMSGKKTFSLSPTVWFLREGSMFVALGASTCSLLAIAIERHLTMIKMRPYDANKRHRVFLLIGMCWLIAFTLGALPILGWNCLHNLPDCSTILPLYSKKYIAFCISIFTAILVTIVILYARIYFLVKSSSRKVANHNNSERSMALLRTVVIVVSVFIACWSPLFILFLIDVACRVQACPILFKAQWFIVLAVLNSAMNPVIYTLASKEMRRAFFRLVCNCLVRGRGARASPIQPALDPSRSKSSSSNNSSHSPKVKEDLPHTAPSSCIMDKNAALQNGIFCN

SEQ ID NO: 83472 - protein, 378 aa, Homo sapiens; identical to SEQ ID NO: 83471
  Payload ID: 16608
  Gene Symbol: S1PR3
  Gene Name: sphingosine-1-phosphate receptor 3
  Uniprot ID: Q99500
  ENSP ID: ENSP00000365006

SEQ ID NO: 83473 - protein, 384 aa, Homo sapiens
  Payload ID: 16609
  Gene Symbol: S1PR4
  Gene Name: sphingosine-1-phosphate receptor 4
  Uniprot ID: O95977
  ENSP ID: ENSP00000246115
MNATGTPVAPESCQQLAAGGHSRLIVLHYNHSGRLAGRGGPEDGGLGALRGLSVAASCLVVLENLLVLAAITSHMRSRRWVYYCLVNITLSDLLTGAAYLANVLLSGARTFRLAPAQWFLREGLLFTALAASTFSLLFTAGERFATMVRPVAESGATKTSRVYGFIGLCWLLAALLGMLPLLGWNCLCAFDRCSSLLPLYSKRYILFCLVIFAGVLATIMGLYGAIFRLVQASGQKAPRPAARRKARRLLKTVLMILLAFLVCWGPLFGLLLADVFGSNLWAQEYLRGMDWILALAVLNSAVNPIIYSFRSREVCRAVLSFLCCGCLRLGMRGPGDCLARAVEAHSGASTTDSSLRPRDSFRGSRSLSFRMREPLSSISSVRSI

SEQ ID NO: 83474 - protein, 398 aa, Homo sapiens
  Payload ID: 16610
  Gene Symbol: S1PR5
  Gene Name: sphingosine-1-phosphate receptor 5
  Uniprot ID: Q9H228
  ENSP ID: ENSP00000328472
MESGLLRPAPVSEVIVLHYNYTGKLRGARYQPGAGLRADAVVCLAVCAFIVLENLAVLLVLGRHPRFHAPMFLLLGSLTLSDLLAGAAYAANILLSGPLTLKLSPALWFAREGGVFVALTASVLSLLAIALERSLTMARRGPAPVSSRGRTLAMAAAAWGVSLLLGLLPALGWNCLGRLDACSTVLPLYAKAYVLFCVLAFVGILAAICALYARIYCQVRANARRLPARPGTAGTTSTRARRKPRSLALLRTLSVVLLAFVACWGPLFLLLLLDVACPARTCPVLLQADPFLGLAMANSLLNPIIYTLTNRDLRHALLRLVCCGRHSCGRDPSGSQQSASAAEASGGLRRCLPPGLDGSFSGSERSSPQRDGLDTSGSTGSPGAPTAARTLVSEPAAD

SEQ ID NO: 83475 - protein, 398 aa, Homo sapiens; identical to SEQ ID NO: 83474
  Payload ID: 16610
  Gene Symbol: S1PR5
  Gene Name: sphingosine-1-phosphate receptor 5
  Uniprot ID: Q9H228
  ENSP ID: ENSP00000416915

SEQ ID NO: 83476 - protein, 75 aa, Homo sapiens
  Payload ID: 16610
  Gene Symbol: S1PR5
  Gene Name: sphingosine-1-phosphate receptor 5
  ENSP ID: ENSP00000464884
MCNPVSLYLGSPPPAWPWGARPMESGLLRPAPVSEVIVLHYNYTGKLRGARYQPGAGLRADAVVCLAVCAFIVLE

SEQ ID NO: 83477 - protein, 254 aa, Homo sapiens
  Payload ID: 16610
  Gene Symbol: S1PR5
  Gene Name: sphingosine-1-phosphate receptor 5
  ENSP ID: ENSP00000481239
MESGLLRPAPVSEVIVLHYNYTGKLRGARYQPGAGLRADAVVCLAVCAFIVLENLAVLLVLGRHPRFHAPMFLLLGSLTLSDLARPGTAGTTSTRARRKPRSLALLRTLSVVLLAFVACWGPLFLLLLLDVACPARTCPVLLQADPFLGLAMANSLLNPIIYTLTNRDLRHALLRLVCCGRHSCGRDPSGSQQSASAAEASGGLRRCLPPGLDGSFSGSERSSPQRDGLDTSGSTGSPGAPTAARTLVSEPAAD

SEQ ID NO: 83478 - protein, 1671 aa, Homo sapiens
  Payload ID: 16611
  Gene Symbol: SPHKAP
  Gene Name: SPHK1 interactor, AKAP domain containing
  Uniprot ID: Q2M3C7
  ENSP ID: ENSP00000339886
MDGNSLLSVPSNLESSRMYDVLEPQQGRGCGSSGSGPGNSITACKKVLRSNSLLESTDYWLQNQRMPCQIGFVEDKSENCASVCFVNLDVNKDECSTEHLQQKLVNVSPDLPKLISSMNVQQPKENEIVVLSGLASGNLQADFEVSQCPWLPDICLVQCARGNRPNSTNCIIFEINKFLIGLELVQERQLHLETNILKLEDDTNCSLSSIEEDFLTASEHLEEESEVDESRNDYENINVSANVLESKQLKGATQVEWNCNKEKWLYALEDKYINKYPTPLIKTERSPENLTKNTALQSLDPSAKPSQWKREAVGNGRQATHYYHSEAFKGQMEKSQALYIPKDAYFSMMDKDVPSACAVAEQRSNLNPGDHEDTRNALPPRQDGEVTTGKYATNLAESVLQDAFIRLSQSQSTLPQESAVSVSVGSSLLPSCYSTKDTVVSRSWNELPKIVVVQSPDGSDAAPQPGISSWPEMEVSVETSSILSGENSSRQPQSALEVALACAATVIGTISSPQATERLKMEQVVSNFPPGSSGALQTQAPQGLKEPSINEYSFPSALCGMTQVASAVAVCGLGEREEVTCSVAPSGSLPPAAEASEAMPPLCGLASMELGKEAIAKGLLKEAALVLTRPNTYSSIGDFLDSMNRRIMETASKSQTLCSENVVRNELAHTLSNVILRHSIDEVHHKNMIIDPNDNRHSSEILDTLMESTNQLLLDVICFTFKKMSHIVRLGECPAVLSKETIRRRETEPSCQPSDPGASQAWTKATESSSSSPLSNSHNTSLVINNLVDGMYSKQDKGGVRPGLFKNPTLQSQLSRSHRVPDSSTATTSSKEIYLKGIAGEDTKSPHHSENECRASSEGQRSPTVSQSRSGSQEAEESIHPNTQEKYNCATSRINEVQVNLSLLGDDLLLPAQSTLQTKHPDIYCITDFAEELADTVVSMATEIAAICLDNSSGKQPWFCAWKRGSEFLMTPNVPCRSLKRKKESQGSGTAVRKHKPPRLSEIKRKTDEHPELKEKLMNRVVDESMNLEDVPDSVNLFANEVAAKIMNLTEFSMVDGMWQAQGYPRNRLLSGDRWSRLKASSCESIPEEDSEARAYVNSLGLMSTLSQPVSRASSVSKQSSCESITDEFSRFMVNQMENEGRGFELLLDYYAGKNASSILNSAMQQACRKSDHLSVRPSCPSKQSSTESITEEFYRYMLRDIERDSRESASSRRSSQDWTAGLLSPSLRSPVCHRQSSMPDSRSPCSRLTVNVPIKANSLDGFAQNCPQDFLSVQPVSSASSSGLCKSDSCLYRRGGTDHITNMLIHETWASSIEALMRKNKIIVDDAEEADTEPVSGGSPSQAEKCANRLAASRMCSGPTLLVQESLDCPRKDSVTECKQPPVSSLSKTASLTNHSPLDSKKETSSCQDPVPINHKRRSLCSREVPLIQIETDQREACAGEPEPFLSKSSLLEEAEGHSNDKNIPDVVRGGDTAVSACQIHSDSLDTRDVPEAEASTEARAPDEAPNPPSSSEESTGSWTQLANEEDNPDDTSSFLQLSERSMSELVEEKKILKGQSESTEAPASGPPTGTASPQRSLLVINFDLEPECPDAELRATLQWIAASELGIPTIYFKKSQENRIEKFLDVVQLVHRKSWKVGDIFHAVVQYCKMHEEQKDGRLSLFDWLLELG

SEQ ID NO: 83479 - protein, 1700 aa, Homo sapiens
  Payload ID: 16611
  Gene Symbol: SPHKAP
  Gene Name: SPHK1 interactor, AKAP domain containing
  Uniprot ID: Q2M3C7
  ENSP ID: ENSP00000375909
MDGNSLLSVPSNLESSRMYDVLEPQQGRGCGSSGSGPGNSITACKKVLRSNSLLESTDYWLQNQRMPCQIGFVEDKSENCASVCFVNLDVNKDECSTEHLQQKLVNVSPDLPKLISSMNVQQPKENEIVVLSGLASGNLQADFEVSQCPWLPDICLVQCARGNRPNSTNCIIFEINKFLIGLELVQERQLHLETNILKLEDDTNCSLSSIEEDFLTASEHLEEESEVDESRNDYENINVSANVLESKQLKGATQVEWNCNKEKWLYALEDKYINKYPTPLIKTERSPENLTKNTALQSLDPSAKPSQWKREAVGNGRQATHYYHSEAFKGQMEKSQALYIPKDAYFSMMDKDVPSACAVAEQRSNLNPGDHEDTRNALPPRQDGEVTTGKYATNLAESVLQDAFIRLSQSQSTLPQESAVSVSVGSSLLPSCYSTKDTVVSRSWNELPKIVVVQSPDGSDAAPQPGISSWPEMEVSVETSSILSGENSSRQPQSALEVALACAATVIGTISSPQATERLKMEQVVSNFPPGSSGALQTQAPQGLKEPSINEYSFPSALCGMTQVASAVAVCGLGEREEVTCSVAPSGSLPPAAEASEAMPPLCGLASMELGKEAIAKGLLKEAALVLTRPNTYSSIGDFLDSMNRRIMETASKSQTLCSENVVRNELAHTLSNVILRHSIDEVHHKNMIIDPNDNRHSSEILDTLMESTNQLLLDVICFTFKKMSHIVRLGECPAVLSKETIRRRETEPSCQPSDPGASQAWTKATESSSSSPLSNSHNTSLVINNLVDGMYSKQDKGGVRPGLFKNPTLQSQLSRSHRVPDSSTATTSSKEIYLKGIAGEDTKSPHHSENECRASSEGQRSPTVSQSRSGSQEAEESIHPNTQEKYNCATSRINEVQVNLSLLGDDLLLPAQSTLQTKHPDIYCITDFAEELADTVVSMATEIAAICLDNSSGKQPWFCAWKRGSEFLMTPNVPCRSLKRKKESQGSGTAVRKHKPPRLSEIKRKTDEHPELKEKLMNRVVDESMNLEDVPDSVNLFANEVAAKIMNLTEFSMVDGMWQAQGYPRNRLLSGDRWSRLKASSCESIPEEDSEARAYVNSLGLMSTLSQPVSRASSVSKQSSCESITDEFSRFMVNQMENEGRGFELLLDYYAGKNASSILNSAMQQACRKSDHLSVRPSCPSKQSSTESITEEFYRYMLRDIERDSRESASSRRSSQDWTAGLLSPSLRSPVCHRQSSMPDSRSPCSRLTVNVPIKANSLDGFAQNCPQDFLSVQPVSSASSSGLCKSDSCLYRRGGTDHITNMLIHETWASSIEALMRKNKIIVDDAEEADTEPVSGGSPSQAEKCANRLAASRMCSGPTLLVQESLDCPRKDSVTECKQPPVSSLSKTASLTNHSPLDSKKETSSCQDPVPINHKRRSLCSREVPLIQIETDQREACAGEPEPFLSKSSLLEEAEGHSNDKNIPDVVRGGDTAVSACQIHSDSLDTRDVPEAEASTEARAPDEAPNPPSSSEESTGSWTQLANEEDNPDDTSSFLQLSERSMSNGNSSATSSLGIMDLDIYQESMPSSPMINELVEEKKILKGQSESTEAPASGPPTGTASPQRSLLVINFDLEPECPDAELRATLQWIAASELGIPTIYFKKSQENRIEKFLDVVQLVHRKSWKVGDIFHAVVQYCKMHEEQKDGRLSLFDWLLELG

SEQ ID NO: 83480 - protein, 271 aa, Homo sapiens
  Payload ID: 16612
  Gene Symbol: SPI1
  Gene Name: Spi-1 proto-oncogene
  Uniprot ID: P17947
  ENSP ID: ENSP00000227163
MLQACKMEGFPLVPPQPSEDLVPYDTDLYQRQTHEYYPYLSSDGESHSDHYWDFHPHHVHSEFESFAENNFTELQSVQPPQLQQLYRHMELEQMHVLDTPMVPPHPSLGHQVSYLPRMCLQYPSLSPAQPSSDEEEGERQSPPLEVSDGEADGLEPGPGLLPGETGSKKKIRLYQFLLDLLRSGDMKDSIWWVDKDKGTFQFSSKHKEALAHRWGIQKGNRKKMTYQKMARALRNYGKTGEVKKVKKKLTYQFSGEVLGRGGLAERRHPPH

SEQ ID NO: 83481 - protein, 270 aa, Homo sapiens
  Payload ID: 16612
  Gene Symbol: SPI1
  Gene Name: Spi-1 proto-oncogene
  Uniprot ID: P17947
  ENSP ID: ENSP00000367799
MLQACKMEGFPLVPPPSEDLVPYDTDLYQRQTHEYYPYLSSDGESHSDHYWDFHPHHVHSEFESFAENNFTELQSVQPPQLQQLYRHMELEQMHVLDTPMVPPHPSLGHQVSYLPRMCLQYPSLSPAQPSSDEEEGERQSPPLEVSDGEADGLEPGPGLLPGETGSKKKIRLYQFLLDLLRSGDMKDSIWWVDKDKGTFQFSSKHKEALAHRWGIQKGNRKKMTYQKMARALRNYGKTGEVKKVKKKLTYQFSGEVLGRGGLAERRHPPH

SEQ ID NO: 83482 - protein, 245 aa, Homo sapiens
  Payload ID: 16612
  Gene Symbol: SPI1
  Gene Name: Spi-1 proto-oncogene
  ENSP ID: ENSP00000438846
MLQACKMEGFPLVPPPSEDLVPYDTDLYQRQTHEYYPYLSSDGESHSDHYWDFHPHHVHSEFESFAENNFTELQSVQPPQLQQLYRHMELEQMHVLDTPMVPPHPSLGHQVSYLPRMCLQYPSLSPAQPSSDEEEGERQSPPLEVSDGEADGLEPGPGLLPGETGGAPGPPPWPRPWPCLCPAPTQPGQLTQQPRHRVACVCVCMFASVCVLWGCLWLSLCVCICCVVHTGISMKCARCVCLSVP

SEQ ID NO: 83483 - protein, 35 aa, Homo sapiens
  Payload ID: 16612
  Gene Symbol: SPI1
  Gene Name: Spi-1 proto-oncogene
  ENSP ID: ENSP00000443865
MLQACKMEGFPLVPPAARRRSACTSSCWTCSAAAT

SEQ ID NO: 83484 - protein, 177 aa, Homo sapiens
  Payload ID: 16613
  Gene Symbol: SPIB
  Gene Name: Spi-B transcription factor (Spi-1/PU.1 related)
  Uniprot ID: Q01892
  ENSP ID: ENSP00000270632
MLALEAAQLDGPHFSCLYPDGVFYDLDSCKHSSYPDSEGAPDSLWDWTVAPPVPATPYEAFDPAAAAFSHPQAAQLCYEPPTYSPAGNLELAPSLEAPGPGLPAYPTENFASQTLVPPAYAPYPSPVLSEEEDLPLDSPALEVSDSESDEALVAGPEGKGSEGLARSCACTSSCWGY

SEQ ID NO: 83485 - protein, 171 aa, Homo sapiens
  Payload ID: 16613
  Gene Symbol: SPIB
  Gene Name: Spi-B transcription factor (Spi-1/PU.1 related)
  Uniprot ID: Q01892
  ENSP ID: ENSP00000391877
MASSMTWTAASIPATLIQRGLLTLVPPAYAPYPSPVLSEEEDLPLDSPALEVSDSESDEALVAGPEGKGSEAGTRKKLRLYQFLLGLLTRGDMRECVWWVEPGAGVFQFSSKHKELLARRWGQQKGNRKRMTYQKLARALRNYAKTGEIRKVKRKLTYQFDSALLPAVRRA

SEQ ID NO: 83486 - protein, 137 aa, Homo sapiens
  Payload ID: 16613
  Gene Symbol: SPIB
  Gene Name: Spi-B transcription factor (Spi-1/PU.1 related)
  ENSP ID: ENSP00000469023
MLALEAAQLDGPHFSCLYPDGVFYDLDSCKHSSYPDSEGAPDSLWDWTVAPPVPATPYEAFDPAAAAFSHPQAAQLCYEPPTYSPAGNLELAPSLEAPGPGLPAYPTENFASQPCAIRGGRLTVGQPCPGGLGQRVG

SEQ ID NO: 83487 - protein, 77 aa, Homo sapiens
  Payload ID: 16613
  Gene Symbol: SPIB
  Gene Name: Spi-B transcription factor (Spi-1/PU.1 related)
  ENSP ID: ENSP00000470970
MLALEAAQLDGPHFSCLYPDGVFYDLDSCKHSSYPDSEGAPDPGSPGICPVPQPCAIRGGRLTVGQPCPGGLGQRVG

SEQ ID NO: 83488 - protein, 262 aa, Homo sapiens
  Payload ID: 16613
  Gene Symbol: SPIB
  Gene Name: Spi-B transcription factor (Spi-1/PU.1 related)
  Uniprot ID: Q01892
  ENSP ID: ENSP00000471921
MLALEAAQLDGPHFSCLYPDGVFYDLDSCKHSSYPDSEGAPDSLWDWTVAPPVPATPYEAFDPAAAAFSHPQAAQLCYEPPTYSPAGNLELAPSLEAPGPGLPAYPTENFASQTLVPPAYAPYPSPVLSEEEDLPLDSPALEVSDSESDEALVAGPEGKGSEAGTRKKLRLYQFLLGLLTRGDMRECVWWVEPGAGVFQFSSKHKELLARRWGQQKGNRKRMTYQKLARALRNYAKTGEIRKVKRKLTYQFDSALLPAVRRA

SEQ ID NO: 83489 - protein, 127 aa, Homo sapiens
  Payload ID: 16613
  Gene Symbol: SPIB
  Gene Name: Spi-B transcription factor (Spi-1/PU.1 related)
  ENSP ID: ENSP00000472626
MLALEAAQFRWLEAASACPCVSPPPGSTGHTSAVCTQMASSMTWTAASIPATLIQRGLLTPCGTGLWPHLSQPPPMKPSTRQQPLLATPRLPSSATNPPPTALQGTSNWPPAWRPRGLASLHTPRRT

SEQ ID NO: 83490 - protein, 248 aa, Homo sapiens
  Payload ID: 16614
  Gene Symbol: SPIC
  Gene Name: Spi-C transcription factor (Spi-1/PU.1 related)
  Uniprot ID: Q8N5J4
  ENSP ID: ENSP00000448580
MTCVEQDKLGQAFEDAFEVLRQHSTGDLQYSPDYRNYLALINHRPHVKGNSSCYGVLPTEEPVYNWRTVINSAADFYFEGNIHQSLQNITENQLVQPTLLQQKGGKGRKKLRLFEYLHESLYNPEMASCIQWVDKTKGIFQFVSKNKEKLAELWGKRKGNRKTMTYQKMARALRNYGRSGEITKIRRKLTYQFSEAILQRLSPSYFLGKEIFYSQCVQPDQEYLSLNNWNANYNYTYANYHELNHHDC

SEQ ID NO: 83491 - protein, 855 aa, Homo sapiens
  Payload ID: 16615
  Gene Symbol: SPICE1
  Gene Name: spindle and centriole associated protein 1
  Uniprot ID: Q8N0Z3
  ENSP ID: ENSP00000295872
MSFVRVNRCGPRVGVRKTPKVKKKKTSVKQEWDNTVTDLTVHRATPEDLVRRHEIHKSKNRALVHWELQEKALKRKWRKQKPETLNLEKRRLSIMKEILSDQYQMQDVLEKSDHLIAAAKELFPRRRTGFPNVTVAPDSSQGPIVVNQDPITQSIFNESVIEPQALNDVDGEEEGTVNSQSGESENENELDNSLNSQSNTNTDRFLQQLTEENFELISKLWTDIQQKIATQSQITPPGTPSSALSSGEQRAALNATNAVKRLQTRLQPEESTETLDSSYVVGHVLNSRKQKQLLNKVKRKPNLHALSKPKKNISSGSTTSADLPNRTNSNLDVLKHMIHEVEHEMEEYERWTGREVKGLQSSQGLTGFTLSLVSSLCRLVRYLKESEIQLRKEVETRQQLEQVLGDHRELIDALTAEILRLREENAATQARLQQYMVTTDEQLISLTHAIKNCPVINNRQEIQASESGATGRRVMDSPERPVVNANVSVPLMFREEVAEFPQEELPVKLSQVPDPPDNMNLAKNFPAHIFEPAVLLTPPRQKSNLKFSPLQDVLRRTVQTRPAPRLPPTVEIIEKEQNWEEKTLPIDTDIQNSSEENRLFTQRWRVSHMGEDLENKTQAPFVNLSQPLCNSHSNTQQSRSPTFSEELPVLGDGQQLRTNESLIQRKDIMTRIADLTLQNSAIKAHMNNIIEPRGEQGDGLRELNKQESASDMTSTFPVAQSLTPGSMEERIAELNRQSMEARGKLLQLIEQQKLVGLNLSPPMSPVQLPLRAWTEGAKRTIEVSIPGAEAPESSKCSTVSPVSGINTRRSSGATGNSCSPLNATSGSGRFTPLNPRAKIEKQNEEGWFALSTHVS

SEQ ID NO: 83492 - protein, 19 aa, Homo sapiens
  Payload ID: 16615
  Gene Symbol: SPICE1
  Gene Name: spindle and centriole associated protein 1
  ENSP ID: ENSP00000417137
MSFVRVNRCGPRVGVRKTP

SEQ ID NO: 83493 - protein, 173 aa, Homo sapiens
  Payload ID: 16615
  Gene Symbol: SPICE1
  Gene Name: spindle and centriole associated protein 1
  ENSP ID: ENSP00000417944
MSFVRVNRCGPRVGVRKTPKVKKKKTSVKQEWDNTVTDLTVHRATPEDLVRRHEIHKSKNRALVHWELQEKALKRKWRKQKPETLNLEKRRLSIMKEILSDQYQMQDVLEKSDHLIAAAKELFPRRRTGFPNVTVAPDSSQGPIVVNQDPITQSIFNESVIEPQALNDVDGEE

SEQ ID NO: 83494 - protein, 160 aa, Homo sapiens
  Payload ID: 16615
  Gene Symbol: SPICE1
  Gene Name: spindle and centriole associated protein 1
  ENSP ID: ENSP00000418681
MSFVRVNRCGPRVGVRKTPKVKKKKTSVKQEWDNTVTDLTVHRATPEDLVRRHEIHKSKNRALVHWELQEKALKRKWRKQKPETLNLEKRRLSIMKEILSDQYQMQDVLEKSDHLIAAAKELFPRRRTGFPNVTVAPDSSQGPIVVNQDPITQSIFNESV

SEQ ID NO: 83495 - protein, 189 aa, Homo sapiens
  Payload ID: 16615
  Gene Symbol: SPICE1
  Gene Name: spindle and centriole associated protein 1
  ENSP ID: ENSP00000420363
  MOD_RES (1)..(1): Any amino acid
XLDNSLNSQSNTNTDRFLQQLTEENFELISKLWTDIQQKIATQSQITPPGTPSSALSSGEQRAALNATNAVKRLQTRLQPEESTETLDSSYVVGHVLNSRKQKQLLNKEGAKRTIEVSIPGAEAPESSKCSTVSPVSGINTRRSSGATGNSCSPLNATSGSGRFTPLNPRAKIEKQNEEGWFALSTHVS

SEQ ID NO: 83496 - protein, 255 aa, Homo sapiens
  Payload ID: 16616
  Gene Symbol: SKA1
  Gene Name: spindle and kinetochore associated complex subunit 1
  Uniprot ID: Q96BD8
  ENSP ID: ENSP00000285116
MASSDLEQLCSHVNEKIGNIKKTLSLRNCGQEPTLKTVLNKIGDEIIVINELLNKLELEIQYQEQTNNSLKELCESLEEDYKDIEHLKENVPSHLPQVTVTQSCVKGSDLDPEEPIKVEEPEPVKKPPKEQRSIKEMPFITCDEFNGVPSYMKSRLTYNQINDVIKEINKAVISKYKILHQPKKSMNSVTRNLYHRFIDEETKDTKGRYFIVEADIKEFTTLKADKKFHVLLNILRHCRRLSEVRGGGLTRYVIT

SEQ ID NO: 83497 - protein, 255 aa, Homo sapiens; identical to SEQ ID NO: 83496
  Payload ID: 16616
  Gene Symbol: SKA1
  Gene Name: spindle and kinetochore associated complex subunit 1
  Uniprot ID: Q96BD8
  ENSP ID: ENSP00000381470

SEQ ID NO: 83498 - protein, 209 aa, Homo sapiens
  Payload ID: 16616
  Gene Symbol: SKA1
  Gene Name: spindle and kinetochore associated complex subunit 1
  Uniprot ID: Q96BD8
  ENSP ID: ENSP00000397222
MASSDLEQLCSHVNEKIGNIKKTLSLRNCGQEPTLKTVLNKIGDEIIVINELLNKLELEIQYQEQTNNSLKELCESLEEDYKDIEHLKENVPSHLPQVTVTQSWYMKSRLTYNQINDVIKEINKAVISKYKILHQPKKSMNSVTRNLYHRFIDEETKDTKGRYFIVEADIKEFTTLKADKKFHVLLNILRHCRRLSEVRGGGLTRYVIT

SEQ ID NO: 83499 - protein, 255 aa, Homo sapiens; identical to SEQ ID NO: 83496
  Payload ID: 16616
  Gene Symbol: SKA1
  Gene Name: spindle and kinetochore associated complex subunit 1
  Uniprot ID: Q96BD8
  ENSP ID: ENSP00000458992

SEQ ID NO: 83500 - protein, 104 aa, Homo sapiens
  Payload ID: 16616
  Gene Symbol: SKA1
  Gene Name: spindle and kinetochore associated complex subunit 1
  ENSP ID: ENSP00000467242
MKSRLTYNQINDVIKEINKAVISKYKILHQPKKSMNSVTRNLYHRFIDEETKDTKGRYFIVEADIKEFTTLKADKKFHVLLNILRHCRRLSEVRGGGLTRYVIT

SEQ ID NO: 83501 - protein, 91 aa, Homo sapiens
  Payload ID: 16616
  Gene Symbol: SKA1
  Gene Name: spindle and kinetochore associated complex subunit 1
  ENSP ID: ENSP00000467559
MPFITCDEFNGVPSYMKSRLTYNQINDVIKEINKAVISKYKILHQPKKSMNSVTRNLYHRFIDEETKDTKGRYFIVEADIKEFTTLKADKK

SEQ ID NO: 83502 - protein, 255 aa, Homo sapiens; identical to SEQ ID NO: 83496
  Payload ID: 16616
  Gene Symbol: SKA1
  Gene Name: spindle and kinetochore associated complex subunit 1
  Uniprot ID: Q96BD8
  ENSP ID: ENSP00000478259

SEQ ID NO: 83503 - protein, 104 aa, Homo sapiens; identical to SEQ ID NO: 83500
  Payload ID: 16616
  Gene Symbol: SKA1
  Gene Name: spindle and kinetochore associated complex subunit 1
  ENSP ID: ENSP00000487620

SEQ ID NO: 83504 - protein, 91 aa, Homo sapiens; identical to SEQ ID NO: 83501
  Payload ID: 16616
  Gene Symbol: SKA1
  Gene Name: spindle and kinetochore associated complex subunit 1
  ENSP ID: ENSP00000487687

SEQ ID NO: 83505 - protein, 209 aa, Homo sapiens; identical to SEQ ID NO: 83498
  Payload ID: 16616
  Gene Symbol: SKA1
  Gene Name: spindle and kinetochore associated complex subunit 1
  Uniprot ID: Q96BD8
  ENSP ID: ENSP00000488815

SEQ ID NO: 83506 - protein, 121 aa, Homo sapiens
  Payload ID: 16617
  Gene Symbol: SKA2
  Gene Name: spindle and kinetochore associated complex subunit 2
  Uniprot ID: Q8WVK7
  ENSP ID: ENSP00000333433
MEAEVDKLELMFQKAESDLDYIQYRLEYEIKTNHPDSASEKNPVTLLKELSVIKSRYQTLYARFKPVAVEQKESKSRICATVKKTMNMIQKLQKQTDLELSPLTKEEKTAAEQFKFHMPDL

SEQ ID NO: 83507 - protein, 75 aa, Homo sapiens
  Payload ID: 16617
  Gene Symbol: SKA2
  Gene Name: spindle and kinetochore associated complex subunit 2
  Uniprot ID: Q8WVK7
  ENSP ID: ENSP00000411231
MASEVGHNLESPETPGGGGWTRVEFPPPAPKGAATVWCLNRLGSRKLSLIWITFNTGWNMKSRLIILIQQVSCHH

SEQ ID NO: 83508 - protein, 46 aa, Homo sapiens
  Payload ID: 16617
  Gene Symbol: SKA2
  Gene Name: spindle and kinetochore associated complex subunit 2
  ENSP ID: ENSP00000462197
MASEVGHNLESPETPGGGGWTRVEFPPPAPKGAATVWCLNRLGCHH

SEQ ID NO: 83509 - protein, 62 aa, Homo sapiens
  Payload ID: 16617
  Gene Symbol: SKA2
  Gene Name: spindle and kinetochore associated complex subunit 2
  ENSP ID: ENSP00000462220
MEAEVDKLELMFQKAESDLDYIQYRLEYEIKTNHPDSASELSPLTKEEKTAAEQFKFHMPDL

SEQ ID NO: 83510 - protein, 109 aa, Homo sapiens
  Payload ID: 16617
  Gene Symbol: SKA2
  Gene Name: spindle and kinetochore associated complex subunit 2
  ENSP ID: ENSP00000462574
MEAEVDKLELMFQKAESDLDYIQYRLEYEIKTNHPDSASEKNPVTLLKELSVIKSRYQTLYARFKPVAVEQKESKSRICATVKKTMNMIQKLQKQTDLEVMLSVDSCHH

SEQ ID NO: 83511 - protein, 92 aa, Homo sapiens
  Payload ID: 16617
  Gene Symbol: SKA2
  Gene Name: spindle and kinetochore associated complex subunit 2
  ENSP ID: ENSP00000462918
MEAEVDKLELMKNPVTLLKELSVIKSRYQTLYARFKPVAVEQKESKSRICATVKKTMNMIQKLQKQTDLELSPLTKEEKTAAEQFKFHMPDL

SEQ ID NO: 83512 - protein, 78 aa, Homo sapiens
  Payload ID: 16617
  Gene Symbol: SKA2
  Gene Name: spindle and kinetochore associated complex subunit 2
  ENSP ID: ENSP00000463167
MASEVGHNLESPETPGGGGWTRVEFPPPAPKGAATVWCLNRLGSRKLSLIWITFNTGWNMKSRLIILIQQVRKIQLHS

SEQ ID NO: 83513 - protein, 66 aa, Homo sapiens
  Payload ID: 16617
  Gene Symbol: SKA2
  Gene Name: spindle and kinetochore associated complex subunit 2
  ENSP ID: ENSP00000463315
MFQKAESDLDYIQYRLEYEIKTNHPDSASEKNPVTLLKELSVIKSRYQTLYARFKPVAVEQKESKS

SEQ ID NO: 83514 - protein, 61 aa, Homo sapiens
  Payload ID: 16617
  Gene Symbol: SKA2
  Gene Name: spindle and kinetochore associated complex subunit 2
  ENSP ID: ENSP00000464558
MEAEVDKLELMFQKAESDLDYIQYRLEYEIKTNHPDSASETESHSVVQTGVQWHDHGSLQL

SEQ ID NO: 83515 - protein, 35 aa, Homo sapiens
  Payload ID: 16618
  Gene Symbol: SKA3
  Gene Name: spindle and kinetochore associated complex subunit 3
  Uniprot ID: Q8IX90
  ENSP ID: ENSP00000298260
MDPIRSFCGKLRSLASTLDCETARLQRALDGEESG

SEQ ID NO: 83516 - protein, 412 aa, Homo sapiens
  Payload ID: 16618
  Gene Symbol: SKA3
  Gene Name: spindle and kinetochore associated complex subunit 3
  Uniprot ID: Q8IX90
  ENSP ID: ENSP00000319417
MDPIRSFCGKLRSLASTLDCETARLQRALDGEESDFEDYPMRILYDLHSEVQTLKDDVNILLDKARLENQEGIDFIKATKVLMEKNSMDIMKIREYFQKYGYSPRVKKNSVHEQEAINSDPELSNCENFQKTDVKDDLSDPPVASSCISEKSPRSPQLSDFGLERYIVSQVLPNPPQAVNNYKEEPVIVTPPTKQSLVKVLKTPKCALKMDDFECVTPKLEHFGISEYTMCLNEDYTMGLKNARNNKSEEAIDTESRLNDNVFATPSPIIQQLEKSDAEYTNSPLVPTFCTPGLKIPSTKNSIALVSTNYPLSKTNSSSNDLEVEDRTSLVLNSDTCFENLTDPSSPTISSYENLLRTPTPPEVTKIPEDILQLLSKYNSNLATPIAIKAVPPSKRFLKHGQNIRDVSNKEN

SEQ ID NO: 83517 - protein, 388 aa, Homo sapiens
  Payload ID: 16618
  Gene Symbol: SKA3
  Gene Name: spindle and kinetochore associated complex subunit 3
  Uniprot ID: Q8IX90
  ENSP ID: ENSP00000382896
MDPIRSFCGKLRSLASTLDCETARLQRALDGEESDFEDYPMRILYDLHSEVQTLKDDVNILLDKARLENQEGIDFIKATKVLMEKNSMDIMKIREYFQKYGYSPRVKKNSVHEQEAINSDPELSNCENFQKTDVKDDLSDPPVASSCISEKSPRSPQLSDFGLERYIVSQVLPNPPQAVNNYKEEPVIVTPPTKQSLVKVLKTPKCALKMDDFECVTPKLEHFGISEYTMCLNEDYTMGLKNARNNKSEEAIDTESRLNDNVFATPSPIIQQLEKSDAEYTNSPLVPTFCTPGLKIPSTKNSIALVSTNYPLSKTNSSSNDLEVEDRTSLVLNSDTCFENLTDPSSPTISSYENLLRTPTPPEVTKIPEDILQKFQWIYPTQKLNKMR

SEQ ID NO: 83518 - protein, 36 aa, Homo sapiens
  Payload ID: 16618
  Gene Symbol: SKA3
  Gene Name: spindle and kinetochore associated complex subunit 3
  ENSP ID: ENSP00000441632
MDPIRSFCGKLRSLASTLDCETARLQRALDGEESGA

SEQ ID NO: 83519 - protein, 49 aa, Homo sapiens
  Payload ID: 16618
  Gene Symbol: SKA3
  Gene Name: spindle and kinetochore associated complex subunit 3
  ENSP ID: ENSP00000443543
MDPIRSFCGKLRSLASTLDCETARLQRALDGEESAFIKIQLKPSYSNSN

SEQ ID NO: 83520 - protein, 605 aa, Homo sapiens
  Payload ID: 16619
  Gene Symbol: SPDL1
  Gene Name: spindle apparatus coiled-coil protein 1
  Uniprot ID: Q96EA4
  ENSP ID: ENSP00000265295
MEADIITNLRCRLKEAEEERLKAAQYGLQLVESQNELQNQLDKCRNEMMTMTESYEQEKYTLQREVELKSRMLESLSCECEAIKQQQKMHLEKLEEQLSRSHGQEVNELKTKIEKLKVELDEARLSEKQLKHQVDHQKELLSCKSEELRVMSERVQESMSSEMLALQIELTEMESMKTTLKEEVNELQYRQEQLELLITNLMRQVDRLKEEKEEREKEAVSYYNALEKARVANQDLQVQLDQALQQALDPNSKGNSLFAEVEDRRAAMERQLISMKVKYQSLKKQNVFNREQMQRMKLQIATLLQMKGSQTEFEQQERLLAMLEQKNGEIKHLLGEIRNLEKFKNLYDSMESKPSVDSGTLEDNTYYTDLLQMKLDNLNKEIESTKGELSIQRMKALFESQRALDIERKLFANERCLQLSESENMKLRAKLDELKLKYEPEETVEVPVLKKRREVLPVDITTAKDACVNNSALGGEVYRLPPQKEETQSCPNSLEDNNLQLEKSVSIYTPVVSLSPHKNLPVDMQLKKEKKCVKLIGVPADAEALSERSGNTPNSPRLAAESKLQTEVKEGKETSSKLEKETCKKLHPILYVSSKSTPETQCPQQ

SEQ ID NO: 83521 - protein, 86 aa, Homo sapiens
  Payload ID: 16619
  Gene Symbol: SPDL1
  Gene Name: spindle apparatus coiled-coil protein 1
  ENSP ID: ENSP00000421598
MEADIITNLRCRLKEAEEERLKAAQYGLQLVESQNELQNQLDKCRNEMMTMTESYEQEKYTLQREVELKSRMLESLSCECEAIKQQ

SEQ ID NO: 83522 - protein, 230 aa, Homo sapiens
  Payload ID: 16619
  Gene Symbol: SPDL1
  Gene Name: spindle apparatus coiled-coil protein 1
  ENSP ID: ENSP00000422352
MEADIITNLRCRLKEAEEERLKAAQYGLQLVESQNELQNQLDKCRNEMMTMTESYEQEKYTLQREVELKSRMLESLSCECEAIKQQQKMHLEKLEEQLSRSHGQEVNELKTKIEKLKVELDEARLSEKQLKHQVDHQKELLSCKSEELRVMSERVQESMSSEMLALQIELTEMESMKTTLKEEVNELQYRQEQLELLITNLMRQVDRLKEEKEEREKEAVSYYNALEKAR

SEQ ID NO: 83523 - protein, 88 aa, Homo sapiens
  Payload ID: 16619
  Gene Symbol: SPDL1
  Gene Name: spindle apparatus coiled-coil protein 1
  ENSP ID: ENSP00000423687
MEADIITNLRCRLKEAEEERLKAAQYGLQLVESQNELQNQLDKCRNEMMTMTESYEQEKYTLQREVELKSRMLESLSCECEAIKQQQK

SEQ ID NO: 83524 - protein, 44 aa, Homo sapiens
  Payload ID: 16619
  Gene Symbol: SPDL1
  Gene Name: spindle apparatus coiled-coil protein 1
  ENSP ID: ENSP00000425357
MEADIITNLRCRLKEAEEERLKAAQVMNKKNIPFKEKLNSRVEC

SEQ ID NO: 83525 - protein, 149 aa, Homo sapiens
  Payload ID: 16619
  Gene Symbol: SPDL1
  Gene Name: spindle apparatus coiled-coil protein 1
  ENSP ID: ENSP00000425922
MEADIITNLRCRLKEAEEERLKAAQYGLQLVESQNELQNQLDKCRNEMMTMTESYEQEKYTLQREVELKSRMLESLSCECEAIKQQQKMHLEKLEEQLSRSHGQEVNELKTKIEKLKVELDEARLSEKQLKHQVDHQKELLSCKSEELR

SEQ ID NO: 83526 - protein, 22 aa, Homo sapiens
  Payload ID: 16619
  Gene Symbol: SPDL1
  Gene Name: spindle apparatus coiled-coil protein 1
  ENSP ID: ENSP00000426881
  MOD_RES (1)..(1): Any amino acid
XLDKCRNEMMTMTEQRLLDLTC

SEQ ID NO: 83527 - protein, 60 aa, Homo sapiens
  Payload ID: 16619
  Gene Symbol: SPDL1
  Gene Name: spindle apparatus coiled-coil protein 1
  ENSP ID: ENSP00000426965
MEADIITNLRCRLKEAEEERLKAAQYGLQLVESQNELQNQLDKCRNEMMTMTERLLDLTC

SEQ ID NO: 83528 - protein, 60 aa, Homo sapiens; identical to SEQ ID NO: 83527
  Payload ID: 16619
  Gene Symbol: SPDL1
  Gene Name: spindle apparatus coiled-coil protein 1
  ENSP ID: ENSP00000427197

SEQ ID NO: 83529 - protein, 158 aa, Homo sapiens
  Payload ID: 16619
  Gene Symbol: SPDL1
  Gene Name: spindle apparatus coiled-coil protein 1
  ENSP ID: ENSP00000427510
MEADIITNLRCRLKEAEEERLKAAQYGLQLVESQNELQNQLDKCRNEMMTMTESYEQEKYTLQREVELKSRMLESLSCECEAIKQQQKMHLEKLEEQLSRSHGQEVNELKTKIEKLKVELDEARLSEKQLKHQVDHQKELLSCKSEELRVMSERVQES

SEQ ID NO: 83530 - protein, 312 aa, Homo sapiens
  Payload ID: 16619
  Gene Symbol: SPDL1
  Gene Name: spindle apparatus coiled-coil protein 1
  ENSP ID: ENSP00000429470
  MOD_RES (1)..(1): Any amino acid
XLESLSCECEAIKQQQKMHLEKLEEQLSRSHGQEVNELKTKIEKLKVELDEARLSEKQLKHQVDHQKELLSCKSEELRVMSERVQESMSSEMLALQIELTEMESMKTTLKEEVNELQYRQEQLELLITNLMRQVDRLKEEKEEREKEAVSYYNALEKARVANQDLQVQLDQALQQALDPNSKGNSLFAEVEDRRAAMERQLISMKVKYQSLKKQNVFNREQMQRMKMKGSQTEFEQQERLLAMLEQKNGEIKHLLGEIRNLEKFKNLYDSMESKPSVDSGTLEDNTYYTDLLQMKLDNLNKEIESTKGELSI

SEQ ID NO: 83531 - protein, 60 aa, Homo sapiens; identical to SEQ ID NO: 83527
  Payload ID: 16619
  Gene Symbol: SPDL1
  Gene Name: spindle apparatus coiled-coil protein 1
  ENSP ID: ENSP00000486653

SEQ ID NO: 83532 - protein, 262 aa, Homo sapiens
  Payload ID: 16620
  Gene Symbol: SPIN1
  Gene Name: spindlin 1
  Uniprot ID: Q9Y657
  ENSP ID: ENSP00000365019
MKTPFGKTPGQRSRADAGHAGVSANMMKKRTSHKKHRSSVGPSKPVSQPRRNIVGCRIQHGWKEGNGPVTQWKGTVLDQVPVNPSLYLIKYDGFDCVYGLELNKDERVSALEVLPDRVATSRISDAHLADTMIGKAVEHMFETEDGSKDEWRGMVLARAPVMNTWFYITYEKDPVLYMYQLLDDYKEGDLRIMPDSNDSPPAEREPGEVVDSLVGKQVEYAKEDGSKRTGMVIHQVEAKPSVYFIKFDDDFHIYVYDLVKTS

SEQ ID NO: 83533 - protein, 258 aa, Homo sapiens
  Payload ID: 16621
  Gene Symbol: SPIN2A
  Gene Name: spindlin family, member 2A
  Uniprot ID: Q99865
  ENSP ID: ENSP00000364041
MKTPNAQEAEGQQTRAAAGRATGSANMTKKKVSQKKQRGRPSSQPRRNIVGCRISHGWKEGDEPITQWKGTVLDQVPINPSLYLVKYDGIDCVYGLELHRDERVLSLKILSDRVASSHISDANLANTIIGKAVEHMFEGEHGSKDEWRGMVLAQAPIMKAWFYITYEKDPVLYMYQLLDDYKEGDLRIMPESSESPPTEREPGGVVDGLIGKHVEYTKEDGSKRIGMVIHQVETKPSVYFIKFDDDFHIYVYDLVKKS

SEQ ID NO: 83534 - protein, 258 aa, Homo sapiens; identical to SEQ ID NO: 83533
  Payload ID: 16621
  Gene Symbol: SPIN2A
  Gene Name: spindlin family, member 2A
  Uniprot ID: Q99865
  ENSP ID: ENSP00000364043

SEQ ID NO: 83535 - protein, 157 aa, Homo sapiens
  Payload ID: 16621
  Gene Symbol: SPIN2A
  Gene Name: spindlin family, member 2A
  ENSP ID: ENSP00000483149
MKTPNAQEAEGQQTRAAAGRATGSANMTKKKVSQKKQRGRPSSQPRRNIVGCRISHGWKEGDEPITQWKGTVLDQLLDDYKEGDLRIMPESSESPPTEREPGGVVDGLIGKHVEYTKEDGSKRIGMVIHQVETKPSVYFIKFDDDFHIYVYDLVKKS

SEQ ID NO: 83536 - protein, 258 aa, Homo sapiens
  Payload ID: 16622
  Gene Symbol: SPIN2B
  Gene Name: spindlin family, member 2B
  Uniprot ID: Q9BPZ2
  ENSP ID: ENSP00000275988
MKTPNAQEAEGQQTRAAAGRATGSANMTKKKVSQKKQRGRPSSQPRRNIVGCRISHGWKEGDEPITQWKGTVLDQVPINPSLYLVKYDGIDCVYGLELHRDERVLSLKILSDRVASSHISDANLANTIIGKAVEHMFEGEHGSKDEWRGMVLAQAPIMKAWFYITYEKDPVLYMYQLLDDYKEGDLRIMPESSESPPTEREPGGVVDGLIGKHVEYTKEDGSKRIGMVIHQVEAKPSVYFIKFDDDFHIYVYDLVKKS

SEQ ID NO: 83537 - protein, 258 aa, Homo sapiens; identical to SEQ ID NO: 83536
  Payload ID: 16622
  Gene Symbol: SPIN2B
  Gene Name: spindlin family, member 2B
  Uniprot ID: Q9BPZ2
  ENSP ID: ENSP00000335008

SEQ ID NO: 83538 - protein, 157 aa, Homo sapiens
  Payload ID: 16622
  Gene Symbol: SPIN2B
  Gene Name: spindlin family, member 2B
  ENSP ID: ENSP00000364045
MKTPNAQEAEGQQTRAAAGRATGSANMTKKKVSQKKQRGRPSSQPRRNIVGCRISHGWKEGDEPITQWKGTVLDQLLDDYKEGDLRIMPESSESPPTEREPGGVVDGLIGKHVEYTKEDGSKRIGMVIHQVEAKPSVYFIKFDDDFHIYVYDLVKKS

SEQ ID NO: 83539 - protein, 258 aa, Homo sapiens; identical to SEQ ID NO: 83536
  Payload ID: 16622
  Gene Symbol: SPIN2B
  Gene Name: spindlin family, member 2B
  Uniprot ID: Q9BPZ2
  ENSP ID: ENSP00000364047

SEQ ID NO: 83540 - protein, 247 aa, Homo sapiens
  Payload ID: 16622
  Gene Symbol: SPIN2B
  Gene Name: spindlin family, member 2B
  ENSP ID: ENSP00000404314
MKTPNAQEAEGQQTRAAAGRATGSANMTKKKVSQKKQRGRPSSQPRRNIVGCRISHGWKEGDEPITQWKGTVLDQVPINPSLYLVKYDGIDCVYGLELHRDERVLSLKILSDRVASSHISDANLANTIIGKAVEHMFEGEHGSKDEWRGMVLAQAPIMKAWFYITYEKDPVLYMYQLLDDYKEGDLRIMPESSESPPTEREPGGVVDGLIGKHVEYTKEDGSKRIGMVIHQVEAKPSVYFIKFDDDF

SEQ ID NO: 83541 - protein, 258 aa, Homo sapiens
  Payload ID: 16623
  Gene Symbol: SPIN3
  Gene Name: spindlin family, member 3
  Uniprot ID: Q5JUX0
  ENSP ID: ENSP00000364054
MKTPFGKAAAGQRSRTGAGHGSVSVTMIKRKAAHKKHRSRPTSQPRGNIVGCRIQHGWKDGDEPLTQWKGTVLDQVPVNPSLYLIKYDGFDCVYGLELHRDERVSSLEVLPNRVASSRISDTHLAEIMVGKAVEHIFETEEGSKNEWRGMVLAQAPVMNTWFYITYEKDPVLYMYQLLDDYKDGDLRILQDSNDSPLAEREPGEVIDSLVGKQVEYAKDDGSKRTGMVIHQVEAKPSVYFIKFDDDFHIYVYDLVKTS

SEQ ID NO: 83542 - protein, 77 aa, Homo sapiens
  Payload ID: 16623
  Gene Symbol: SPIN3
  Gene Name: spindlin family, member 3
  Uniprot ID: Q5JUX0
  ENSP ID: ENSP00000433337
MKTPFGKAAAGQRSRTGAGHGSVSVTMIKRKAAHKKHRSRPTSQPRGNIVGCRIQHGWKDGDEPLTQWKGTVLDQLL

SEQ ID NO: 83543 - protein, 77 aa, Homo sapiens; identical to SEQ ID NO: 83542
  Payload ID: 16623
  Gene Symbol: SPIN3
  Gene Name: spindlin family, member 3
  Uniprot ID: Q5JUX0
  ENSP ID: ENSP00000436805

SEQ ID NO: 83544 - protein, 249 aa, Homo sapiens
  Payload ID: 16624
  Gene Symbol: SPIN4
  Gene Name: spindlin family, member 4
  Uniprot ID: Q56A73
  ENSP ID: ENSP00000334163
MSPPTVPPMGVDGVSAYLMKKRHTHRKQRRKPTFLTRRNIVGCRIQHGWKEGNEPVEQWKGTVLEQVSVKPTLYIIKYDGKDSVYGLELHRDKRVLALEILPERVPTPRIDSRLADSLIGKAVEHVFEGEHGTKDEWKGMVLARAPVMDTWFYITYEKDPVLYMYTLLDDYKDGDLRIIPDSNYYFPTAEQEPGEVVDSLVGKQVEHAKDDGSKRTGIFIHQVVAKPSVYFIKFDDDIHIYVYGLVKTP

SEQ ID NO: 83545 - protein, 231 aa, Homo sapiens
  Payload ID: 16624
  Gene Symbol: SPIN4
  Gene Name: spindlin family, member 4
  ENSP ID: ENSP00000364018
MKKRHTHRKQRRKPTFLTRRNIVGCRIQHGWKEGNEPVEQWKGTVLEQVSVKPTLYIIKYDGKDSVYGLELHRDKRVLALEILPERVPTPRIDSRLADSLIGKAVEHVFEGEHGTKDEWKGMVLARAPVMDTWFYITYEKDPVLYMYTLLDDYKDGDLRIIPDSNYYFPTAEQEPGEVVDSLVGKQVEHAKDDGSKRTGIFIHQVVAKPSVYFIKFDDDIHIYVYGLVKTP

SEQ ID NO: 83546 - protein, 454 aa, Homo sapiens
  Payload ID: 16625
  Gene Symbol: SPNS1
  Gene Name: spinster homolog 1 (Drosophila)
  Uniprot ID: Q9H2V7
  ENSP ID: ENSP00000306050
MAGSDTAPFLSQADDPDDGPVPGTPGLPGSTGNPKSEEPEVPDQEGLQRITGLSPGRSALIVAVLCYINLLNYMDRFTVAVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLLGDAGSPYLIGLISDRLRRNWPPSFLSEFRALQFSLMLCAFVGALGGAAFLGTAIFIEADRRRAQLHVQGLLHEAGSTDDRIVVPQRGRSTRVPVASVLI

SEQ ID NO: 83547 - protein, 528 aa, Homo sapiens
  Payload ID: 16625
  Gene Symbol: SPNS1
  Gene Name: spinster homolog 1 (Drosophila)
  Uniprot ID: Q9H2V7
  ENSP ID: ENSP00000309945
MAGSDTAPFLSQADDPDDGPVPGTPGLPGSTGNPKSEEPEVPDQEGLQRITGLSPGRSALIVAVLCYINLLNYMDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNPSFVLSSLGFTAVAFVTGSLALWAPAFLLRSRVVLGETPPCLPGDSCSSSDSLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLLGDAGSPYLIGLISDRLRRNWPPSFLSEFRALQFSLMLCAFVGALGGAAFLGTAIFIEADRRRAQLHVQGLLHEAGSTDDRIVVPQRGRSTRVPVASVLI

SEQ ID NO: 83548 - protein, 455 aa, Homo sapiens
  Payload ID: 16625
  Gene Symbol: SPNS1
  Gene Name: spinster homolog 1 (Drosophila)
  Uniprot ID: Q9H2V7
  ENSP ID: ENSP00000318228
MDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNPSFVLSSLGFTAVAFVTGSLALWAPAFLLRSRVVLGETPPCLPGDSCSSSDSLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLLGDAGSPYLIGLISDRLRRNWPPSFLSEFRALQFSLMLCAFVGALGGAAFLGTAIFIEADRRRAQLHVQGLLHEAGSTDDRIVVPQRGRSTRVPVASVLI

SEQ ID NO: 83549 - protein, 476 aa, Homo sapiens
  Payload ID: 16625
  Gene Symbol: SPNS1
  Gene Name: spinster homolog 1 (Drosophila)
  Uniprot ID: Q9H2V7
  ENSP ID: ENSP00000335494
MAGSDTAPFLSQADDPDDGPVPGTPGLPGSTGNPKSEEPEVPDQEGLQRITGLSPGRSALIVAVLCYINLLNYMDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLLGDAGSPYLIGLISDRLRRNWPPSFLSEFRALQFSLMLCAFVGALGGAAFLGTAIFIEADRRRAQLHVQGLLHEAGSTDDRIVVPQRGRSTRVPVASVLI

SEQ ID NO: 83550 - protein, 573 aa, Homo sapiens
  Payload ID: 16625
  Gene Symbol: SPNS1
  Gene Name: spinster homolog 1 (Drosophila)
  ENSP ID: ENSP00000454360
MTGFKQHGGCRGAAPGLSDSKCSGLLPRVGSSVGPERGRARPPGTMAGSDTAPFLSQADDPDDGPVPGTPGLPGSTGNPKSEEPEVPDQEGLQRITGLSPGRSALIVAVLCYINLLNYMDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNPSFVLSSLGFTAVAFVTGSLALWAPAFLLRSRVVLGETPPCLPGDSCSSSDSLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLLGDAGSPYLIGLISDRLRRNWPPSFLSEFRALQFSLMLCAFVGALGGAAFLGTAIFIEADRRRAQLHVQGLLHEAGSTDDRIVVPQRGRSTRVPVASVLI

SEQ ID NO: 83551 - protein, 142 aa, Homo sapiens
  Payload ID: 16625
  Gene Symbol: SPNS1
  Gene Name: spinster homolog 1 (Drosophila)
  ENSP ID: ENSP00000455101
MDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGD

SEQ ID NO: 83552 - protein, 274 aa, Homo sapiens
  Payload ID: 16625
  Gene Symbol: SPNS1
  Gene Name: spinster homolog 1 (Drosophila)
  ENSP ID: ENSP00000455429
  MOD_RES (1)..(1): Any amino acid
XDDGPVPGTPGLPGSTGNPKSEEPEVPDQEGLQRITGLSPGRSALIVAVLCYINLLNYMDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRISDRLRRNWPPSFLSEFRALQFSLMLCAFVGALGGAAFLGTAIFIEADRRRAQLHVQGQLGAVPGPAS

SEQ ID NO: 83553 - protein, 179 aa, Homo sapiens
  Payload ID: 16625
  Gene Symbol: SPNS1
  Gene Name: spinster homolog 1 (Drosophila)
  ENSP ID: ENSP00000455467
  MOD_RES (1)..(1): Any amino acid
XVFGYLGDRYNRKYLMCGGIAFWSLVTLGSSFIPGEIFIFIGETLLSMNWAIVADILLYVVIPTRRSTAEAFQIVLSHLLGDAGSPYLIGLISDRLRRNWPPSFLSEFRALQFSLMLCAFVGALGGAAFLGTAIFIEADRRRAQLHVQGLLHEAGSTDDRIVVPQRGRSTRVPVASVLI

SEQ ID NO: 83554 - protein, 538 aa, Homo sapiens
  Payload ID: 16625
  Gene Symbol: SPNS1
  Gene Name: spinster homolog 1 (Drosophila)
  ENSP ID: ENSP00000456119
QADDPDDGPVPGTPGLPGSTGNPKSEEPEVPDQEGLQRITGLSPGRSALIVAVLCYINLLNYMDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRPSVSQVTPGLGVVAVLLLFLVVREPPRGAVERHSDLPPLNPTSWWADLRALARNPSFVLSSLGFTAVAFVTGSLALWAPAFLLRSRVVLGETPPCLPGDSCSSSDSLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLLGDAGSPYLIGLACCTKQGPQTTGLWCPSGAAPPACPWPVCSSERLPLTYLHICHSWPWAHPTKGLGLTPWPGPASRGTLGRVPAPRHYLGSSGEEVGVQEGDPSPQGQPQGLGAI

SEQ ID NO: 83555 - protein, 178 aa, Homo sapiens
  Payload ID: 16625
  Gene Symbol: SPNS1
  Gene Name: spinster homolog 1 (Drosophila)
  ENSP ID: ENSP00000457011
MAGSDTAPFLSQADDPDDGPVPGTPGLPGSTGNPKSEEPEVPDQEGLQRITGLSPGRSALIVAVLCYINLLNYMDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADL

SEQ ID NO: 83556 - protein, 549 aa, Homo sapiens
  Payload ID: 16626
  Gene Symbol: SPNS2
  Gene Name: spinster homolog 2 (Drosophila)
  Uniprot ID: Q8IVW8
  ENSP ID: ENSP00000333292
MMCLECASAAAGGAEEEEADAERRRRRRGAQRGAGGSGCCGARGAGGAGVSAAGDEVQTLSGSVRRAPTGPPGTPGTPGCAATAKGPGAQQPKPASLGRGRGAAAAILSLGNVLNYLDRYTVAGVLLDIQQHFGVKDRGAGLLQSVFICSFMVAAPIFGYLGDRFNRKVILSCGIFFWSAVTFSSSFIPQQYFWLLVLSRGLVGIGEASYSTIAPTIIGDLFTKNTRTLMLSVFYFAIPLGSGLGYITGSSVKQAAGDWHWALRVSPVLGMITGTLILILVPATKRGHADQLGDQLKARTSWLRDMKALIRNRSYVFSSLATSAVSFATGALGMWIPLYLHRAQVVQKTAETCNSPPCGAKDSLIFGAITCFTGFLGVVTGAGATRWCRLKTQRADPLVCAVGMLGSAIFICLIFVAAKSSIVGAYICIFVGETLLFSNWAITADILMYVVIPTRRATAVALQSFTSHLLGDAGSPYLIGFISDLIRQSTKDSPLWEFLSLGYALMLCPFVVVLGGMFFLATALFFVSDRARAEQQVNQLAMPPASVKV

SEQ ID NO: 83557 - protein, 282 aa, Homo sapiens
  Payload ID: 16626
  Gene Symbol: SPNS2
  Gene Name: spinster homolog 2 (Drosophila)
  ENSP ID: ENSP00000461410
ALGMWIPLYLHRAQVVQKTAETCNSPPCGAKDSLIFGAITCFTGFLGVVTGAGATRWCRLKTQRADPLVCAVGMLGSAIFICLIFVAAKSSIVGAYICIFVGETLLFSNWAITADILMYVVIPTRRATAVALQSFTSHLLGDAGSPYLIGFGEPAGDAARICESLRWCHWDNEEPTLPPRLGGVLQRPGPAGLPQSFLCDPRLGTHPLWPRPAEWPWHQEEAVSSVTLEGCVCWSHTVGQVPSPRFGPQGPWGQGRRQPQVGVRGEPGLPPAYVILGKSLPS

SEQ ID NO: 83558 - protein, 512 aa, Homo sapiens
  Payload ID: 16627
  Gene Symbol: SPNS3
  Gene Name: spinster homolog 3 (Drosophila)
  Uniprot ID: Q6ZMD2
  ENSP ID: ENSP00000347721
MAGGMSAECPEPGPGGLQGQSPGPGRQCPPPITPTSWSLPPWRAYVAAAVLCYINLLNYMNWFIIAGVLLDIQEVFQISDNHAGLLQTVFVSCLLLSAPVFGYLGDRHSRKATMSFGILLWSGAGLSSSFISPRYSWLFFLSRGIVGTGSASYSTIAPTVLGDLFVRDQRTRVLAVFYIFIPVGSGLGYVLGSAVTMLTGNWRWALRVMPCLEAVALILLILLVPDPPRGAAETQGEGAVGGFRSSWCEDVRYLGKNWSFVWSTLGVTAMAFVTGALGFWAPKFLLEARVVHGLQPPCFQEPCSNPDSLIFGALTIMTGVIGVILGAEAARRYKKVIPGAEPLICASSLLATAPCLYLALVLAPTTLLASYVFLGLGELLLSCNWAVVADILLSVVVPRCRGTAEALQITVGHILGDAGSPYLTGLISSVLRARRPDSYLQRFRSLQQSFLCCAFVIALGGGCFLLTALYLERDETRAWQPVTGTPDSNDVDSNDLERQGLLSGAGASTEEP

SEQ ID NO: 83559 - protein, 202 aa, Homo sapiens
  Payload ID: 16627
  Gene Symbol: SPNS3
  Gene Name: spinster homolog 3 (Drosophila)
  ENSP ID: ENSP00000460781
MAGGMSAECPEPGPGGLQGQSPGPGRQCPPPITPTSWSLPPWRAYVAAAVLCYINLLNYMNWFIIAGVLLDIQEVFQISDNHAGLLQTVFLALLPVPGHRGHWLGQLLHHRAHRPGRPLREGPAHPRAGCLLHLYPRWKWSGLRAGVGCDDADWELALGPPSHALPGGRGLDPAYPAGSRPTPGSCRDTGGGGRGRLQEQLV

SEQ ID NO: 83560 - protein, 545 aa, Homo sapiens
  Payload ID: 16628
  Gene Symbol: SPIRE1
  Gene Name: spire-type actin nucleation factor 1
  ENSP ID: ENSP00000309661
METELCAAHLPTESDAPNHYQAVCRALFAETMELHTFLTKIKSAKENLKKIQEMEKSDESSTDLEELKNADWARFWVQVMRDLRNGVKLKKVQERQYNPLPIEYQLTPYEMLMDDIRCKRYTLRKVMVNGDIPPRLKKSAHEIILDFIRSRPPLNPVSARKLKPTPPRPRSLHERILEEIKAERKLRPVSPEEIRRSRLDVTTPESTKNLVESSMVNGGLTSQTKENGLSTSQQVPAQRKKLLRAPTLAELDSSESEEETLHKSTSSSSVSPSFPEEPVLEAVSTRKKPPKFLPISSTPQPERRQPPQRRHSIEKETPTNVRQFLPPSRQSSRSLEEFCYPVECLALTVEEVMHIRQVLVKAELEKYQQYKDIYTALKKGKLCFCCRTRRFSFFTWSYTCQFCKRPVCSQCCKKMRLPSKPYSTLPIFSLGPSALQRGESSMRSEKPSTAHHRPLRSIARFSSKSKSMDKSDEELQFPKELMEDWSTMEVCVDCKKFISEIISSSRRSLVLANKRARLKRKTQSFYMSSPGPSEYCPSERTISEI

SEQ ID NO: 83561 - protein, 742 aa, Homo sapiens
  Payload ID: 16628
  Gene Symbol: SPIRE1
  Gene Name: spire-type actin nucleation factor 1
  Uniprot ID: Q08AE8
  ENSP ID: ENSP00000387226
MAQAAGPAGGGEPRTEAVGGEGPREPGAAGGAAGGSRDALSLEEILRLYNQPINEEQAWAVCYQCCGSLRAAARRRQPRHRVRSAAQIRVWRDGAVTLAPAADDAGEPPPVAGKLGYSQCMETEVIESLGIIIYKALDYGLKENEERELSPPLEQLIDHMANTVEADGSNDEGYEAAEEGLGDEDEKRKISAIRSYRDVMKLCAAHLPTESDAPNHYQAVCRALFAETMELHTFLTKIKSAKENLKKIQEMEKSDESSTDLEELKNADWARFWVQVMRDLRNGVKLKKVQERQYNPLPIEYQLTPYEMLMDDIRCKRYTLRKVMVNGDIPPRLKKSAHEIILDFIRSRPPLNPVSARKLKPTPPRPRSLHERILEEIKAERKLRPVSPEEIRRSRLDVTTPESTKNLVESSMVNGGLTSQTKENGLSTSQQVPAQRKKLLRAPTLAELDSSESEEETLHKSTSSSSVSPSFPEEPVLEAVSTRKKPPKFLPISSTPQPERRQPPQRRHSIEKETPTNVRQFLPPSRQSSRSLEEFCYPVECLALTVEEVMHIRQVLVKAELEKYQQYKDIYTALKKGKLCFCCRTRRFSFFTWSYTCQFCKRPVCSQCCKKMRLPSKPYSTLPIFSLGPSALQRGESSMRSEKPSTAHHRPLRSIARFSSKSKSMDKSDEELQFPKELMEDWSTMEVCVDCKKFISEIISSSRRSLVLANKRARLKRKTQSFYMSSPGPSEYCPSERTISEI

SEQ ID NO: 83562 - protein, 756 aa, Homo sapiens
  Payload ID: 16628
  Gene Symbol: SPIRE1
  Gene Name: spire-type actin nucleation factor 1
  Uniprot ID: Q08AE8
  ENSP ID: ENSP00000387266
MAQAAGPAGGGEPRTEAVGGEGPREPGAAGGAAGGSRDALSLEEILRLYNQPINEEQAWAVCYQCCGSLRAAARRRQPRHRVRSAAQIRVWRDGAVTLAPAADDAGEPPPVAGKLGYSQCMETEVIESLGIIIYKALDYGLKENEERELSPPLEQLIDHMANTVEADGSNDEGYEAAEEGLGDEDEKRKISAIRSYRDVMKLCAAHLPTESDAPNHYQAVCRALFAETMELHTFLTKIKSAKENLKKIQEMEKSDESSTDLEELKNADWARFWVQVMRDLRNGVKLKKVQERQYNPLPIEYQLTPYEMLMDDIRCKRYTLRKVMVNGDIPPRLKKSAHEIILDFIRSRPPLNPVSARKLKPTPPRPRSLHERILEEIKAERKLRPVSPEEIRRSRLAMRPLSMSYSFDLSDVTTPESTKNLVESSMVNGGLTSQTKENGLSTSQQVPAQRKKLLRAPTLAELDSSESEEETLHKSTSSSSVSPSFPEEPVLEAVSTRKKPPKFLPISSTPQPERRQPPQRRHSIEKETPTNVRQFLPPSRQSSRSLEEFCYPVECLALTVEEVMHIRQVLVKAELEKYQQYKDIYTALKKGKLCFCCRTRRFSFFTWSYTCQFCKRPVCSQCCKKMRLPSKPYSTLPIFSLGPSALQRGESSMRSEKPSTAHHRPLRSIARFSSKSKSMDKSDEELQFPKELMEDWSTMEVCVDCKKFISEIISSSRRSLVLANKRARLKRKTQSFYMSSPGPSEYCPSERTISEI

SEQ ID NO: 83563 - protein, 197 aa, Homo sapiens
  Payload ID: 16628
  Gene Symbol: SPIRE1
  Gene Name: spire-type actin nucleation factor 1
  ENSP ID: ENSP00000401392
METEVIESLGIIIYKALDYGLKENEERELSPPLEQLIDHMANTVEADGSNDEGYEAAEEGLGDEDEKRKISAIRSYRDVMKLCAAHLPTESDAPNHYQAVCRALFAETMELHTFLTKIKSAKENLKKIQEMEKSDESSTDLEELKNADWARFWVQVMRDLRNGVKLKKVQERQYNPLPIEYQLTPYEMLMDDIRCKR

SEQ ID NO: 83564 - protein, 458 aa, Homo sapiens
  Payload ID: 16628
  Gene Symbol: SPIRE1
  Gene Name: spire-type actin nucleation factor 1
  Uniprot ID: Q08AE8
  ENSP ID: ENSP00000404752
MANTVEADGSNDEGYEAAEEGLGDEDEKRKISAIRSYRDVMKLCAAHLPTESDAPNHYQAVCRALFAETMELHTFLTKIKSAKENLKKIQEMEKSDESSTDLEELKNADWARFWVQVMRDLRNGVKLKKVQERQYNPLPIEYQLTPYEMLMDDIRCKRYTLRKVMVNGDIPPRLKKSAHEIILDFIRSRPPLNPVSARKLKPTPPRPRSLHERILEEIKAERKLRPVSPEEIRRSRLDVTTPESTKNLVESSMVNGGLTSQTKENGLSTSQQVPAQRKKLLRAPTLAELDSSESEEETLHKSTSSSSVSPSFPEEPVLEAVSTRKKPPKFLPISSTPQPERRQPPQRRHSIEKETPTNVRQFLPPSRQSSRSLEEFCYPVECLALTVEEVMHIRQVLVKAELEKYQQYKDIYTALKKGKLCFCCRTRRFSFFTWSYTCQFCKSDCLFNGTAHCQFYLG

SEQ ID NO: 83565 - protein, 622 aa, Homo sapiens
  Payload ID: 16628
  Gene Symbol: SPIRE1
  Gene Name: spire-type actin nucleation factor 1
  Uniprot ID: Q08AE8
  ENSP ID: ENSP00000407050
METEVIESLGIIIYKALDYGLKENEERELSPPLEQLIDHMANTVEADGSNDEGYEAAEEGLGDEDEKRKISAIRSYRDVMKLCAAHLPTESDAPNHYQAVCRALFAETMELHTFLTKIKSAKENLKKIQEMEKSDESSTDLEELKNADWARFWVQVMRDLRNGVKLKKVQERQYNPLPIEYQLTPYEMLMDDIRCKRYTLRKVMVNGDIPPRLKKSAHEIILDFIRSRPPLNPVSARKLKPTPPRPRSLHERILEEIKAERKLRPVSPEEIRRSRLDVTTPESTKNLVESSMVNGGLTSQTKENGLSTSQQVPAQRKKLLRAPTLAELDSSESEEETLHKSTSSSSVSPSFPEEPVLEAVSTRKKPPKFLPISSTPQPERRQPPQRRHSIEKETPTNVRQFLPPSRQSSRSLEEFCYPVECLALTVEEVMHIRQVLVKAELEKYQQYKDIYTALKKGKLCFCCRTRRFSFFTWSYTCQFCKRPVCSQCCKKMRLPSKPYSTLPIFSLGPSALQRGESSMRSEKPSTAHHRPLRSIARFSSKSKSMDKSDEELQFPKELMEDWSTMEVCVDCKKFISEIISSSRRSLVLANKRARLKRKTQSFYMSSPGPSEYCPSERTISEI

SEQ ID NO: 83566 - protein, 122 aa, Homo sapiens
  Payload ID: 16628
  Gene Symbol: SPIRE1
  Gene Name: spire-type actin nucleation factor 1
  ENSP ID: ENSP00000466531
  MOD_RES (1)..(1): Any amino acid
XDDIRCKRYTLRKVMVNGDIPPRLKKSAHEIILDFIRSRPPLNPVSARKLKPTPPRPRSLHERILEEIKAERKLRPVSPEEIRRSRLGGILLPSGMPRSYCGRSDAYSPGPGEGRAGKIPTV

SEQ ID NO: 83567 - protein, 147 aa, Homo sapiens
  Payload ID: 16628
  Gene Symbol: SPIRE1
  Gene Name: spire-type actin nucleation factor 1
  ENSP ID: ENSP00000467103
MSSGKTCCIAGKLGYSQCMETEVIESLGIIIYKALDYGLKENEERELSPPLEQLIDHMANTVEADGSNDEGYEAAEEGLGDEDEKRKISAIRSYRDVMKLCAAHLPTESDAPNHYQAVCRALFAETMELHTFLTKIKSAKENLKKIQ

SEQ ID NO: 83568 - protein, 122 aa, Homo sapiens
  Payload ID: 16628
  Gene Symbol: SPIRE1
  Gene Name: spire-type actin nucleation factor 1
  ENSP ID: ENSP00000467943
METEVIESLGIIIYKALDYGLKENEERELSPPLEQLIDHMANTVEADGSNDEGYEAAEEGLGDEDEKRKISAIRSYRDVMKLCAAHLPTESDAPNHYQAVCRALFAETMELHTFLTKIKSAK

SEQ ID NO: 83569 - protein, 622 aa, Homo sapiens
  Payload ID: 16628
  Gene Symbol: SPIRE1
  Gene Name: spire-type actin nucleation factor 1
  ENSP ID: ENSP00000486927
MELEVIESLGIIIYKALDYGLKENEERELSPPLEQLIDHMANTVEADGSNDEGYEAAEEGLGDEDEKRKISAIRSYRDVMKLCAAHLPTESDAPNHYQAVCRALFAETMELHTFLTKIKSAKENLKKIQEMEKSDESSTDLEELKNADWARFWVQVMRDLRNGVKLKKVQERQYNPLPIEYQLTPYEMLMDDIRCKRYTLRKVMVNGDIPPRLKKSAHEIILDFIRSRPPLNPVSARKLKPTPPRPRSLHERILEEIKAERKLRPVSPEEIRRSRLDVTTPESTKNLVESSMVNGGLTSQTKENGLSTSQQVPAQRKKLLRAPTLAELDSSESEEETLHKSTSSSSVSPSFPEEPVLEAVSTRKKPPKFLPISSTPQPERRQPPQRRHSIEKETPTNVRQFLPPSRQSSRSLEEFCYPVECLALTVEEVMHIRQVLVKAELEKYQQYKDIYTALKKGKLCFCCRTRRFSFFTWSYTCQFCKRPVCSQCCKKMRLPSKPYSTLPIFSLGPSALQRGESSMRSEKPSTAHHRPLRSIARFSSKSKSMDKSDEELQFPKELMEDWSTMEVCVDCKKFISEIISSSRRSLVLANKRARLKRKTQSFYMSSPGPSEYCPSERTISEI

SEQ ID NO: 83570 - protein, 714 aa, Homo sapiens
  Payload ID: 16629
  Gene Symbol: SPIRE2
  Gene Name: spire-type actin nucleation factor 2
  Uniprot ID: Q8WWL2
  ENSP ID: ENSP00000367494
MARAGSCGGAAAGAGRPEPWELSLEEVLKAYEQPLNEEQAWAVCFQGCRGLRGSPGRRLRDTGDLLLRGDGSVGAREPEAAEPATMVVPLASSEAQTVQSLGFAIYRALDWGLDESEERELSPQLERLIDLMANNDSEDSGCGAADEGYGGPEEEEEAEGVPRSVRTFAQAMRLCAARLTDPRGAQAHYQAVCRALFVETLELRAFLARVREAKEMLQKLREDEPHLETPRAELDSLGHTDWARLWVQLMRELRRGVKLKKVQEQEFNPLPTEFQLTPFEMLMQDIRARNYKLRKVMVDGDIPPRVKKDAHELILDFIRSRPPLKQVSERRLRPLPPKQRSLHEKILEEIKQERRLRPVRGEGWAARGFGSLPCILNACSGDAKSTSCINLSVTDAGGSAQRPRPRVLLKAPTLAEMEEMNTSEEEESPCGEVTLKRDRSFSEHDLAQLRSEVASGLQSATHPPGGTEPPRPRAGSAHVWRPGSRDQGTCPASVSDPSHPLLSNRGSSGDRPEASMTPDAKHLWLEFSHPVESLALTVEEVMDVRRVLVKAEMEKFLQNKELFSSLKKGKICCCCRAKFPLFSWPPSCLFCKRAVCTSCSIKMKMPSKKFGHIPVYTLGFESPQRVSAAKTAPIQRRDIFQSLQGPQWQSVEEAFPHIYSHGCVLKDVCSECTSFVADVVRSSRKSVDVLNTTPRRSRQTQSLYIPNTRTLDFK

SEQ ID NO: 83571 - protein, 666 aa, Homo sapiens
  Payload ID: 16629
  Gene Symbol: SPIRE2
  Gene Name: spire-type actin nucleation factor 2
  Uniprot ID: Q8WWL2
  ENSP ID: ENSP00000376782
MARAGSCGGAAAGAGRPEPWELSLEEVLKAYEQPLNEEQAWAVCFQGCRGLRGSPGRRLRDTGDLLLRGDGSVGAREPEAAEPATMVVPLASSEAQTVQSLGFAIYRALDWGLDESEERELSPQLERLIDLMANNDSEDSGCGAADEGYGGPEEEEEAEGVPRSVRTFAQAMRLCAARLTDPRGAQAHYQAVCRALFVETLELRAFLARVREAKEMLQKLREDEPHLETPRAELDSLGHTDWARLWVQLMRELRRGVKLKKVQEQEFNPLPTEFQLTPFEMLMQDIRARNYKLRKVMVDGDIPPRVKKDAHELILDFIRSRPPLKQVSERRLRPLPPKQRSLHEKILEEIKQERRLRPVRGEGWAARGFGSLPCILNACSGDAKSTSCINLSVTDAGGSAQRPRPRVLLKAPTLAEMEEMNTSEEEESPCGEVTLKRDRSFSEHDLAQLRSEVASGLQSATHPPGGTEPPRPRAGSAHVWRPGSRDQGTCPASVSDPSHPLLSNRGSSGDRPEASMTPDAKHLWLEFSHPVESLALTVEEVMDVRRVLVKAEMEKFLQNKELFSSLKKGKICCCCRAKFPLFSWPPSCLFCKRSLQGPQWQSVEEAFPHIYSHGCVLKDVCSECTSFVADVVRSSRKSVDVLNTTPRRSRQTQSLYIPNTRTLDFK

SEQ ID NO: 83572 - protein, 99 aa, Homo sapiens
  Payload ID: 16629
  Gene Symbol: SPIRE2
  Gene Name: spire-type actin nucleation factor 2
  ENSP ID: ENSP00000457940
MARAGSCGGAAAGAGRPEPWELSLEEVLKAYEQPLNEEQAWAVCFQGCRGLRGSPGRRLRDTGDLLLRGDGSVGAREPEAAEPATMVVPLASSEAQLHR

SEQ ID NO: 83573 - protein, 40 aa, Homo sapiens
  Payload ID: 16629
  Gene Symbol: SPIRE2
  Gene Name: spire-type actin nucleation factor 2
  ENSP ID: ENSP00000457981
GLRGSPGRRLRDTGDLLLRGDGSVGAREPEAAVEEVRNPG

SEQ ID NO: 83574 - protein, 273 aa, Homo sapiens
  Payload ID: 16630
  Gene Symbol: SPSB1
  Gene Name: splA/ryanodine receptor domain and SOCS box containing 1
  Uniprot ID: Q96BD6
  ENSP ID: ENSP00000330221
MGQKVTGGIKTVDMRDPTYRPLKQELQGLDYCKPTRLDLLLDMPPVSYDVQLLHSWNNNDRSLNVFVKEDDKLIFHRHPVAQSTDAIRGKVGYTRGLHVWQITWAMRQRGTHAVVGVATADAPLHSVGYTTLVGNNHESWGWDLGRNRLYHDGKNQPSKTYPAFLEPDETFIVPDSFLVALDMDDGTLSFIVDGQYMGVAFRGLKGKKLYPVVSAVWGHCEIRMRYLNGLDPEPLPLMDLCRRSVRLALGRERLGEIHTLPLPASLKAYLLYQ

SEQ ID NO: 83575 - protein, 273 aa, Homo sapiens; identical to SEQ ID NO: 83574
  Payload ID: 16630
  Gene Symbol: SPSB1
  Gene Name: splA/ryanodine receptor domain and SOCS box containing 1
  Uniprot ID: Q96BD6
  ENSP ID: ENSP00000350573

SEQ ID NO: 83576 - protein, 273 aa, Homo sapiens; identical to SEQ ID NO: 83574
  Payload ID: 16630
  Gene Symbol: SPSB1
  Gene Name: splA/ryanodine receptor domain and SOCS box containing 1
  Uniprot ID: Q96BD6
  ENSP ID: ENSP00000366616

SEQ ID NO: 83577 - protein, 202 aa, Homo sapiens
  Payload ID: 16630
  Gene Symbol: SPSB1
  Gene Name: splA/ryanodine receptor domain and SOCS box containing 1
  ENSP ID: ENSP00000409235
MGQKVTGGIKTVDMRDPTYRPLKQELQGLDYCKPTRLDLLLDMPPVSYDVQLLHSWNNNDRSLNVFVKEDDKLIFHRHPVAQSTDAIRGKVGYTRGLHVWQITWAMRQRGTHAVVGVATADAPLHSVGYTTLVGNNHESWGWDLGRNRLYHDGKNQPSKTYPAFLEPDETFIVPDSFLVALDMDDGTLSFIVDGQYMGVAFR

SEQ ID NO: 83578 - protein, 263 aa, Homo sapiens
  Payload ID: 16631
  Gene Symbol: SPSB2
  Gene Name: splA/ryanodine receptor domain and SOCS box containing 2
  Uniprot ID: Q99619
  ENSP ID: ENSP00000428338
MGQTALAGGSSSTPTPQALYPDLSCPEGLEELLSAPPPDLGAQRRHGWNPKDCSENIEVKEGGLYFERRPVAQSTDGARGKRGYSRGLHAWEISWPLEQRGTHAVVGVATALAPLQTDHYAALLGSNSESWGWDIGRGKLYHQSKGPGAPQYPAGTQGEQLEVPERLLVVLDMEEGTLGYAIGGTYLGPAFRGLKGRTLYPAVSAVWGQCQVRIRYLGERRAEPHSLLHLSRLCVRHNLGDTRLGQVSALPLPPAMKRYLLYQ

SEQ ID NO: 83579 - protein, 82 aa, Homo sapiens
  Payload ID: 16631
  Gene Symbol: SPSB2
  Gene Name: splA/ryanodine receptor domain and SOCS box containing 2
  ENSP ID: ENSP00000428458
MGQTALAGGSSSTPTPQALYPDLSCPEGLEELLSAPPPDLGAQRRHGWNPKDCSENIEVKEGGLYFERRPVAQSTDGARGKR

SEQ ID NO: 83580 - protein, 263 aa, Homo sapiens; identical to SEQ ID NO: 83578
  Payload ID: 16631
  Gene Symbol: SPSB2
  Gene Name: splA/ryanodine receptor domain and SOCS box containing 2
  Uniprot ID: Q99619
  ENSP ID: ENSP00000430872

SEQ ID NO: 83581 - protein, 267 aa, Homo sapiens
  Payload ID: 16631
  Gene Symbol: SPSB2
  Gene Name: splA/ryanodine receptor domain and SOCS box containing 2
  Uniprot ID: Q99619
  ENSP ID: ENSP00000431037
MGQTALAGGSSSTPTPQALYPDLSCPEGLEELLSAPPPDLGAQRRHGWNPKDCSENIEVKEGGLYFERRPVAQSTDGARGKRGYSRGLHAWEISWPLEQRGTHAVVGVATALAPLQTDHYAALLGSNSESWGWDIGRGKLYHQSKGPGAPQYPAGTQGEQLEVPERLLVVLDMEEGTLGYAIGGTYLGPAFRGLKGRTLYPAVSAVWGQCQVRIRYLGERRGEAWGRRGENFLSLVAVVWDGNSSDKSRGDGPSSSLPQPLFSAGKG

SEQ ID NO: 83582 - protein, 355 aa, Homo sapiens
  Payload ID: 16632
  Gene Symbol: SPSB3
  Gene Name: splA/ryanodine receptor domain and SOCS box containing 3
  Uniprot ID: Q6PJ21
  ENSP ID: ENSP00000301717
MARRPRNSRAWHFVLSAARRDADARAVALAGSTNWGYDSDGQHSDSDSDPEYSTLPPSIPSAVPVTGESFCDCAGQSEASFCSSLHSAHRGRDCRCGEEDEYFDWVWDDLNKSSATLLSCDNRKVSFHMEYSCGTAAIRGTKELGEGQHFWEIKMTSPVYGTDMMVGIGTSDVDLDKYRHTFCSLLGRDEDSWGLSYTGLLHHKGDKTSFSSRFGQGSIIGVHLDTWHGTLTFFKNRKCIGVAATKLQNKRFYPMVCSTAARSSMKVTRSCASATSLQYLCCHRLRQLRPDSGDTLEGLPLPPGLKQVLHNKLGWVLSMSCSRRKAPVSDPQAATSAHPSSREPRPCQRKRCRRT

SEQ ID NO: 83583 - protein, 168 aa, Homo sapiens
  Payload ID: 16632
  Gene Symbol: SPSB3
  Gene Name: splA/ryanodine receptor domain and SOCS box containing 3
  ENSP ID: ENSP00000455098
MARRPRNSRAWHFVLSAARRDADARAVALAGSTNWGYDSDGQHSDSDSDPEYSTLPPSIPSAVPVTGESFCDCAGQSEASFCSSLHSAHRGRDCRCGEEDEYFDWVWDDLNKSSATLLSCDNRKVSFHMEYSCGTAAIRGTKELGEGQHFWEIKMTSPVYGTDMMVGI

SEQ ID NO: 83584 - protein, 355 aa, Homo sapiens; identical to SEQ ID NO: 83582
  Payload ID: 16632
  Gene Symbol: SPSB3
  Gene Name: splA/ryanodine receptor domain and SOCS box containing 3
  Uniprot ID: Q6PJ21
  ENSP ID: ENSP00000457206

SEQ ID NO: 83585 - protein, 273 aa, Homo sapiens
  Payload ID: 16633
  Gene Symbol: SPSB4
  Gene Name: splA/ryanodine receptor domain and SOCS box containing 4
  Uniprot ID: Q96A44
  ENSP ID: ENSP00000311609
MGQKLSGSLKSVEVREPALRPAKRELRGAEPGRPARLDQLLDMPAAGLAVQLRHAWNPEDRSLNVFVKDDDRLTFHRHPVAQSTDGIRGKVGHARGLHAWQINWPARQRGTHAVVGVATARAPLHSVGYTALVGSDAESWGWDLGRSRLYHDGKNQPGVAYPAFLGPDEAFALPDSLLVVLDMDEGTLSFIVDGQYLGVAFRGLKGKKLYPVVSAVWGHCEVTMRYINGLDPEPLPLMDLCRRSIRSALGRQRLQDISSLPLPQSLKNYLQYQ

SEQ ID NO: 83586 - protein, 90 aa, Homo sapiens
  Payload ID: 16633
  Gene Symbol: SPSB4
  Gene Name: splA/ryanodine receptor domain and SOCS box containing 4
  ENSP ID: ENSP00000422034
  MOD_RES (1)..(1): Any amino acid
XVVLDMDEGTLSFIVDGQYLGVAFRGLKGKKLYPVVSAVWGHCEVTMRYINGLDHGVSLGCPGQSAVARSRLTATSASRVQAILLPQLPE

SEQ ID NO: 83587 - protein, 635 aa, Homo sapiens
  Payload ID: 16634
  Gene Symbol: SYK
  Gene Name: spleen tyrosine kinase
  Uniprot ID: P43405
  ENSP ID: ENSP00000364898
MASSGMADSANHLPFFFGNITREEAEDYLVQGGMSDGLYLLRQSRNYLGGFALSVAHGRKAHHYTIERELNGTYAIAGGRTHASPADLCHYHSQESDGLVCLLKKPFNRPQGVQPKTGPFEDLKENLIREYVKQTWNLQGQALEQAIISQKPQLEKLIATTAHEKMPWFHGKISREESEQIVLIGSKTNGKFLIRARDNNGSYALCLLHEGKVLHYRIDKDKTGKLSIPEGKKFDTLWQLVEHYSYKADGLLRVLTVPCQKIGTQGNVNFGGRPQLPGSHPATWSAGGIISRIKSYSFPKPGHRKSSPAQGNRQESTVSFNPYEPELAPWAADKGPQREALPMDTEVYESPYADPEEIRPKEVYLDRKLLTLEDKELGSGNFGTVKKGYYQMKKVVKTVAVKILKNEANDPALKDELLAEANVMQQLDNPYIVRMIGICEAESWMLVMEMAELGPLNKYLQQNRHVKDKNIIELVHQVSMGMKYLEESNFVHRDLAARNVLLVTQHYAKISDFGLSKALRADENYYKAQTHGKWPVKWYAPECINYYKFSSKSDVWSFGVLMWEAFSYGQKPYRGMKGSEVTAMLEKGERMGCPAGCPREMYDLMNLCWTYDVENRPGFAAVELRLRNYYYDVVN

SEQ ID NO: 83588 - protein, 612 aa, Homo sapiens
  Payload ID: 16634
  Gene Symbol: SYK
  Gene Name: spleen tyrosine kinase
  Uniprot ID: P43405
  ENSP ID: ENSP00000364899
MASSGMADSANHLPFFFGNITREEAEDYLVQGGMSDGLYLLRQSRNYLGGFALSVAHGRKAHHYTIERELNGTYAIAGGRTHASPADLCHYHSQESDGLVCLLKKPFNRPQGVQPKTGPFEDLKENLIREYVKQTWNLQGQALEQAIISQKPQLEKLIATTAHEKMPWFHGKISREESEQIVLIGSKTNGKFLIRARDNNGSYALCLLHEGKVLHYRIDKDKTGKLSIPEGKKFDTLWQLVEHYSYKADGLLRVLTVPCQKIGTQGNVNFGGRPQLPGSHPASSPAQGNRQESTVSFNPYEPELAPWAADKGPQREALPMDTEVYESPYADPEEIRPKEVYLDRKLLTLEDKELGSGNFGTVKKGYYQMKKVVKTVAVKILKNEANDPALKDELLAEANVMQQLDNPYIVRMIGICEAESWMLVMEMAELGPLNKYLQQNRHVKDKNIIELVHQVSMGMKYLEESNFVHRDLAARNVLLVTQHYAKISDFGLSKALRADENYYKAQTHGKWPVKWYAPECINYYKFSSKSDVWSFGVLMWEAFSYGQKPYRGMKGSEVTAMLEKGERMGCPAGCPREMYDLMNLCWTYDVENRPGFAAVELRLRNYYYDVVN

SEQ ID NO: 83589 - protein, 612 aa, Homo sapiens; identical to SEQ ID NO: 83588
  Payload ID: 16634
  Gene Symbol: SYK
  Gene Name: spleen tyrosine kinase
  Uniprot ID: P43405
  ENSP ID: ENSP00000364904

SEQ ID NO: 83590 - protein, 635 aa, Homo sapiens; identical to SEQ ID NO: 83587
  Payload ID: 16634
  Gene Symbol: SYK
  Gene Name: spleen tyrosine kinase
  Uniprot ID: P43405
  ENSP ID: ENSP00000364907

SEQ ID NO: 83591 - protein, 548 aa, Homo sapiens
  Payload ID: 16635
  Gene Symbol: SF1
  Gene Name: splicing factor 1
  Uniprot ID: Q15637
  ENSP ID: ENSP00000227503
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPPPPPSGPLPPWQQQQQQPPPPPPPSSSMASSTPLPWQQRSLPAAAMARAMRVRTFRAHW

SEQ ID NO: 83592 - protein, 638 aa, Homo sapiens
  Payload ID: 16635
  Gene Symbol: SF1
  Gene Name: splicing factor 1
  Uniprot ID: Q15637
  ENSP ID: ENSP00000334414
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPPPPPSGPLPPWQQQQQQPPPPPPPSSSMASSTPLPWQQNTTTTTTSAGTGSIPPWQQQQAAAAASPGAPQMQGNPTMVPLPPGVQPPLPPGAPPPPPPPPPGSAGMMIPPRGGDGPSHESEDFPRPLVTLPGRQPQQRPWWTGWFGKAA

SEQ ID NO: 83593 - protein, 673 aa, Homo sapiens
  Payload ID: 16635
  Gene Symbol: SF1
  Gene Name: splicing factor 1
  Uniprot ID: Q15637
  ENSP ID: ENSP00000366604
MATGANATPLGKLGPPGLPPLPGPKGGFEPGPPPAPGPGAGLLAPGPPPPPPVGSMGALTAAFPFAALPPPPPPPPPPPPQQPPPPPPPPSPGASYPPPQPPPPPPLYQRVSPPQPPPPQPPRKDQQPGPAGGGGDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPPPPPSGPLPPWQQQQQQPPPPPPPSSSMASSTPLPWQQRSLPAAAMARAMRVRTFRAHW

SEQ ID NO: 83594 - protein, 639 aa, Homo sapiens
  Payload ID: 16635
  Gene Symbol: SF1
  Gene Name: splicing factor 1
  Uniprot ID: Q15637
  ENSP ID: ENSP00000366607
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPPPPPSGPLPPWQQQQQQPPPPPPPSSSMASSTPLPWQQNTTTTTTSAGTGSIPPWQQQQAAAAASPGAPQMQGNPTMVPLPPGVQPPLPPGAPPPPPPPPPGSAGMMYAPPPPPPPPMDPSNFVTMMGMGVAGMPPFGMPPAPPPPPPQN

SEQ ID NO: 83595 - protein, 571 aa, Homo sapiens
  Payload ID: 16635
  Gene Symbol: SF1
  Gene Name: splicing factor 1
  Uniprot ID: Q15637
  ENSP ID: ENSP00000366611
MATGANATPLDFPSKKRKRSRWNQDTMEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMGKSVPGKYACGLWGLSPASRKRYDAATTYGHDAAAAAASQWAAPTPSLWSSSPMATTAAAASATPSAQQQYGFQYPLAMAAKIPPRGGDGPSHESEDFPRPLVTLPGRQPQQRPWWTGWFGKAA

SEQ ID NO: 83596 - protein, 51 aa, Homo sapiens
  Payload ID: 16635
  Gene Symbol: SF1
  Gene Name: splicing factor 1
  ENSP ID: ENSP00000388470
MATGANATPLAAAASTATVPRRLVPAAAAAPSAAALPARVAAAAAATPAAA

SEQ ID NO: 83597 - protein, 200 aa, Homo sapiens
  Payload ID: 16635
  Gene Symbol: SF1
  Gene Name: splicing factor 1
  ENSP ID: ENSP00000391198
SLMSTTQSRPPWMNSGPSESRPYHGMHGGGPGGPGGGPHSFPHPLPSLTGGHGGHPMQHNPNGPPPPWMQPPPPPMNQGPHPPGHHGPPPMVPALSFHQDQYLGSTPVGSGVYRLHQGKGMMPPPPMGMMPPPPPPPSGQPPPPPSGPLPPWQQQQQQPPPPPPPSSSMASSTPLPWQQRSLPAAAMARAMRVRTFRAHW

SEQ ID NO: 83598 - protein, 180 aa, Homo sapiens
  Payload ID: 16635
  Gene Symbol: SF1
  Gene Name: splicing factor 1
  ENSP ID: ENSP00000395927
  MOD_RES (1)..(1): Any amino acid
XNQGPHPPGHHGPPPMGKSVPGKYACGLWGLSPASRKRYDAATTYGHDAAAAAASQWAAPTPSLWSSSPMATTAAAASATPSAQQQYGFQYPLAMAAKYDDYHHERWHRVHPAMATAAGGCRSFSRSPSDARQPHYGAPAPRGPAASAAWGPSPSAASTAWFRRHDVCPAPSSSASHGPF

SEQ ID NO: 83599 - protein, 613 aa, Homo sapiens
  Payload ID: 16635
  Gene Symbol: SF1
  Gene Name: splicing factor 1
  Uniprot ID: Q15637
  ENSP ID: ENSP00000396793
MEQKTVIPGMPTVIPPGLTREQERAYIVQLQIEDLTRKLRTGDLGIPPNPEDRSPSPEPIYNSEGKRLNTREFRTRKKLEEERHNLITEMVALNPDFKPPADYKPPATRVSDKVMIPQDEYPEINFVGLLIGPRGNTLKNIEKECNAKIMIRGKGSVKEGKVGRKDGQMLPGEDEPLHALVTANTMENVKKAVEQIRNILKQGIETPEDQNDLRKMQLRELARLNGTLREDDNRILRPWQSSETRSITNTTVCTKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMDQYLGSTPVGSGVYRLHQGKGMMPPPPMGMMPPPPPPPSGQPPPPPSGPLPPWQQQQQQPPPPPPPSSSMASSTPLPWQQNTTTTTTSAGTGSIPPWQQQQAAAAASPGAPQMQGNPTMVPLPPGVQPPLPPGAPPPPPPPPPGSAGMMYAPPPPPPPPMDPSNFVTMMGMGVAGMPPFGMPPAPPPPPPQN

SEQ ID NO: 83600 - protein, 62 aa, Homo sapiens
  Payload ID: 16635
  Gene Symbol: SF1
  Gene Name: splicing factor 1
  ENSP ID: ENSP00000406354
MEQKTVIPGMPTVIPPGLTREQERAYIVQLQIEDLTRKLRTGDLGIPPNPEDRSPSPEPIYN

SEQ ID NO: 83601 - protein, 110 aa, Homo sapiens
  Payload ID: 16635
  Gene Symbol: SF1
  Gene Name: splicing factor 1
  ENSP ID: ENSP00000407962
MATGANATPLDFPSKKRKRSRWNQDTMEQKTVIPGMPTVIPPGLTREQERAYIGPLPLSPSTIARGSGLTPESSAPAKSWKRSGTTSSQRWLHSIRISSHLQITNLQQHV

SEQ ID NO: 83602 - protein, 291 aa, Homo sapiens
  Payload ID: 16635
  Gene Symbol: SF1
  Gene Name: splicing factor 1
  ENSP ID: ENSP00000419062
TKCGGAGHIASDCKFQRPGDPQSAQDKARMDKEYLSLMAELGEAPVPASVGSTSGPATTPLASAPRPAAPANNPPPPSLMSTTQSRPPWMNSGPSESRPYHGMHGGGPGGPGGGPHSFPHPLPSLTGGHGGHPMQHNPNGPPPPWMQPPPPPMNQGPHPPGHHGPPPMVPGKYACGLWGLSPASRKRYDAATTYGHDAAAAAASQWAAPTPSLWSSSPMATTAAAASATPSAQQQYGFQYPLAMAAKYDDYHHERWHRVHPAMATAAGGCRSFSRSPSDARQPHYGAPAPR

SEQ ID NO: 83603 - protein, 110 aa, Homo sapiens; identical to SEQ ID NO: 83601
  Payload ID: 16635
  Gene Symbol: SF1
  Gene Name: splicing factor 1
  ENSP ID: ENSP00000486693

SEQ ID NO: 83604 - protein, 793 aa, Homo sapiens
  Payload ID: 16636
  Gene Symbol: SF3A1
  Gene Name: splicing factor 3a, subunit 1, 120kDa
  Uniprot ID: Q15459
  ENSP ID: ENSP00000215793
MPAGPVQAVPPPPPVPTEPKQPTEEEASSKEDSAPSKPVVGIIYPPPEVRNIVDKTASFVARNGPEFEARIRQNEINNPKFNFLNPNDPYHAYYRHKVSEFKEGKAQEPSAAIPKVMQQQQQTTQQQLPQKVQAQVIQETIVPKEPPPEFEFIADPPSISAFDLDVVKLTAQFVARNGRQFLTQLMQKEQRNYQFDFLRPQHSLFNYFTKLVEQYTKILIPPKGLFSKLKKEAENPREVLDQVCYRVEWAKFQERERKKEEEEKEKERVAYAQIDWHDFVVVETVDFQPNEQGNFPPPTTPEELGARILIQERYEKFGESEEVEMEVESDEEDDKQEKAEEPPSQLDQDTQVQDMDEGSDDEEEGQKVPPPPETPMPPPLPPTPDQVIVRKDYDPKASKPLPPAPAPDEYLVSPITGEKIPASKMQEHMRIGLLDPRWLEQRDRSIREKQSDDEVYAPGLDIESSLKQLAERRTDIFGVEETAIGKKIGEEEIQKPEEKVTWDGHSGSMARTQQAAQANITLQEQIEAIHKAKGLVPEDDTKEKIGPSKPNEIPQQPPPPSSATNIPSSAPPITSVPRPPTMPPPVRTTVVSAVPVMPRPPMASVVRLPPGSVIAPMPPIIHAPRINVVPMPPSAPPIMAPRPPPMIVPTAFVPAPPVAPVPAPAPMPPVHPPPPMEDEPTSKKLKTEDSLMPEEEFLRRNKGPVSIKVQVPNMQDKTEWKLNGQVLVFTLPLTDQVSVIKVKIHEATGMPAGKQKLQYEGIFIKDSNSLAYYNMANGAVIHLALKERGGRKK

SEQ ID NO: 83605 - protein, 63 aa, Homo sapiens
  Payload ID: 16636
  Gene Symbol: SF3A1
  Gene Name: splicing factor 3a, subunit 1, 120kDa
  ENSP ID: ENSP00000397267
MPAGPVQAVPPPPPVPTEPKQPTEEEASSKEDSAPSKPVVGIIYPPPEVRNIVDKTASFVARS

SEQ ID NO: 83606 - protein, 259 aa, Homo sapiens
  Payload ID: 16636
  Gene Symbol: SF3A1
  Gene Name: splicing factor 3a, subunit 1, 120kDa
  ENSP ID: ENSP00000400862
GARILIQERYEKFGESEEVEMEVESDEEDDKQEKAEEPPSQLDQDTQVQDMDEGSDDEEEGQKVPPPPETPMPPPLPPTPDQVIVRKDYDPKASKPLPPAPAPDEYLVSPITGEKIPASKMQEHMRIGLLDPRWLEQRDRSIREKQSDDEVTWDGHSGSMARTQQAAQANITLQEQIEAIHKAKGLVPEDDTKEKIGPSKPNEIPQQPPPPSSATNIPSSAPPITSVPRPPTMPPPVRTTVVSAVPVMPRPPMASVVRL

SEQ ID NO: 83607 - protein, 38 aa, Homo sapiens
  Payload ID: 16636
  Gene Symbol: SF3A1
  Gene Name: splicing factor 3a, subunit 1, 120kDa
  ENSP ID: ENSP00000412715
MPAGPVQAVPPPPPVPTEPKQPLVRRSVRRRSRSQRKR

SEQ ID NO: 83608 - protein, 464 aa, Homo sapiens
  Payload ID: 16637
  Gene Symbol: SF3A2
  Gene Name: splicing factor 3a, subunit 2, 66kDa
  Uniprot ID: Q15428
  ENSP ID: ENSP00000221494
MDFQHRPGGKTGSGGVASSSESNRDRRERLRQLALETIDINKDPYFMKNHLGSYECKLCLTLHNNEGSYLAHTQGKKHQTNLARRAAKEAKEAPAQPAPEKVKVEVKKFVKIGRPGYKVTKQRDSEMGQQSLLFQIDYPEIAEGIMPRHRFMSAYEQRIEPPDRRWQYLLMAAEPYETIAFKVPSREIDKAEGKFWTHWNRETKQFFLQFHFKMEKPPAPPSLPAGPPGVKRPPPPLMNGLPPRPPLPESLPPPPPGGLPLPPMPPTGPAPSGPPGPPQLPPPAPGVHPPAPVVHPPASGVHPPAPGVHPPAPGVHPPAPGVHPPTSGVHPPAPGVHPPAPGVHPPAPGVHPPAPGVHPPAPGVHPPPSAGVHPQAPGVHPAAPAVHPQAPGVHPPAPGMHPQAPGVHPQPPGVHPSAPGVHPQPPGVHPSNPGVHPPTPMPPMLRPPLPSEGPGNIPPPPPTN

SEQ ID NO: 83609 - protein, 135 aa, Homo sapiens
  Payload ID: 16637
  Gene Symbol: SF3A2
  Gene Name: splicing factor 3a, subunit 2, 66kDa
  ENSP ID: ENSP00000466634
MDFQHRPGGKTGSGGVASSSESNRDRRERLRQLALETIDINKDPYFMKNHLGSYECKLCLTLHNNEGSYLAHTQGKKHQTNLARRAAKEAKEAPAQPAPEKVKVEVKKFVKIGRPGYKVTKQRDSEMGQQSLLFQ

SEQ ID NO: 83610 - protein, 501 aa, Homo sapiens
  Payload ID: 16638
  Gene Symbol: SF3A3
  Gene Name: splicing factor 3a, subunit 3, 60kDa
  Uniprot ID: Q12874
  ENSP ID: ENSP00000362110
METILEQQRRYHEEKERLMDVMAKEMLTKKSTLRDQINSDHRTRAMQDRYMEVSGNLRDLYDDKDGLRKEELNAISGPNEFAEFYNRLKQIKEFHRKHPNEICVPMSVEFEELLKARENPSEEAQNLVEFTDEEGYGRYLDLHDCYLKYINLKASEKLDYITYLSIFDQLFDIPKERKNAEYKRYLEMLLEYLQDYTDRVKPLQDQNELFGKIQAEFEKKWENGTFPGWPKETSSALTHAGAHLDLSAFSSWEELASLGLDRLKSALLALGLKCGGTLEERAQRLFSTKGKSLESLDTSLFAKNPKSKGTKRDTERNKDIAFLEAQIYEYVEILGEQRHLTHENVQRKQARTGEEREEEEEEQISESESEDEENEIIYNPKNLPLGWDGKPIPYWLYKLHGLNINYNCEICGNYTYRGPKAFQRHFAEWRHAHGMRCLGIPNTAHFANVTQIEDAVSLWAKLKLQKASERWQPDTEEEYEDSSGNVVNKKTYEDLKRQGLL

SEQ ID NO: 83611 - protein, 1304 aa, Homo sapiens
  Payload ID: 16639
  Gene Symbol: SF3B1
  Gene Name: splicing factor 3b, subunit 1, 155kDa
  Uniprot ID: O75533
  ENSP ID: ENSP00000335321
MAKIAKTHEDIEAQIREIQGKKAALDEAQGVGLDSTGYYDQEIYGGSDSRFAGYVTSIAATELEDDDDDYSSSTSLLGQKKPGYHAPVALLNDIPQSTEQYDPFAEHRPPKIADREDEYKKHRRTMIISPERLDPFADGGKTPDPKMNARTYMDVMREQHLTKEEREIRQQLAEKAKAGELKVVNGAAASQPPSKRKRRWDQTADQTPGATPKKLSSWDQAETPGHTPSLRWDETPGRAKGSETPGATPGSKIWDPTPSHTPAGAATPGRGDTPGHATPGHGGATSSARKNRWDETPKTERDTPGHGSGWAETPRTDRGGDSIGETPTPGASKRKSRWDETPASQMGGSTPVLTPGKTPIGTPAMNMATPTPGHIMSMTPEQLQAWRWEREIDERNRPLSDEELDAMFPEGYKVLPPPAGYVPIRTPARKLTATPTPLGGMTGFHMQTEDRTMKSVNDQPSGNLPFLKPDDIQYFDKLLVDVDESTLSPEEQKERKIMKLLLKIKNGTPPMRKAALRQITDKAREFGAGPLFNQILPLLMSPTLEDQERHLLVKVIDRILYKLDDLVRPYVHKILVVIEPLLIDEDYYARVEGREIISNLAKAAGLATMISTMRPDIDNMDEYVRNTTARAFAVVASALGIPSLLPFLKAVCKSKKSWQARHTGIKIVQQIAILMGCAILPHLRSLVEIIEHGLVDEQQKVRTISALAIAALAEAATPYGIESFDSVLKPLWKGIRQHRGKGLAAFLKAIGYLIPLMDAEYANYYTREVMLILIREFQSPDEEMKKIVLKVVKQCCGTDGVEANYIKTEILPPFFKHFWQHRMALDRRNYRQLVDTTVELANKVGAAEIISRIVDDLKDEAEQYRKMVMETIEKIMGNLGAADIDHKLEEQLIDGILYAFQEQTTEDSVMLNGFGTVVNALGKRVKPYLPQICGTVLWRLNNKSAKVRQQAADLISRTAVVMKTCQEEKLMGHLGVVLYEYLGEEYPEVLGSILGALKAIVNVIGMHKMTPPIKDLLPRLTPILKNRHEKVQENCIDLVGRIADRGAEYVSAREWMRICFELLELLKAHKKAIRRATVNTFGYIAKAIGPHDVLATLLNNLKVQERQNRVCTTVAIAIVAETCSPFTVLPALMNEYRVPELNVQNGVLKSLSFLFEYIGEMGKDYIYAVTPLLEDALMDRDLVHRQTASAVVQHMSLGVYGFGCEDSLNHLLNYVWPNVFETSPHVIQAVMGALEGLRVAIGPCRMLQYCLQGLFHPARKVRDVYWKIYNSIYIGSQDALIAHYPRIYNDDKNTYIRYELDYIL

SEQ ID NO: 83612 - protein, 37 aa, Homo sapiens
  Payload ID: 16639
  Gene Symbol: SF3B1
  Gene Name: splicing factor 3b, subunit 1, 155kDa
  ENSP ID: ENSP00000392117
MAKIAKTHEDIEAQIREIQGKKAALDEAQGVGLDSTG

SEQ ID NO: 83613 - protein, 144 aa, Homo sapiens
  Payload ID: 16639
  Gene Symbol: SF3B1
  Gene Name: splicing factor 3b, subunit 1, 155kDa
  Uniprot ID: O75533
  ENSP ID: ENSP00000402997
MAKIAKTHEDIEAQIREIQGKKAALDEAQGVGLDSTGYYDQEIYGGSDSRFAGYVTSIAATELEDDDDDYSSSTSLLGQKKPGYHAPVALLNDIPQSTEQYDPFAEHRPPKIADREDEYKKHRRTMIISPERLDPFADGFYSAA

SEQ ID NO: 83614 - protein, 241 aa, Homo sapiens
  Payload ID: 16639
  Gene Symbol: SF3B1
  Gene Name: splicing factor 3b, subunit 1, 155kDa
  ENSP ID: ENSP00000409435
  MOD_RES (1)..(1): Any amino acid
XSKYALHCRETGDLFVLQLKGMHKMTPPIKDLLPRLTPILKNRHEKVQENCIDLVGRIADRGAEYVSAREWMRICFELLELLKAHKKAIRRATVNTFGYIAKAIGPHDVLATLLNNLKVQERQNRVCTTVAIAIVAETCSPFTVLPALMNEYRVPELNVQNGVLKSLSFLFEYIGEMGKDYIYAVTPLLEDALMDRDLVHRQTASAVVQHMSLGVYGFGCEDSLNHLLNYVWPNVFETSPH

SEQ ID NO: 83615 - protein, 154 aa, Homo sapiens
  Payload ID: 16639
  Gene Symbol: SF3B1
  Gene Name: splicing factor 3b, subunit 1, 155kDa
  ENSP ID: ENSP00000419896
MAKIAKTHEDIEAQIREIQGKKAALDEAQGVGLDSTGYYDQEIYGGSDSRFAGYVTSIAATELEDDDDDYSSSTSLLGQKKPGYHAPVALLNDIPQSTEQYDPFAEHRPPKIADREDEYKKHRRTMIISPERLDPFADGNSFPLFYKYSEIYLY

SEQ ID NO: 83616 - protein, 144 aa, Homo sapiens; identical to SEQ ID NO: 83613
  Payload ID: 16639
  Gene Symbol: SF3B1
  Gene Name: splicing factor 3b, subunit 1, 155kDa
  Uniprot ID: O75533
  ENSP ID: ENSP00000428820

SEQ ID NO: 83617 - protein, 895 aa, Homo sapiens
  Payload ID: 16640
  Gene Symbol: SF3B2
  Gene Name: splicing factor 3b, subunit 2, 145kDa
  Uniprot ID: Q13435
  ENSP ID: ENSP00000318861
MATEHPEPPKAELQLPPPPPPGHYGAWAAQELQAKLAEIGAPIQGNREELVERLQSYTRQTGIVLNRPVLRGEDGDKAAPPPMSAQLPGIPMPPPPLGLPPLQPPPPPPPPPPGLGLGFPMAHPPNLGPPPPLRVGEPVALSEEERLKLAQQQAALLMQQEERAKQQGDHSLKEHELLEQQKRAAVLLEQERQQEIAKMGTPVPRPPQDMGQIGVRTPLGPRVAAPVGPVGPTPTVLPMGAPVPRPRGPPPPPGDENREMDDPSVGPKIPQALEKILQLKESRQEEMNSQQEEEEMETDARSSLGQSASETEEDTVSVSKKEKNRKRRNRKKKKKPQRVRGVSSESSGDREKDSTRSRGSDSPAADVEIEYVTEEPEIYEPNFIFFKRIFEAFKLTDDVKKEKEKEPEKLDKLENSAAPKKKGFEEEHKDSDDDSSDDEQEKKPEAPKLSKKKLRRMNRFTVAELKQLVARPDVVEMHDVTAQDPKLLVHLKATRNSVPVPRHWCFKRKYLQGKRGIEKPPFELPDFIKRTGIQEMREALQEKEEQKTMKSKMREKVRPKMGKIDIDYQKLHDAFFKWQTKPKLTIHGDLYYEGKEFETRLKEKKPGDLSDELRISLGMPVGPNAHKVPPPWLIAMQRYGPPPSYPNLKIPGLNSPIPESCSFGYHAGGWGKPPVDETGKPLYGDVFGTNAAEFQTKTEEEEIDRTPWGELEPSDEESSEEEEEEESDEDKPDETGFITPADSGLITPGGFSSVPAGMETPELIELRKKKIEEAMDGSETPQLFTVLPEKRTATVGGAMMGSTHIYDMSTVMSRKGPAPELQGVEVALAPEELELDPMAMTQKYEEHVREQQAQVEKEDFSDMVAEHAAKQKQKKRKAQPQDSRGGSKKYKEFKF

SEQ ID NO: 83618 - protein, 387 aa, Homo sapiens
  Payload ID: 16640
  Gene Symbol: SF3B2
  Gene Name: splicing factor 3b, subunit 2, 145kDa
  ENSP ID: ENSP00000431520
PEPPKAELQLPPPPPPGHYGAWAAQELQAKLAEIGAPIQGNREELVERLQSYTRQTGIVLNRPVLRGEDGDKAAPPPMSAQLPGIPMPPPPLGLPPLQPPPPPPPPPPGLGLGFPMAHPPNLGPPPPLRVGEPVALSEEERLKLAQQQAALLMQQEERAKQQGDHSLKEHELLEQQKRAAVLLEQERQQEIAKMGTPVPRPPQDMGQIGVRTPLGPRAAPVGPVGPTPTVLPMGAPVPRPRGPPPPPGDENREMDDPSVGPKIPQALEKILQLKESRQEEMNSQQEEEEMETDARSSLGQSASETEEDTVSVSKKEKNRKRRNRKKKKKPQRVRGVSSESSGDREKDSTRSRGSDSPAADVEIEYVTEEPEIYEPNFIFFKRIFEAF

SEQ ID NO: 83619 - protein, 353 aa, Homo sapiens
  Payload ID: 16640
  Gene Symbol: SF3B2
  Gene Name: splicing factor 3b, subunit 2, 145kDa
  ENSP ID: ENSP00000431908
MATEHPEPPKAELQLPPPPPPGHYGAWAAQELQAKLAEIGAPIQGNREELVERLQSYTRQTGIVLNRPVLRGEDGDKAAPPPMSAQLPGIPMPPPPLGLPPLQPPPPPPPPPPGLGLGFPMAHPPNLGPPPPLRVGEPVALSEEERLKLAQQQAALLMQQEERAKQGDHSLKEHELLEQQKRAAVLLEQERQQEIAKMGTPVPRPPQDMGQIGVRTPLGPRAAPVGPVGPTPTVLPMGAPVPRPRGPPPPPGDENREMDDPSVGPKIPQALEKILQLKESRQEEMNSQQEEEEMETDARSSLGQSASETEEDTVSVSKKEKNRKRRNRKKKKKPQRVRGVSSESSGDREKDST

SEQ ID NO: 83620 - protein, 878 aa, Homo sapiens
  Payload ID: 16640
  Gene Symbol: SF3B2
  Gene Name: splicing factor 3b, subunit 2, 145kDa
  ENSP ID: ENSP00000432655
MATEHPEPPKAELQLPPPPPPGHYGAWAAQELQAKLAEIGAPIQGNREELVERLQSYTRQTGIVLNRPVLRGEDGDKAAPPPMSAQLPGIPMPPPPLGLPPLQPPPPPPPPPPGLGLGFPMAHPPNLGPPPPLRVGEPVALSEEERLKLAQQQAALLMQQEERAKQAAVLLEQERQQEIAKMGTPVPRPPQDMGQIGVRTPLGPRVAAPVGPVGPTPTVLPMGAPVPRPRGPPPPPGDENREMDDPSVGPKIPQALEKILQLKESRQEEMNSQQEEEEMETDARSSLGQSASETEEDTVSVSKKEKNRKRRNRKKKKKPQRVRGVSSESSGDREKDSTRSRGSDSPAADVEIEYVTEEPEIYEPNFIFFKRIFEAFKLTDDVKKEKEKEPEKLDKLENSAAPKKKGFEEEHKDSDDDSSDDEQEKKPEAPKLSKKKLRRMNRFTVAELKQLVARPDVVEMHDVTAQDPKLLVHLKATRNSVPVPRHWCFKRKYLQGKRGIEKPPFELPDFIKRTGIQEMREALQEKEEQKTMKSKMREKVRPKMGKIDIDYQKLHDAFFKWQTKPKLTIHGDLYYEGKEFETRLKEKKPGDLSDELRISLGMPVGPNAHKVPPPWLIAMQRYGPPPSYPNLKIPGLNSPIPESCSFGYHAGGWGKPPVDETGKPLYGDVFGTNAAEFQTKTEEEEIDRTPWGELEPSDEESSEEEEEEESDEDKPDETGFITPADSGLITPGGFSSVPAGMETPELIELRKKKIEEAMDGSETPQLFTVLPEKRTATVGGAMMGSTHIYDMSTVMSRKGPAPELQGVEVALAPEELELDPMAMTQKYEEHVREQQAQVEKEDFSDMVAEHAAKQKQKKRKAQPQDSRGGSKKYKEFKF

SEQ ID NO: 83621 - protein, 273 aa, Homo sapiens
  Payload ID: 16640
  Gene Symbol: SF3B2
  Gene Name: splicing factor 3b, subunit 2, 145kDa
  ENSP ID: ENSP00000435495
MATEHPEPPKAELQLPPPPPPGHYGAWAAQELQAKLAEIGAPIQGNREELVERLQSYTRQTGIVLNRPVLRGEDGDKAAPPPMSAQLPGIPMPPPPLGLPPLQPPPPPPPPPPGLGLGFPMAHPPNLGPPPPLRVGEPVALSEEERLKLAQQQAALLMQQEERAKQGDHSLKEHELLEQQKRAAVLLEQERQQEIAKMGTPVPRPPQDMGQIGVRTPLGPRVAAPVGPVGPTPTVLPMGAPVPRPRGPPPPPGDENREMDDPSVGPKIPQALE

SEQ ID NO: 83622 - protein, 80 aa, Homo sapiens
  Payload ID: 16640
  Gene Symbol: SF3B2
  Gene Name: splicing factor 3b, subunit 2, 145kDa
  ENSP ID: ENSP00000435765
MSAQLPGIPMPPPPLGLPPLQPPPPPPPPPPGLGLGFPMAHPPNLGPPPPLRVGEPVALSEEERLKLAQQQAALLMQQEE

SEQ ID NO: 83623 - protein, 315 aa, Homo sapiens
  Payload ID: 16640
  Gene Symbol: SF3B2
  Gene Name: splicing factor 3b, subunit 2, 145kDa
  ENSP ID: ENSP00000436757
  MOD_RES (1)..(1): Any amino acid
XKPKLTIHGDLYYEGKEFETRLKEKKPGDLSDELRISLGMPVGPNAHKVPPPWLIAMQRYGPPPSYPNLKIPGLNSPIPESCSFGYHAGGWGKPPVDETGKPLYGDVFGTNAAEFQTKTEEEEIDRTPWGELEPSDEESSEEEEEEESDEDKPDETGFITPADSGLITPGGFSSVPAGMETPELIELRKKKIEEAMDGETPQLFTVLPEKRTATVGGAMMGSTHIYDMSTVMSRKGPAPELQGVEVALAPEELELDPMAMTQKYEEHVREQQAQVEKEDFSDMVAEHAAKQKQKKRKAQPQDSRGGSKKYKEFKF

SEQ ID NO: 83624 - protein, 871 aa, Homo sapiens
  Payload ID: 16640
  Gene Symbol: SF3B2
  Gene Name: splicing factor 3b, subunit 2, 145kDa
  ENSP ID: ENSP00000482986
MAPGAQELQAKLAEIGAPIQGNREELVERLQSYTRQTGIVLNRPVLRGEDGDKAAPPPMSAQLPGIPMPPPPLGLPPLQPPPPPPPPPPGLGLGFPMAHPPNLGPPPPLRVGEPVALSEEERLKLAQQQAALLMQQEERAKQQGDHSLKEHELLEQQKRAAVLLEQERQQEIAKMGTPVPRPPQDMGQIGVRTPLGPRVAAPVGPVGPTPTVLPMGAPVPRPRGPPPPPGDENREMDDPSVGPKIPQALEKILQLKESRQEEMNSQQEEEEMETDARSSLGQSASETEEDTVSVSKKEKNRKRRNRKKKKKPQRVRGVSSESSGDREKDSTRSRGSDSPAADVEIEYVTEEPEIYEPNFIFFKRIFEAFKLTDDVKKEKEKEPEKLDKLENSAAPKKKGFEEEHKDSDDDSSDDEQEKKPEAPKLSKKKLRRMNRFTVAELKQLVARPDVVEMHDVTAQDPKLLVHLKATRNSVPVPRHWCFKRKYLQGKRGIEKPPFELPDFIKRTGIQEMREALQEKEEQKTMKSKMREKVRPKMGKIDIDYQKLHDAFFKWQTKPKLTIHGDLYYEGKEFETRLKEKKPGDLSDELRISLGMPVGPNAHKVPPPWLIAMQRYGPPPSYPNLKIPGLNSPIPESCSFGYHAGGWGKPPVDETGKPLYGDVFGTNAAEFQTKTEEEEIDRTPWGELEPSDEESSEEEEEEESDEDKPDETGFITPADSGLITPGGFSSVPAGMETPELIELRKKKIEEAMDGSETPQLFTVLPEKRTATVGGAMMGSTHIYDMSTVMSRKGPAPELQGVEVALAPEELELDPMAMTQKYEEHVREQQAQVEKEDFSDMVAEHAAKQKQKKRKAQPQDSRGGSKKYKEFKF

SEQ ID NO: 83625 - protein, 1217 aa, Homo sapiens
  Payload ID: 16641
  Gene Symbol: SF3B3
  Gene Name: splicing factor 3b, subunit 3, 130kDa
  Uniprot ID: Q15393
  ENSP ID: ENSP00000305790
MFLYNLTLQRATGISFAIHGNFSGTKQQEIVVSRGKILELLRPDPNTGKVHTLLTVEVFGVIRSLMAFRLTGGTKDYIVVGSDSGRIVILEYQPSKNMFEKIHQETFGKSGCRRIVPGQFLAVDPKGRAVMISAIEKQKLVYILNRDAAARLTISSPLEAHKANTLVYHVVGVDVGFENPMFACLEMDYEEADNDPTGEAAANTQQTLTFYELDLGLNHVVRKYSEPLEEHGNFLITVPGGSDGPSGVLICSENYITYKNFGDQPDIRCPIPRRRNDLDDPERGMIFVCSATHKTKSMFFFLAQTEQGDIFKITLETDEDMVTEIRLKYFDTVPVAAAMCVLKTGFLFVASEFGNHYLYQIAHLGDDDEEPEFSSAMPLEEGDTFFFQPRPLKNLVLVDELDSLSPILFCQIADLANEDTPQLYVACGRGPRSSLRVLRHGLEVSEMAVSELPGNPNAVWTVRRHIEDEFDAYIIVSFVNATLVLSIGETVEEVTDSGFLGTTPTLSCSLLGDDALVQVYPDGIRHIRADKRVNEWKTPGKKTIVKCAVNQRQVVIALTGGELVYFEMDPSGQLNEYTERKEMSADVVCMSLANVPPGEQRSRFLAVGLVDNTVRIISLDPSDCLQPLSMQALPAQPESLCIVEMGGTEKQDELGERGSIGFLYLNIGLQNGVLLRTVLDPVTGDLSDTRTRYLGSRPVKLFRVRMQGQEAVLAMSSRSWLSYSYQSRFHLTPLSYETLEFASGFASEQCPEGIVAISTNTLRILALEKLGAVFNQVAFPLQYTPRKFVIHPESNNLIIIETDHNAYTEATKAQRKQQMAEEMVEAAGEDERELAAEMAAAFLNENLPESIFGAPKAGNGQWASVIRVMNPIQGNTLDLVQLEQNEAAFSVAVCRFSNTGEDWYVLVGVAKDLILNPRSVAGGFVYTYKLVNNGEKLEFLHKTPVEEVPAAIAPFQGRVLIGVGKLLRVYDLGKKKLLRKCENKHIANYISGIQTIGHRVIVSDVQESFIWVRYKRNENQLIIFADDTYPRWVTTASLLDYDTVAGADKFGNICVVRLPPNTNDEVDEDPTGNKALWDRGLLNGASQKAEVIMNYHVGETVLSLQKTTLIPGGSESLVYTTLSGGIGILVPFTSHEDHDFFQHVEMHLRSEHPPLCGRDHLSFRSYYFPVKNVIDGDLCEQFNSMEPNKQKNVSEELDRTPPEVSKKLEDIRTRYAF

SEQ ID NO: 83626 - protein, 30 aa, Homo sapiens
  Payload ID: 16641
  Gene Symbol: SF3B3
  Gene Name: splicing factor 3b, subunit 3, 130kDa
  ENSP ID: ENSP00000454308
MFLYNLTLQRATGISFAIHGNFSGTKQQEI

SEQ ID NO: 83627 - protein, 72 aa, Homo sapiens
  Payload ID: 16641
  Gene Symbol: SF3B3
  Gene Name: splicing factor 3b, subunit 3, 130kDa
  ENSP ID: ENSP00000461236
MFLYNLTLQRATGISFAIHGNFSGTKQQEIVVSRGKILELLRPDPNTGKVHTLLTVEVFGVIRSLMAFRLTG

SEQ ID NO: 83628 - protein, 4 aa, Homo sapiens
  Payload ID: 16641
  Gene Symbol: SF3B3
  Gene Name: splicing factor 3b, subunit 3, 130kDa
  ENSP ID: ENSP00000461342
MFLY

SEQ ID NO: 83629 - protein, 91 aa, Homo sapiens
  Payload ID: 16641
  Gene Symbol: SF3B3
  Gene Name: splicing factor 3b, subunit 3, 130kDa
  ENSP ID: ENSP00000463253
EEGDTFFFQPRPLKNLVLVDELDSLSPILFCQIADLANEDTPQLYVACGRGPRSSLRVLRHGLEVSEMAVSELPGNPNAVWTVRRHIEGGW

SEQ ID NO: 83630 - protein, 57 aa, Homo sapiens
  Payload ID: 16641
  Gene Symbol: SF3B3
  Gene Name: splicing factor 3b, subunit 3, 130kDa
  ENSP ID: ENSP00000463359
MAFRLTGGTKDYIVVGSDSGRIVILEYQPSKNMFEKIHQETFGKSGCRRIVPGQFLA

SEQ ID NO: 83631 - protein, 31 aa, Homo sapiens
  Payload ID: 16641
  Gene Symbol: SF3B3
  Gene Name: splicing factor 3b, subunit 3, 130kDa
  ENSP ID: ENSP00000464126
MAFRLTGGTKDYIVVGSDSGRIVILEYQPSK

SEQ ID NO: 83632 - protein, 424 aa, Homo sapiens
  Payload ID: 16642
  Gene Symbol: SF3B4
  Gene Name: splicing factor 3b, subunit 4, 49kDa
  Uniprot ID: Q15427
  ENSP ID: ENSP00000271628
MAAGPISERNQDATVYVGGLDEKVSEPLLWELFLQAGPVVNTHMPKDRVTGQHQGYGFVEFLSEEDADYAIKIMNMIKLYGKPIRVNKASAHNKNLDVGANIFIGNLDPEIDEKLLYDTFSAFGVILQTPKIMRDPDTGNSKGYAFINFASFDASDAAIEAMNGQYLCNRPITVSYAFKKDSKGERHGSAAERLLAAQNPLSQADRPHQLFADAPPPPSAPNPVVSSLGSGLPPPGMPPPGSFPPPVPPPGALPPGIPPAMPPPPMPPGAAGHGPPSAGTPGAGHPGHGHSHPHPFPPGGMPHPGMSQMQLAHHGPHGLGHPHAGPPGSGGQPPPRPPPGMPHPGPPPMGMPPRGPPFGSPMGHPGPMPPHGMRGPPPLMPPHGYTGPPRPPPYGYQRGPLPPPRPTPRPPVPPRGPLRGPLPQ

SEQ ID NO: 83633 - protein, 190 aa, Homo sapiens
  Payload ID: 16642
  Gene Symbol: SF3B4
  Gene Name: splicing factor 3b, subunit 4, 49kDa
  ENSP ID: ENSP00000391114
MPKDRVTGQHQGYGFVEFLSEEDADYAIKIMNMIKLYGKPIRVNKASAHNKNLDVGANIFIGNLDPEIDEKLLYDTFSAFGVILQTPKIMRDPDTGNSKGYAFINFASFDASDAAIEAMNGQYLCNRPITVSYAFKKDSKGERHGSAAERLLAAQNPLSQADRPHQLFADAPPPPSAPNPVVSSLGSGLP

SEQ ID NO: 83634 - protein, 86 aa, Homo sapiens
  Payload ID: 16643
  Gene Symbol: SF3B5
  Gene Name: splicing factor 3b, subunit 5, 10kDa
  Uniprot ID: Q9BWJ5
  ENSP ID: ENSP00000356541
MTDRYTIHSQLEHLQSKYIGTGHADTTKWEWLVNQHRDSYCSYMGHFDLLNYFAIAENESKARVRFNLMEKMLQPCGPPADKPEEN

SEQ ID NO: 83635 - protein, 125 aa, Homo sapiens
  Payload ID: 16644
  Gene Symbol: SF3B6
  Gene Name: splicing factor 3b, subunit 6, 14kDa
  Uniprot ID: Q9Y3B4
  ENSP ID: ENSP00000233468
MAMQAAKRANIRLPPEVNRILYIRNLPYKITAEEMYDIFGKYGPIRQIRVGNTPETRGTAYVVYEDIFDAKNACDHLSGFNVCNRYLVVLYYNANRAFQKMDTKKKEEQLKLLKEKYGINTDPPK

SEQ ID NO: 83636 - protein, 707 aa, Homo sapiens
  Payload ID: 16645
  Gene Symbol: SFPQ
  Gene Name: splicing factor proline/glutamine-rich
  Uniprot ID: P23246
  ENSP ID: ENSP00000349748
MSRDRFRSRGGGGGGFHRRGGGGGRGGLHDFRSPPPGMGLNQNRGPMGPGPGQSGPKPPIPPPPPHQQQQQPPPQQPPPQQPPPHQPPPHPQPHQQQQPPPPPQDSSKPVVAQGPGPAPGVGSAPPASSSAPPATPPTSGAPPGSGPGPTPTPPPAVTSAPPGAPPPTPPSSGVPTTPPQAGGPPPPPAAVPGPGPGPKQGPGPGGPKGGKMPGGPKPGGGPGLSTPGGHPKPPHRGGGEPRGGRQHHPPYHQQHHQGPPPGGPGGRSEEKISDSEGFKANLSLLRRPGEKTYTQRCRLFVGNLPADITEDEFKRLFAKYGEPGEVFINKGKGFGFIKLESRALAEIAKAELDDTPMRGRQLRVRFATHAAALSVRNLSPYVSNELLEEAFSQFGPIERAVVIVDDRGRSTGKGIVEFASKPAARKAFERCSEGVFLLTTTPRPVIVEPLEQLDDEDGLPEKLAQKNPMYQKERETPPRFAQHGTFEYEYSQRWKSLDEMEKQQREQVEKNMKDAKDKLESEMEDAYHEHQANLLRQDLMRRQEELRRMEELHNQEMQKRKEMQLRQEEERRRREEEMMIRQREMEEQMRRQREESYSRMGYMDPRERDMRMGGGGAMNMGDPYGSGGQKFPPLGGGGGIGYEANPGVPPATMSGSMMGSDMRTERFGQGGAGPVGGQGPRGMGPGTPAGYGRGREEYEGPNKKPRF

SEQ ID NO: 83637 - protein, 223 aa, Homo sapiens
  Payload ID: 16645
  Gene Symbol: SFPQ
  Gene Name: splicing factor proline/glutamine-rich
  ENSP ID: ENSP00000424440
VEPLEQLDDEDGLPEKLAQKNPMYQKERETPPRFAQHGTFEYEYSQRWKSLDEMEKQQREQVEKNMKDAKDKLESEMEDAYHEHQANLLRQDLMRRQEELRRMEELHNQEMQKRKEMQLRQEEERRRREEEMMIRQREMEEQMRRQREESYSRMGYMDPRERDMRMGGGGAMNMGDPYGSGGQKFPPLGGGGGIGYEANPGVPPATMSGSMMGSDMVRMIDVG

SEQ ID NO: 83638 - protein, 88 aa, Homo sapiens
  Payload ID: 16645
  Gene Symbol: SFPQ
  Gene Name: splicing factor proline/glutamine-rich
  ENSP ID: ENSP00000425071
  MOD_RES (1)..(1): Any amino acid
XREMEEQMRRQREESYSRMGYMDPRERDMRMGGGGAMNMGDPYGSGGQKFPPLGGGGGIGYEANPGVPPATMSGSMMGSDMVRMIDVG

SEQ ID NO: 83639 - protein, 951 aa, Homo sapiens
  Payload ID: 16646
  Gene Symbol: SFSWAP
  Gene Name: splicing factor, suppressor of white-apricot family
  Uniprot ID: Q12872
  ENSP ID: ENSP00000261674
MYGASGGRAKPERKSGAKEEAGPGGAGGGGSRVELLVFGYACKLFRDDERALAQEQGQHLIPWMGDHKILIDRYDGRGHLHDLSEYDAEYSTWNRDYQLSEEEARIEALCDEERYLALHTDLLEEEARQEEEYKRLSEALAEDGSYNAVGFTYGSDYYDPSEPTEEEEPSKQREKNEAENLEENEEPFVAPLGLSVPSDVELPPTAKMHAIIERTASFVCRQGAQFEIMLKAKQARNSQFDFLRFDHYLNPYYKFIQKAMKEGRYTVLAENKSDEKKKSGVSSDNEDDDDEEDGNYLHPSLFASKKCNRLEELMKPLKVVDPDHPLAALVRKAQADSSTPTPHNADGAPVQPSQVEYTADSTVAAMYYSYYMLPDGTYCLAPPPPGIDVTTYYSTLPAGVTVSNSPGVTTTAPPPPGTTPLPPPTTAETSSGATSTTTTTSALAPVAAIIPPPPDVQPVIDKLAEYVARNGLKFETSVRAKNDQRFEFLQPWHQYNAYYEFKKQFFLQKEGGDSMQAVSAPEEAPTDSAPEKPSDAGEDGAPEDAAEVGARAGSGGKKEASSSKTVPDGKLVKASFAPISFAIKAKENDLLPLEKNRVKLDDDSDDDEESKEGQESSSSAANTNPAVAPPCVVVEEKKPQLTQEELEAKQAKQKLEDRLAAAAREKLAQASKESKEKQLQAERKRKAALFLQTLKNPLPEAEAGKIEESPFSVEESSTTPCPLLTGGRPLPTLEVKPPDRPSSKSKDPPREEEKEKKKKKHKKRSRTRSRSPKYHSSSKSRSRSHSKAKHSLPSAYRTVRRSRSRSRSPRRRAHSPERRREERSVPTAYRVSRSPGASRKRTRSRSPHEKKKKRRSRSRTKSKARSQSVSPSKQAAPRPAAPAAHSAHSASVSPVESRGSSQERSRGVSQEKEAQISSAIVSSVQSKITQDLMAKVRAMLAASKNLQTSAS

SEQ ID NO: 83640 - protein, 1003 aa, Homo sapiens
  Payload ID: 16646
  Gene Symbol: SFSWAP
  Gene Name: splicing factor, suppressor of white-apricot family
  Uniprot ID: Q12872
  ENSP ID: ENSP00000437738
MYGASGGRAKPERKSGAKEEAGPGGAGGGGSRVELLVFGYACKLFRDDERALAQEQGQHLIPWMGDHKILIDRYDGRGHLHDLSEYDAEYSTWNRDYQLSEEEARIEALCDEERYLALHTDLLEEEARQEEEYKRLSEALAEDGSYNAVGFTYGSDYYDPSEPTEEEEPSKQREKNEAENLEENEEPFVAPLGLSVPSDVELPPTAKMHAIIERTASFVCRQGAQFEIMLKAKQARNSQFDFLRFDHYLNPYYKFIQKAMKEGRYTVLAENKSDEKKKSGVSSDNEDDDDEEDGNYLHPSLFASKKCNRLEELMKPLKVVDPDHPLAALVRKAQADSSTPTPHNADGAPVQPSQVEYTADSTVAAMYYSYYMLPDGTYCLAPPPPGIDVTTYYSTLPAGVTVSNSPGVTTTAPPPPGTTPLPPPTTAETSSGATSTTTTTSALAPVAAIIPPPPDVQPVIDKLAEYVARNGLKFETSVRAKNDQRFEFLQPWHQYNAYYEFKKQFFLQKEGGDSMQAVSAPEEAPTDSAPEKPSDAGEDGAPEDAAEVGARAGSGGKKEASSSKTVPDGKLVKASFAPISFAIKAKENDLLPLEKNRVKLDDDSDDDEESKEGQESSSSAANTNPAVAPPCVVVEEKKPQLTQEELEAKQAKQKLEDRLAAAAREKLAQASKESKEKQLQAERKRKAALFLQTLKNPLPEAEAGKIEESPFSVEESSTTPCPLLTGGRPLPTLEVKPPDRPSSKSKDPPREEEKEKKKKKHKKRSRTRSRSPKYHSSSKSRSRSHSKAKHSLPSAYRTVRRSRVTASPGTLRAEPCQSSASVTAAAEPGSYQAASTTTRFDSASSFEGKPGKTSRSRSRSPRRRAHSPERRREERSVPTAYRVSRSPGASRKRTRSRSPHEKKKKRRSRSRTKSKARSQSVSPSKQAAPRPAAPAAHSAHSASVSPVESRGSSQERSRGVSQEKEAQISSAIVSSVQSKITQDLMAKVRAMLAASKNLQTSAS

SEQ ID NO: 83641 - protein, 320 aa, Homo sapiens
  Payload ID: 16646
  Gene Symbol: SFSWAP
  Gene Name: splicing factor, suppressor of white-apricot family
  ENSP ID: ENSP00000439957
  MOD_RES (1)..(1): Any amino acid
XTVAAMYYSYYMLPDGTYCLAPPPPGIDVTTYYSTLPAGVTVSNSPGVTTTAPPPPGTTPLPPPTTAETSSGATSTTTTTSALAPVAAIIPPPPDVQPVIDKLAEYVARNGLKFETSVRAKNDQRFEFLQPWHQYNAYYEFKKQFFLQKEGGDSMQAVSAPEEAPTDSAPEKPSDAGEDGAPEDAAEVGARAGSGGKKEASSSKTVPDGKLVKAKQKLEDRLAAAAREKLAQASKESKEKQLQAERKRKAALFLQTLKNPLPEAEAGKIEESPFSVEESSTTPCPLLTGGRPLPTLEVKPPDRPSSKSKDPPREEEKEKK

SEQ ID NO: 83642 - protein, 121 aa, Homo sapiens
  Payload ID: 16646
  Gene Symbol: SFSWAP
  Gene Name: splicing factor, suppressor of white-apricot family
  ENSP ID: ENSP00000445832
MYGASGGRAKPERKSGAKEEAGPGGAGGGGSRVELLVFGYACKLFRDDERALAQEQGQHLIPWMGDHKILIDRYDGRGHLHDLSEYDAEYSTWNRDYQLSEEEARIEALCDEERGRIQAIE

SEQ ID NO: 83643 - protein, 624 aa, Homo sapiens
  Payload ID: 16647
  Gene Symbol: SREK1
  Gene Name: splicing regulatory glutamine/lysine-rich protein 1
  Uniprot ID: Q8WXA9
  ENSP ID: ENSP00000334538
MNSGGGFGLGLGFGLTPTSVIQVTNLSSAVTSEQMRTLFSFLGEIEELRLYPPDNAPLAFSSKVCYVKFRDPSSVGVAQHLTNTVFIDRALIVVPCAEGKIPEESKALSLLAPAPTMTSLMPGAGLLPIPTPNPLTTLGVSLSSLGAIPAAALDPNIATLGEIPQPPLMGNVDPSKIDEIRRTVYVGNLNSQTTTADQLLEFFKQVGEVKFVRMAGDETQPTRFAFVEFADQNSVPRALAFNGVMFGDRPLKINHSNNAIVKPPEMTPQAAAKELEEVMKRVREAQSFISAAIEPESGKSNERKGGRSRSHTRSKSRSSSKSHSRRKRSQSKHRSRSHNRSRSRQKDRRRSKSPHKKRSKSRERRKSRSRSHSRDKRKDTREKIKEKERVKEKDREKEREREKEREKEKERGKNKDRDKEREKDREKDKEKDREREREKEHEKDRDKEKEKEQDKEKEREKDRSKEIDEKRKKDKKSRTPPRSYNASRRSRSSSRERRRRRSRSSSRSPRTSKTIKRKSSRSPSPRSRNKKDKKREKERDHISERRERERSTSMRKSSNDRDGKEKLEKNSTSLKEKEHNKEPDSSVSKEVDDKDAPRTEENKIQHNGNCQLNEENLSTKTEAV

SEQ ID NO: 83644 - protein, 508 aa, Homo sapiens
  Payload ID: 16647
  Gene Symbol: SREK1
  Gene Name: splicing regulatory glutamine/lysine-rich protein 1
  Uniprot ID: Q8WXA9
  ENSP ID: ENSP00000370305
MTSLMPGAGLLPIPTPNPLTTLGVSLSSLGAIPAAALDPNIATLGEIPQPPLMGNVDPSKIDEIRRTVYVGNLNSQTTTADQLLEFFKQVGEVKFVRMAGDETQPTRFAFVEFADQNSVPRALAFNGVMFGDRPLKINHSNNAIVKPPEMTPQAAAKELEEVMKRVREAQSFISAAIEPESGKSNERKGGRSRSHTRSKSRSSSKSHSRRKRSQSKHRSRSHNRSRSRQKDRRRSKSPHKKRSKSRERRKSRSRSHSRDKRKDTREKIKEKERVKEKDREKEREREKEREKEKERGKNKDRDKEREKDREKDKEKDREREREKEHEKDRDKEKEKEQDKEKEREKDRSKEIDEKRKKDKKSRTPPRSYNASRRSRSSSRERRRRRSRSSSRSPRTSKTIKRKSSRSPSPRSRNKKDKKREKERDHISERRERERSTSMRKSSNDRDGKEKLEKNSTSLKEKEHNKEPDSSVSKEVDDKDAPRTEENKIQHNGNCQLNEENLSTKTEAV

SEQ ID NO: 83645 - protein, 132 aa, Homo sapiens
  Payload ID: 16647
  Gene Symbol: SREK1
  Gene Name: splicing regulatory glutamine/lysine-rich protein 1
  ENSP ID: ENSP00000427935
MNSGGGFGLGLGFGLTPTSVIQVTNLSSAVTSEQMRTLFSFLGEIEELRLYPPDNAPLAFSSKVCYVKFRDPSSVGVAQHLTNTVFIDRALIVVPCAEVMQPTRTVVMCNTTFDHRENTVLGKRPCLISFGS

SEQ ID NO: 83646 - protein, 76 aa, Homo sapiens
  Payload ID: 16647
  Gene Symbol: SREK1
  Gene Name: splicing regulatory glutamine/lysine-rich protein 1
  ENSP ID: ENSP00000428272
MTSLMPGAGLLPIPTPNPLTTLGVSLSSLGAIPAAALDPNIATLGEIPQPPLMGNVDPSKIDEIRRTVYVGNLNSQ

SEQ ID NO: 83647 - protein, 42 aa, Homo sapiens
  Payload ID: 16647
  Gene Symbol: SREK1
  Gene Name: splicing regulatory glutamine/lysine-rich protein 1
  ENSP ID: ENSP00000428970
MNSGGGFGLGLGFGLTPTSVIQSSDSCSLCRSDAANTNGCHV

SEQ ID NO: 83648 - protein, 60 aa, Homo sapiens
  Payload ID: 16647
  Gene Symbol: SREK1
  Gene Name: splicing regulatory glutamine/lysine-rich protein 1
  ENSP ID: ENSP00000430894
  MOD_RES (1)..(1): Any amino acid
XINHSNNAIVKPPEMTPQAAAKELEEVMKRVREAQSFISAAIEPGWLHSTSLCNDFLGCF

SEQ ID NO: 83649 - protein, 100 aa, Homo sapiens
  Payload ID: 16647
  Gene Symbol: SREK1
  Gene Name: splicing regulatory glutamine/lysine-rich protein 1
  ENSP ID: ENSP00000481430
MNSGGGFGLGLGFGLTPTSVIQVTNLSSAVTSEQMRTLFSFLGEIEELRLYPPDNAPLAFSSKVCYVKFRDPSSVGVAQHLTNTVFIDRALIVVPCAEDD

SEQ ID NO: 83650 - protein, 70 aa, Homo sapiens
  Payload ID: 16648
  Gene Symbol: SHFM1
  Gene Name: split hand/foot malformation (ectrodactyly) type 1
  Uniprot ID: P60896
  ENSP ID: ENSP00000248566
MSEKKQPVDLGLLEEDDEFEEFPAEDWAGLDEDEDAHVWEDNWDDDNVEDDFSNQLRAELEKHGYKMETS

SEQ ID NO: 83651 - protein, 128 aa, Homo sapiens
  Payload ID: 16648
  Gene Symbol: SHFM1
  Gene Name: split hand/foot malformation (ectrodactyly) type 1
  Uniprot ID: Q6ZVN7
  ENSP ID: ENSP00000349114
MYCQDSNICAVFAVQGGKVGRKHGIKRGRRPSIRSPAQRARGPWIHESKHPAFAKQQINLEMPNSRATTELAWVCSSTSRKKKWARSLTLSTAPLSPPPSLVHCEDCSCLPGCHSGDLYNLAPAERTC

SEQ ID NO: 83652 - protein, 62 aa, Homo sapiens
  Payload ID: 16648
  Gene Symbol: SHFM1
  Gene Name: split hand/foot malformation (ectrodactyly) type 1
  ENSP ID: ENSP00000390049
MSEKKQPVDLGLLEEDDEFEEFPAEDWAGLDEDEDAHVWEDNWDDDNVEDDFSNQLRCEKKP

SEQ ID NO: 83653 - protein, 89 aa, Homo sapiens
  Payload ID: 16648
  Gene Symbol: SHFM1
  Gene Name: split hand/foot malformation (ectrodactyly) type 1
  ENSP ID: ENSP00000392852
MSEKKQPVDLGLLEEDDEFEEFPAEDWAGLDEDEDAHVWEDNWDDDNVEDDFSNQLRATVLLMILVCETPYGCYVLHQKGRMCSAFLCC

SEQ ID NO: 83654 - protein, 89 aa, Homo sapiens; identical to SEQ ID NO: 83653
  Payload ID: 16648
  Gene Symbol: SHFM1
  Gene Name: split hand/foot malformation (ectrodactyly) type 1
  ENSP ID: ENSP00000409481

SEQ ID NO: 83655 - protein, 65 aa, Homo sapiens
  Payload ID: 16648
  Gene Symbol: SHFM1
  Gene Name: split hand/foot malformation (ectrodactyly) type 1
  ENSP ID: ENSP00000416322
MSEKKQPVDLGLLEEDDEFEEFPAEDWAGLDEDEDAHVWEDNWDDDNVEDDFSNQLRAGYSELEE

SEQ ID NO: 83656 - protein, 30 aa, Homo sapiens
  Payload ID: 16648
  Gene Symbol: SHFM1
  Gene Name: split hand/foot malformation (ectrodactyly) type 1
  ENSP ID: ENSP00000478651
MSEKKQPVDLGLLEEDDEFEEFPAEGQLYS

SEQ ID NO: 83657 - protein, 61 aa, Homo sapiens
  Payload ID: 16648
  Gene Symbol: SHFM1
  Gene Name: split hand/foot malformation (ectrodactyly) type 1
  ENSP ID: ENSP00000480885
MSEKKQPVDLGLLEEDDEFEEFPAEDWAGLDEDEDAHVWEDNWDDDNVEDDFSNQLRSQNG

SEQ ID NO: 83658 - protein, 118 aa, Homo sapiens
  Payload ID: 16648
  Gene Symbol: SHFM1
  Gene Name: split hand/foot malformation (ectrodactyly) type 1
  ENSP ID: ENSP00000481021
MYCQDSNICAVFAVQGGKVGRKHGIKRGRRPSIRSPAQRARGPWIHESKHPAFAKQQINLEMPNSRATTELAWVCRSLTLSTAPLSPPPSLVHCEDCSCLPGCHSGDLYNLAPAERTC

SEQ ID NO: 83659 - protein, 61 aa, Homo sapiens; identical to SEQ ID NO: 83657
  Payload ID: 16648
  Gene Symbol: SHFM1
  Gene Name: split hand/foot malformation (ectrodactyly) type 1
  ENSP ID: ENSP00000481400

SEQ ID NO: 83660 - protein, 66 aa, Homo sapiens
  Payload ID: 16648
  Gene Symbol: SHFM1
  Gene Name: split hand/foot malformation (ectrodactyly) type 1
  ENSP ID: ENSP00000482085
MSEKKQPVDLGLLEEDDEFEEFPAEDWAGLDEDEDAHVWEDNWDDDNVEDDFSNQLRDMGNVSISV

SEQ ID NO: 83661 - protein, 89 aa, Homo sapiens
  Payload ID: 16648
  Gene Symbol: SHFM1
  Gene Name: split hand/foot malformation (ectrodactyly) type 1
  ENSP ID: ENSP00000484478
MSEKKQPVDLGLLEEDDEFEEFPAEDWAGLDEDEDAHVWEDNWDDDNVEDDFSNQLRHGHASAGLLQEKLLGEEPRWPNRNSSSLQLPA

SEQ ID NO: 83662 - protein, 58 aa, Homo sapiens
  Payload ID: 16648
  Gene Symbol: SHFM1
  Gene Name: split hand/foot malformation (ectrodactyly) type 1
  ENSP ID: ENSP00000484726
MSEKKQPVDLGLLEEDDEFEEFPAEDWAGLDEDEDAHVWEDNWDDDNVEDDFSNQLRS

SEQ ID NO: 83663 - protein, 57 aa, Homo sapiens
  Payload ID: 16648
  Gene Symbol: SHFM1
  Gene Name: split hand/foot malformation (ectrodactyly) type 1
  ENSP ID: ENSP00000485341
MSEKKQPVDLGLLEEDDEFEEFPAEDWAGLDEDEDAHVWEDNWDDDNVEDDFSNQLR

SEQ ID NO: 83664 - protein, 120 aa, Homo sapiens
  Payload ID: 16648
  Gene Symbol: SHFM1
  Gene Name: split hand/foot malformation (ectrodactyly) type 1
  ENSP ID: ENSP00000485353
MSEKKQPVDLGLLEEDDEFEEFPAEDWAGLDEDEDAHVWEDNWDDDNVEDDFSNQLRHSIISTHKRWHSARLRRCPPPFPESRPSLTHTRTTEASPLVLLLVTPPQLPLIHPSIYPAWVM

SEQ ID NO: 83665 - protein, 358 aa, Homo sapiens
  Payload ID: 16649
  Gene Symbol: SPO11
  Gene Name: SPO11 meiotic protein covalently bound to DSB
  Uniprot ID: Q9Y5K1
  ENSP ID: ENSP00000316034
MAFAPMGPEASFFDVLDRHRESLLAALRRGGREPPTGGSRLASRFEDSVGLQMVSHCTTRKIKSDSPKSAQKFSLILKILSMIYKLVQSNTYATKRDIYYTDSQLFGNQTVVDNIINDISCMLKVSRRSLHILSTSKGLIAGNLRYIEEDGTKVNCTCGATAVAVPSNIQGIRNLVTDAKFVLIVEKDATFQRLLDDNFCNKLSPCIMITGKGVPDLNTRLLVKKLWDTFHVPVFTLVDADPHGIEIMCIYKYGSMSMSFEAHHLTVPAIRWLGLLPSDLKRLNVPKDSLIPLTKRDQMKLDSILRRPYVTCQPFWRKEMEIMADSKMKAEIQALTFLSSDYLSRVYLPNKLKFGGWI

SEQ ID NO: 83666 - protein, 354 aa, Homo sapiens
  Payload ID: 16649
  Gene Symbol: SPO11
  Gene Name: SPO11 meiotic protein covalently bound to DSB
  ENSP ID: ENSP00000360307
MAFAPMGPEASFFDVLDRHRESLLAALRRGGREPPTGGSRLASRFEDSVGLQMVSHCTTRKIKSDSPKSAQKFSLILKILSMIYKLVQSNTYATKRDIYYTDSQLFGNQTVVDNIINDISCMLKVSRRSLHILSTSKGLIAGNLRYIEEDGTKVNCTCGATAVAVPSNIQGIRNAKFVLIVEKDATFQRLLDDNFCNKLSPCIMITGKGVPDLNTRLLVKKLWDTFHVPVFTLVDADPHGIEIMCIYKYGSMSMSFEAHHLTVPAIRWLGLLPSDLKRLNVPKDSLIPLTKRDQMKLDSILRRPYVTCQPFWRKEMEIMADSKMKAEIQALTFLSSDYLSRVYLPNKLKFGGWI

SEQ ID NO: 83667 - protein, 396 aa, Homo sapiens
  Payload ID: 16649
  Gene Symbol: SPO11
  Gene Name: SPO11 meiotic protein covalently bound to DSB
  Uniprot ID: Q9Y5K1
  ENSP ID: ENSP00000360310
MAFAPMGPEASFFDVLDRHRESLLAALRRGGREPPTGGSRLASSSEVLASIENIIQDIITSLARNEAPAFTIDNRSSWENIKFEDSVGLQMVSHCTTRKIKSDSPKSAQKFSLILKILSMIYKLVQSNTYATKRDIYYTDSQLFGNQTVVDNIINDISCMLKVSRRSLHILSTSKGLIAGNLRYIEEDGTKVNCTCGATAVAVPSNIQGIRNLVTDAKFVLIVEKDATFQRLLDDNFCNKLSPCIMITGKGVPDLNTRLLVKKLWDTFHVPVFTLVDADPHGIEIMCIYKYGSMSMSFEAHHLTVPAIRWLGLLPSDLKRLNVPKDSLIPLTKRDQMKLDSILRRPYVTCQPFWRKEMEIMADSKMKAEIQALTFLSSDYLSRVYLPNKLKFGGWI

SEQ ID NO: 83668 - protein, 270 aa, Homo sapiens
  Payload ID: 16649
  Gene Symbol: SPO11
  Gene Name: SPO11 meiotic protein covalently bound to DSB
  ENSP ID: ENSP00000413185
LLAALRRGGREPPTGGSRLASSSEVLASIENIIQDIITSLARNEAPAFTIDNRSSWENIKFEDSVGLQMVSHCTTRKIKSDSPKSAQKFSLILKILSMIYKLVQSNTYATKRDIYYTDSQLFGNQTVVDNIINDISCMLKVSRRSLHILSTSKGLIAGNLRYIEEDGTKVNCTCGATAVAVPSNIQGIRITDAKFVLIVEKDATFQRLLDDNFCNKLSPCIMITGKGVPDLNTRLLVKKLWDTFHVPVFTLVDADPHGIEIMCIYKYGSM

SEQ ID NO: 83669 - protein, 123 aa, Homo sapiens
  Payload ID: 16649
  Gene Symbol: SPO11
  Gene Name: SPO11 meiotic protein covalently bound to DSB
  ENSP ID: ENSP00000431842
LSTSKGLIAGNLRYIEEDGTKVNCTCGATAVAVPSNIQGIRNLVTDAKFVLIVEKDATFQRLLDDNFCNKLSPCIMITSTPVFQHLKSKGKGVPDLNTRLLVKKLWDTFHVPVFTLVDADPHD

SEQ ID NO: 83670 - protein, 696 aa, Homo sapiens
  Payload ID: 16650
  Gene Symbol: SPOCD1
  Gene Name: SPOC domain containing 1
  Uniprot ID: Q6ZMY3
  ENSP ID: ENSP00000257100
MEVSSPSPAQRLRRKKRPMVQGPAGCQVFQPSPSGGTAGDPGGLSDPFYPPRSGSLALGDPSSDPACSQSGPMEAEEDSLPEQPEDSAQLQQEKPSLYIGVRGTVVRSMQEVLWTRLRELPDPVLSEEVVEGIAAGIEAALWDLTQGTNGRYKTKYRSLLFNLRDPRNLDLFLKVVHGDVTPYDLVRMSSMQLAPQELARWRDQEEKRGLNIIEQQQKEPCRLPASKMTHKGEVEIQRDMDQTLTLEDLVGPQMFMDCSPQALPIASEDTTGQHDHHFLDPNCHICKDWEPSNELLGSFEAAKSCGDNIFQKALSQTPMPAPEMPKTRELSPTEPQDRVPPSGLHVPAAPTKALPCLPPWEGVLDMFSIKRFRARAQLVSGHSCRLVQALPTVIRSAGCIPSNIVWDLLASICPAKAKDVCVVRLCPHGARDTQNCRLLYSYLNDRQRHGLASVEHMGMVLLPLPAFQPLPTRLRPLGGPGLEVTHSSLLLAVLLPKEGLPDTAGSSPWLGKVQKMVSFNSKVEKRYYQPDDRRPNVPLKGTPPPGGAWQQSQGRGSIAPRGISAWQRPPRGRGRLWPEPENWQHPGRGQWPPEPGLRQSQHPYSVAPAGHGFGRGQHFHRDSCPHQALLRHLESLATMSHQLQALLCPQTKSSIPRPLQRLSSALAAPEPPGPARDSSLGPTDEAGSECPFPRKA

SEQ ID NO: 83671 - protein, 1216 aa, Homo sapiens
  Payload ID: 16650
  Gene Symbol: SPOCD1
  Gene Name: SPOC domain containing 1
  Uniprot ID: Q6ZMY3
  ENSP ID: ENSP00000353670
MSQAGDVEGPSTGDPVLSPQHNCELLQNMEGASSMPGLSPDGPGASSGPGVRAGSRRKIPRKEALRGGSSRAAGAAEVRPGVLELLAVVQSRGSMLAPGLHMQLPSVPTQGRALTSKRLQVSLCDILDDSCPRKLCSRSAGLPERALACRERLAGVEEVSCLRPREARDGGMSSPGCDRRSPTLSKEEPPGRPLTSSPDPVPVRVRKKWRRQGAHSECEEGAGDFLWLDQSPRGDNLLSVGDPPQVADLESLGGPCRPPSPKDTGSGPGEPGGSGAGCASGTEKFGYLPATGDGPQPGSPCGPVGFPVPSGGESLSSAAQAPPQSAALCLGASAQASAEQQEAVCVVRTGSDEGQAPAQDQEELEAKAQPASRGRLEQGLAAPADTCASSREPLGGLSSSLDTEASRACSGPFMEQRRSKGTKNLKKGPVPCAQDRGTDRSSDNSHQDRPEEPSPGGCPRLEEVKIPHGVKLVCYLGSGPVIQLLGAISHGQAGGQLPPKLEVLEDLMEVSSPSPAQRLRRKKRPMVQGPAGCQVFQPSPSGGTAGDPGGLSDPFYPPRSGSLALGDPSSDPACSQSGPMEAEEDSLPEQPEDSAQLQQEKPSLYIGVRGTVVRSMQEVLWTRLRELPDPVLSEEVVEGIAAGIEAALWDLTQGTNGRYKTKYRSLLFNLRDPRNLDLFLKVVHGDVTPYDLVRMSSMQLAPQELARWRDQEEKRGLNIIEQQQKEPCRLPASKMTHKGEVEIQRDMDQTLTLEDLVGPQMFMDCSPQALPIASEDTTGQHDHHFLDPNCHICKDWEPSNELLGSFEAAKSCGDNIFQKALSQTPMPAPEMPKTRELSPTEPQDRVPPSGLHVPAAPTKALPCLPPWEGVLDMFSIKRFRARAQLVSGHSCRLVQALPTVIRSAGCIPSNIVWDLLASICPAKAKDVCVVRLCPHGARDTQNCRLLYSYLNDRQRHGLASVEHMGMVLLPLPAFQPLPTRLRPLGGPGLWALPVSPLLSPGLEVTHSSLLLAVLLPKEGLPDTAGSSPWLGKVQKMVSFNSKVEKRYYQPDDRRPNVPLKGTPPPGGAWQQSQGRGSIAPRGISAWQRPPRGRGRLWPEPENWQHPGRGQWPPEPGLRQSQHPYSVAPAGHGFGRGQHFHRDSCPHQALLRHLESLATMSHQLQALLCPQTKSSIPRPLQRLSSALAAPEPPGPARDSSLGPTDEAGSECPFPRKA

SEQ ID NO: 83672 - protein, 639 aa, Homo sapiens
  Payload ID: 16650
  Gene Symbol: SPOCD1
  Gene Name: SPOC domain containing 1
  ENSP ID: ENSP00000399778
MILFPPHGVGVRISRFLQGNTHDRNKLAQTLPPTQLPPSGTKCLESLLGSVPPPCPGLHSLRELPDPVLSEEVVEGIAAGIEAALWDLTQGTNGRYKTKYRSLLFNLRDPRNLDLFLKVVHGDVTPYDLVRMSSMQLAPQELARWRDQEEKRGLNIIEQQQKEPCRLPASKMTHKGEVEIQRDMDQTLTLEDLGPQMFMDCSPQALPIASEDTTGQHDHHFLDPNCHICKDWEPSNELLGSFEAAKSCGDNIFQKALSQTPMPAPEMPKTRELSPTEPQDRVPPSGLHVPAAPTKALPCLPPWEGVLDMFSIKRFRARAQLVSGHSCRLVQALPTVIRSAGCIPSNIVWDLLASICPAKAKDVCVVRLCPHGARDTQNCRLLYSYLNDRQRHGLASVEHMGMVLLPLPAFQPLPTRLRPLGGPGLEVTHSSLLLAVLLPKEGLPDTAGSSPWLGKVQKMVSFNSKVEKRYYQPDDRRPNVPLKGTPPPGGAWQQSQGRGSIAPRGISAWQRPPRGRGRLWPEPENWQHPGRGQWPPEPGLRQSQHPYSVAPAGHGFGRGQHFHRDSCPHQALLRHLESLATMSHQLQALLCPQTKSSIPRPLQRLSSALAAPEPPGPARDSSLGPTDEAGSECPFPRKA

SEQ ID NO: 83673 - protein, 87 aa, Homo sapiens
  Payload ID: 16650
  Gene Symbol: SPOCD1
  Gene Name: SPOC domain containing 1
  ENSP ID: ENSP00000435385
MEVSSPSPAQRLRRKKRPMVQGPAGCQVFQPSPSGGTAGDPGGLSDPFYPPRSGSLALGDPSSDPACSQSGPMEAEEDSLPEQPEDS

SEQ ID NO: 83674 - protein, 1203 aa, Homo sapiens
  Payload ID: 16650
  Gene Symbol: SPOCD1
  Gene Name: SPOC domain containing 1
  Uniprot ID: Q6ZMY3
  ENSP ID: ENSP00000435851
MSQAGDVEGPSTGDPVLSPQHNCELLQNMEGASSMPGLSPDGPGASSGPGVRAGSRRKIPRKEALRGGSSRAAGAAEVRPGVLELLAVVQSRGSMLAPGLHMQLPSVPTQGRALTSKRLQVSLCDILDDSCPRKLCSRSAGLPERALACRERLAGVEEVSCLRPREARDGGMSSPGCDRRSPTLSKEEPPGRPLTSSPDPVPVRVRKKWRRQGAHSECEEGAGDFLWLDQSPRGDNLLSVGDPPQVADLESLGGPCRPPSPKDTGSGPGEPGGSGAGCASGTEKFGYLPATGDGPQPGSPCGPVGFPVPSGGESLSSAAQAPPQSAALCLGASAQASAEQQEAVCVVRTGSDEGQAPAQDQEELEAKAQPASRGRLEQGLAAPADTCASSREPLGGLSSSLDTEASRACSGPFMEQRRSKGTKNLKKGPVPCAQDRGTDRSSDNSHQDRPEEPSPGGCPRLEEVKIPHGVKLVCYLGSGPVIQLLGAISHGQAGGQLPPKLEVLEDLMEVSSPSPAQRLRRKKRPMVQGPAGCQVFQPSPSGGTAGDPGGLSDPFYPPRSGSLALGDPSSDPACSQSGPMEAEEDSLPEQPEDSAQLQQEKPSLYIGVRGTVVRSMQEVLWTRLRELPDPVLSEEVVEGIAAGIEAALWDLTQGTNGRYKTKYRSLLFNLRDPRNLDLFLKVVHGDVTPYDLVRMSSMQLAPQELARWRDQEEKRGLNIIEQQQKEPCRLPASKMTHKGEVEIQRDMDQTLTLEDLVGPQMFMDCSPQALPIASEDTTGQHDHHFLDPNCHICKDWEPSNELLGSFEAAKSCGDNIFQKALSQTPMPAPEMPKTRELSPTEPQDRVPPSGLHVPAAPTKALPCLPPWEGVLDMFSIKRFRARAQLVSGHSCRLVQALPTVIRSAGCIPSNIVWDLLASICPAKAKDVCVVRLCPHGARDTQNCRLLYSYLNDRQRHGLASVEHMGMVLLPLPAFQPLPTRLRPLGGPGLEVTHSSLLLAVLLPKEGLPDTAGSSPWLGKVQKMVSFNSKVEKRYYQPDDRRPNVPLKGTPPPGGAWQQSQGRGSIAPRGISAWQRPPRGRGRLWPEPENWQHPGRGQWPPEPGLRQSQHPYSVAPAGHGFGRGQHFHRDSCPHQALLRHLESLATMSHQLQALLCPQTKSSIPRPLQRLSSALAAPEPPGPARDSSLGPTDEAGSECPFPRKA

SEQ ID NO: 83675 - protein, 20 aa, Homo sapiens
  Payload ID: 16650
  Gene Symbol: SPOCD1
  Gene Name: SPOC domain containing 1
  ENSP ID: ENSP00000436239
MEVSSPSPAQRLRRKKRPMV

SEQ ID NO: 83676 - protein, 255 aa, Homo sapiens
  Payload ID: 16650
  Gene Symbol: SPOCD1
  Gene Name: SPOC domain containing 1
  ENSP ID: ENSP00000437197
  MOD_RES (1)..(1): Any amino acid
XDRNKLAQTLPPTQLPPSGTKCLESLLGSVPPPCPGLHSLRELPDPVLSEEVVEGIAAGIEAALWDLTQGTNGRYKTKYRSLLFNLRDPRNLDLFLKVVHGDVTPYDLVRMSSMQLAPQELARWRDQEEKRGPQMFMDCSPQALPIASEDTTGQHDHHFLDPNCHICKDWEPSNELLGSFEAAKSCGDNIFQKALSQTPMPAPEMPKTRELSPTEPQDRVPPSGLHVPAAPTKALPCLPPWEGVLDMFSIKRFRA

SEQ ID NO: 83677 - protein, 43 aa, Homo sapiens
  Payload ID: 16650
  Gene Symbol: SPOCD1
  Gene Name: SPOC domain containing 1
  ENSP ID: ENSP00000437270
MEAEEDSLPEQPEDSAQLQQEKPSLYIGVRGTVVRSMQEVLWT

SEQ ID NO: 83678 - protein, 807 aa, Homo sapiens
  Payload ID: 16651
  Gene Symbol: SPON1
  Gene Name: spondin 1, extracellular matrix protein
  Uniprot ID: Q9HCB6
  ENSP ID: ENSP00000460236
MRLSPAPLKLSRTPALLALALPLAAALAFSDETLDKVPKSEGYCSRILRAQGTRREGYTEFSLRVEGDPDFYKPGTSYRVTLSAAPPSYFRGFTLIALRENREGDKEEDHAGTFQIIDEEETQFMSNCPVAVTESTPRRRTRIQVFWIAPPAGTGCVILKASIVQKRIIYFQDEGSLTKKLCEQDSTFDGVTDKPILDCCACGTAKYRLTFYGNWSEKTHPKDYPRRANHWSAIIGGSHSKNYVLWEYGGYASEGVKQVAELGSPVKMEEEIRQQSDEVLTVIKAKAQWPAWQPLNVRAAPSAEFSVDRTRHLMSFLTMMGPSPDWNVGLSAEDLCTKECGWVQKVVQDLIPWDAGTDSGVTYESPNKPTIPQEKIRPLTSLDHPQSPFYDPEGGSITQVARVVIERIARKGEQCNIVPDNVDDIVADLAPEEKDEDDTPETCIYSNWSPWSACSSSTCDKGKRMRQRMLKAQLDLSVPCPDTQDFQPCMGPGCSDEDGSTCTMSEWITWSPCSISCGMGMRSRERYVKQFPEDGSVCTLPTEETEKCTVNEECSPSSCLMTEWGEWDECSATCGMGMKKRHRMIKMNPADGSMCKAETSQAEKCMMPECHTIPCLLSPWSEWSDCSVTCGKGMRTRQRMLKSLAELGDCNEDLEQVEKCMLPECPIDCELTEWSQWSECNKSCGKGHVIRTRMIQMEPQFGGAPCPETVQRKKCRIRKCLRNPSIQKLRWREARESRRSEQLKEESEGEQFPGCRMRPWTAWSECTKLCGGGIQERYMTVKKRFKSSQFTSCKDKKEIRACNVHPC

SEQ ID NO: 83679 - protein, 331 aa, Homo sapiens
  Payload ID: 16652
  Gene Symbol: SPON2
  Gene Name: spondin 2, extracellular matrix protein
  Uniprot ID: Q9BUD6
  ENSP ID: ENSP00000290902
MENPSPAAALGKALCALLLATLGAAGQPLGGESICSARALAKYSITFTGKWSQTAFPKQYPLFRPPAQWSSLLGAAHSSDYSMWRKNQYVSNGLRDFAERGEAWALMKEIEAAGEALQSVHAVFSAPAVPSGTGQTSAELEVQRRHSLVSFVVRIVPSPDWFVGVDSLDLCDGDRWREQAALDLYPYDAGTDSGFTFSSPNFATIPQDTVTEITSSSPSHPANSFYYPRLKALPPIARVTLVRLRQSPRAFIPPAPVLPSRDNEIVDSASVPETPLDCEVSLWSSWGLCGGHCGRLGTKSRTRYVRVQPANNGSPCPELEEEAECVPDNCV

SEQ ID NO: 83680 - protein, 331 aa, Homo sapiens; identical to SEQ ID NO: 83679
  Payload ID: 16652
  Gene Symbol: SPON2
  Gene Name: spondin 2, extracellular matrix protein
  Uniprot ID: Q9BUD6
  ENSP ID: ENSP00000394832

SEQ ID NO: 83681 - protein, 16 aa, Homo sapiens
  Payload ID: 16652
  Gene Symbol: SPON2
  Gene Name: spondin 2, extracellular matrix protein
  ENSP ID: ENSP00000421379
MENPSPAAALGKALCA

SEQ ID NO: 83682 - protein, 24 aa, Homo sapiens
  Payload ID: 16652
  Gene Symbol: SPON2
  Gene Name: spondin 2, extracellular matrix protein
  ENSP ID: ENSP00000421634
MENPSPAAALGKALCALLLATLGA

SEQ ID NO: 83683 - protein, 7 aa, Homo sapiens
  Payload ID: 16652
  Gene Symbol: SPON2
  Gene Name: spondin 2, extracellular matrix protein
  ENSP ID: ENSP00000421858
MENPSPA

SEQ ID NO: 83684 - protein, 61 aa, Homo sapiens
  Payload ID: 16652
  Gene Symbol: SPON2
  Gene Name: spondin 2, extracellular matrix protein
  ENSP ID: ENSP00000422516
MENPSPAAALGKALCALLLATLGAAGQPLGGESICSARALAKYSITFTGKWSQTAFPKQYP

SEQ ID NO: 83685 - protein, 15 aa, Homo sapiens
  Payload ID: 16652
  Gene Symbol: SPON2
  Gene Name: spondin 2, extracellular matrix protein
  ENSP ID: ENSP00000423414
MENPSPAAALGKALC

SEQ ID NO: 83686 - protein, 108 aa, Homo sapiens
  Payload ID: 16652
  Gene Symbol: SPON2
  Gene Name: spondin 2, extracellular matrix protein
  ENSP ID: ENSP00000424542
MENPSPAAALGKALCALLLATLGAAGQPLGGESICSARALAKYSITFTGKWSQTAFPKQYPLFRPPAQWSSLLGAAHSSDYSMWRKNQYVSNGLRDFAERGEAWALMK

SEQ ID NO: 83687 - protein, 64 aa, Homo sapiens
  Payload ID: 16652
  Gene Symbol: SPON2
  Gene Name: spondin 2, extracellular matrix protein
  ENSP ID: ENSP00000425871
MENPSPAAALGKALCALLLATLGAAGQPLGGESICSARALAKYSITFTGKWSQTAFPKQYPLFR

SEQ ID NO: 83688 - protein, 331 aa, Homo sapiens; identical to SEQ ID NO: 83679
  Payload ID: 16652
  Gene Symbol: SPON2
  Gene Name: spondin 2, extracellular matrix protein
  Uniprot ID: Q9BUD6
  ENSP ID: ENSP00000483599

SEQ ID NO: 83689 - protein, 319 aa, Homo sapiens
  Payload ID: 16653
  Gene Symbol: SPRY1
  Gene Name: sprouty RTK signaling antagonist 1
  Uniprot ID: O43609
  ENSP ID: ENSP00000343785
MDPQNQHGSGSSLVVIQQPSLDSRQRLDYEREIQPTAILSLDQIKAIRGSNEYTEGPSVVKRPAPRTAPRQEKHERTHEIIPINVNNNYEHRHTSHLGHAVLPSNARGPILSRSTSTGSAASSGSNSSASSEQGLLGRSPPTRPVPGHRSERAIRTQPKQLIVDDLKGSLKEDLTQHKFICEQCGKCKCGECTAPRTLPSCLACNRQCLCSAESMVEYGTCMCLVKGIFYHCSNDDEGDSYSDNPCSCSQSHCCSRYLCMGAMSLFLPCLLCYPPAKGCLKLCRRCYDWIHRPGCRCKNSNTVYCKLESCPSRGQGKPS

SEQ ID NO: 83690 - protein, 319 aa, Homo sapiens; identical to SEQ ID NO: 83689
  Payload ID: 16653
  Gene Symbol: SPRY1
  Gene Name: sprouty RTK signaling antagonist 1
  Uniprot ID: O43609
  ENSP ID: ENSP00000377871

SEQ ID NO: 83691 - protein, 209 aa, Homo sapiens
  Payload ID: 16653
  Gene Symbol: SPRY1
  Gene Name: sprouty RTK signaling antagonist 1
  ENSP ID: ENSP00000421036
MDPQNQHGSGSSLVVIQQPSLDSRQRLDYEREIQPTAILSLDQIKAIRGSNEYTEGPSVVKRPAPRTAPRQEKHERTHEIIPINVNNNYEHRHTSHLGHAVLPSNARGPILSRSTSTGSAASSGSNSSASSEQGLLGRSPPTRPVPGHRSERAIRTQPKQLIVDDLKGSLKEDLTQHKFICEQCGKCKCGECTAPRTLPSCLACNRQCL

SEQ ID NO: 83692 - protein, 67 aa, Homo sapiens
  Payload ID: 16653
  Gene Symbol: SPRY1
  Gene Name: sprouty RTK signaling antagonist 1
  ENSP ID: ENSP00000421622
MDPQNQHGSGSSLVVIQQPSLDSRQRLDYEREIQPTAILSLDQIKAIRGSNEYTEGPSVVKRPAPRT

SEQ ID NO: 83693 - protein, 35 aa, Homo sapiens
  Payload ID: 16653
  Gene Symbol: SPRY1
  Gene Name: sprouty RTK signaling antagonist 1
  ENSP ID: ENSP00000425946
MDPQNQHGSGSSLVVIQQPSLDSRQRLDYEREIQP

SEQ ID NO: 83694 - protein, 319 aa, Homo sapiens; identical to SEQ ID NO: 83689
  Payload ID: 16653
  Gene Symbol: SPRY1
  Gene Name: sprouty RTK signaling antagonist 1
  Uniprot ID: O43609
  ENSP ID: ENSP00000480540

SEQ ID NO: 83695 - protein, 319 aa, Homo sapiens; identical to SEQ ID NO: 83689
  Payload ID: 16653
  Gene Symbol: SPRY1
  Gene Name: sprouty RTK signaling antagonist 1
  Uniprot ID: O43609
  ENSP ID: ENSP00000481675

SEQ ID NO: 83696 - protein, 315 aa, Homo sapiens
  Payload ID: 16654
  Gene Symbol: SPRY2
  Gene Name: sprouty RTK signaling antagonist 2
  Uniprot ID: O43597
  ENSP ID: ENSP00000366306
MEARAQSGNGSQPLLQTPRDGGRQRGEPDPRDALTQQVHVLSLDQIRAIRNTNEYTEGPTVVPRPGLKPAPRPSTQHKHERLHGLPEHRQPPRLQHSQVHSSARAPLSRSISTVSSGSRSSTRTSTSSSSSEQRLLGSSFSSGPVADGIIRVQPKSELKPGELKPLSKEDLGLHAYRCEDCGKCKCKECTYPRPLPSDWICDKQCLCSAQNVIDYGTCVCCVKGLFYHCSNDDEDNCADNPCSCSQSHCCTRWSAMGVMSLFLPCLWCYLPAKGCLKLCQGCYDRVNRPGCRCKNSNTVCCKVPTVPPRNFEKPT

SEQ ID NO: 83697 - protein, 315 aa, Homo sapiens; identical to SEQ ID NO: 83696
  Payload ID: 16654
  Gene Symbol: SPRY2
  Gene Name: sprouty RTK signaling antagonist 2
  Uniprot ID: O43597
  ENSP ID: ENSP00000366308

SEQ ID NO: 83698 - protein, 353 aa, Homo sapiens
  Payload ID: 16654
  Gene Symbol: SPRY2
  Gene Name: sprouty RTK signaling antagonist 2
  ENSP ID: ENSP00000439027
MEARAQSGNGSQPLLQTPRDGGRQRGEPDPRDALTQQVHVLSLDQIRAIRNTNEYTEGPTVVPRPGLKPAPRPSTQHKHERLHGLPEHRQPPRLQHSQVHSSARAPLSRSISTVSSGSRSSTRTSTSSSSSEQRLLGSSFSSGPVADGIIRVQPKSELKPGELKPLSKEDLGLHAYRCEDCGKCKCKECTYPRPLPSDWICDKQCLCSAQNVIDYGTCVCCVKGLFYHCSNDDEDNCADNPCSCSQSHCCTRWSAMGVMSLFLPCLWCYLPAKGCLKLCQGCYDRVNRPGCRCKNSNTVCCKVPTVPPRTLKNQHSIINQEYYSNEDFFFLFLIHICNQLNSYNLGTVNRKVG

SEQ ID NO: 83699 - protein, 288 aa, Homo sapiens
  Payload ID: 16655
  Gene Symbol: SPRY3
  Gene Name: sprouty RTK signaling antagonist 3
  Uniprot ID: O43610
  ENSP ID: ENSP00000302978
MDAAVTDDFQQILPIEQLRSTHASNDYVERPPAPCKQALSSPSLIVQTHKSDWSLATMPTSLPRSLSQCHQLQPLPQHLSQSSIASSMSHSTTASDQRLLASITPSPSGQSIIRTQPGAGVHPKADGALKGEAEQSAGHPSEHLFICEECGRCKCVPCTAARPLPSCWLCNQRCLCSAESLLDYGTCLCCVKGLFYHCSTDDEDNCADEPCSCGPSSCFVRWAAMSLISLFLPCLCCYLPTRGCLHLCQQGYDSLRRPGCRCKRHTNTVCRKISSGSAPFPKAQEKSV

SEQ ID NO: 83700 - protein, 322 aa, Homo sapiens
  Payload ID: 16656
  Gene Symbol: SPRY4
  Gene Name: sprouty RTK signaling antagonist 4
  ENSP ID: ENSP00000344967
MLSPLPTGPLEACFSVQSRTSSPMEPPIPQSAPLTPNSVMVQPLLDSRMSHSRLQHPLTILPIDQVKTSHVENDYIDNPSLALTTGPKRTRGGAPELAPTPARCDQDVTHHWISFSGRPSSVSSSSSTSSDQRLLDHMAPPPVADQASPRAVRIQPKVVHCQPLDLKGPAVPPELDKHFLLCEACGKCKCKECASPRTLPSCWVCNQECLCSAQTLVNYGTCMCLVQGIFYHCTNEDDEGSCADHPCSCSRSNCCARWSFMGALSVVLPCLLCYLPATGCVKLAQRGYDRLRRPGCRCKHTNSVICKAASGDAKTSRPDKPF

SEQ ID NO: 83701 - protein, 299 aa, Homo sapiens
  Payload ID: 16656
  Gene Symbol: SPRY4
  Gene Name: sprouty RTK signaling antagonist 4
  Uniprot ID: Q9C004
  ENSP ID: ENSP00000399468
MEPPIPQSAPLTPNSVMVQPLLDSRMSHSRLQHPLTILPIDQVKTSHVENDYIDNPSLALTTGPKRTRGGAPELAPTPARCDQDVTHHWISFSGRPSSVSSSSSTSSDQRLLDHMAPPPVADQASPRAVRIQPKVVHCQPLDLKGPAVPPELDKHFLLCEACGKCKCKECASPRTLPSCWVCNQECLCSAQTLVNYGTCMCLVQGIFYHCTNEDDEGSCADHPCSCSRSNCCARWSFMGALSVVLPCLLCYLPATGCVKLAQRGYDRLRRPGCRCKHTNSVICKAASGDAKTSRPDKPF

SEQ ID NO: 83702 - protein, 50 aa, Homo sapiens
  Payload ID: 16656
  Gene Symbol: SPRY4
  Gene Name: sprouty RTK signaling antagonist 4
  ENSP ID: ENSP00000424411
MEPPIPQSAPLTPNSVMVQPLLDSRMSHSRLQHPLTILPIDQVKTSHVEN

SEQ ID NO: 83703 - protein, 444 aa, Homo sapiens
  Payload ID: 16657
  Gene Symbol: SPRED1
  Gene Name: sprouty-related, EVH1 domain containing 1
  Uniprot ID: Q7Z699
  ENSP ID: ENSP00000299084
MSEETATSDNDNSYARVRAVVMTRDDSSGGWLPLGGSGLSSVTVFKVPHQEENGCADFFIRGERLRDKMVVLECMLKKDLIYNKVTPTFHHWKIDDKKFGLTFQSPADARAFDRGIRRAIEDISQGCPESKNEAEGADDLQANEEDSSSSLVKDHLFQQETVVTSEPYRSSNIRPSPFEDLNARRVYMQSQANQITFGQPGLDIQSRSMEYVQRQISKECGSLKSQNRVPLKSIRHVSFQDEDEIVRINPRDILIRRYADYRHPDMWKNDLERDDADSSIQFSKPDSKKSDYLYSCGDETKLSSPKDSVVFKTQPSSLKIKKSKRRKEDGERSRCVYCQERFNHEENVRGKCQDAPDPIKRCIYQVSCMLCAESMLYHCMSDSEGDFSDPCSCDTSDDKFCLRWLALVALSFIVPCMCCYVPLRMCHRCGEACGCCGGKHKAAG

SEQ ID NO: 83704 - protein, 131 aa, Homo sapiens
  Payload ID: 16657
  Gene Symbol: SPRED1
  Gene Name: sprouty-related, EVH1 domain containing 1
  ENSP ID: ENSP00000453680
MTRDDSSGGWLPLGGSGLSSVTVFKVPHQEENGCADFFIRGERLRDKMVVLECMLKKDLIYNKVTPTFHHWKIDDKKFGLTFQSPADARAFDRGIRRAIEDISQGCPESKNEAEGADDLQANEEDSSSSLV

SEQ ID NO: 83705 - protein, 418 aa, Homo sapiens
  Payload ID: 16658
  Gene Symbol: SPRED2
  Gene Name: sprouty-related, EVH1 domain containing 2
  Uniprot ID: Q7Z698
  ENSP ID: ENSP00000348753
MTEETHPDDDSYIVRVKAVVMTRDDSSGGWFPQEGGGISRVGVCKVMHPEGNGRSGFLIHGERQKDKLVVLECYVRKDLVYTKANPTFHHWKVDNRKFGLTFQSPADARAFDRGVRKAIEDLIEGSTTSSSTIHNEAELGDDDVFTTATDSSSNSSQKREQPTRTISSPTSCEHRRIYTLGHLHDSYPTDHYHLDQPMPRPYRQVSFPDDDEEIVRINPREKIWMTGYEDYRHAPVRGKYPDPSEDADSSYVRFAKGEVPKHDYNYPYVDSSDFGLGEDPKGRGGSVIKTQPSRGKSRRRKEDGERSRCVYCRDMFNHEENRRGHCQDAPDSVRTCIRRVSCMWCADSMLYHCMSDPEGDYTDPCSCDTSDEKFCLRWMALIALSFLAPCMCCYLPLRACYHCGVMCRCCGGKHKAAA

SEQ ID NO: 83706 - protein, 432 aa, Homo sapiens
  Payload ID: 16658
  Gene Symbol: SPRED2
  Gene Name: sprouty-related, EVH1 domain containing 2
  ENSP ID: ENSP00000390595
MALCSLISSWASGFRSDDDQERRGDSYIVRVKAVVMTRDDSSGGWFPQEGGGISRVGVCKVMHPEGNGRSGFLIHGERQKDKLVVLECYVRKDLVYTKANPTFHHWKVDNRKFGLTFQSPADARAFDRGVRKAIEDLIEGSTTSSSTIHNEAELGDDDVFTTATDSSSNSSQKREQPTRTISSPTSCEHRRIYTLGHLHDSYPTDHYHLDQPMPRPYRQVSFPDDDEEIVRINPREKIWMTGYEDYRHAPVRGKYPDPSEDADSSYVRFAKGEVPKHDYNYPYVDSSDFGLGEDPKGRGGSVIKTQPSRGKSRRRKEDGERSRCVYCRDMFNHEENRRGHCQDAPDSVRTCIRRVSCMWCADSMLYHCMSDPEGDYTDPCSCDTSDEKFCLRWMALIALSFLAPCMCCYLPLRACYHCGVMCRCCGGKHKAA

SEQ ID NO: 83707 - protein, 47 aa, Homo sapiens
  Payload ID: 16658
  Gene Symbol: SPRED2
  Gene Name: sprouty-related, EVH1 domain containing 2
  ENSP ID: ENSP00000393148
  MOD_RES (1)..(1): Any amino acid
XMHPEGNGRSGFLIHGERQKDKLLQKLEPRSWCQIVKRDCPFQQSLF

SEQ ID NO: 83708 - protein, 415 aa, Homo sapiens
  Payload ID: 16658
  Gene Symbol: SPRED2
  Gene Name: sprouty-related, EVH1 domain containing 2
  Uniprot ID: Q7Z698
  ENSP ID: ENSP00000393697
MASPGSDSYIVRVKAVVMTRDDSSGGWFPQEGGGISRVGVCKVMHPEGNGRSGFLIHGERQKDKLVVLECYVRKDLVYTKANPTFHHWKVDNRKFGLTFQSPADARAFDRGVRKAIEDLIEGSTTSSSTIHNEAELGDDDVFTTATDSSSNSSQKREQPTRTISSPTSCEHRRIYTLGHLHDSYPTDHYHLDQPMPRPYRQVSFPDDDEEIVRINPREKIWMTGYEDYRHAPVRGKYPDPSEDADSSYVRFAKGEVPKHDYNYPYVDSSDFGLGEDPKGRGGSVIKTQPSRGKSRRRKEDGERSRCVYCRDMFNHEENRRGHCQDAPDSVRTCIRRVSCMWCADSMLYHCMSDPEGDYTDPCSCDTSDEKFCLRWMALIALSFLAPCMCCYLPLRACYHCGVMCRCCGGKHKAAA

SEQ ID NO: 83709 - protein, 116 aa, Homo sapiens
  Payload ID: 16658
  Gene Symbol: SPRED2
  Gene Name: sprouty-related, EVH1 domain containing 2
  ENSP ID: ENSP00000406481
MTEETHPDDDSYIVRVKAVVMTRDDSSGGWFPQEGGGISRVGVCKVMHPEGNGRSGFLIHGERQKDKLVVLECYVRKDLVYTKANPTFHHWKVDNRKFGLTFQSPADARAFDRGVR

SEQ ID NO: 83710 - protein, 233 aa, Homo sapiens
  Payload ID: 16658
  Gene Symbol: SPRED2
  Gene Name: sprouty-related, EVH1 domain containing 2
  ENSP ID: ENSP00000407627
VVLECYVRKDLVYTKANPTFHHWKVDNRKFGLTFQSPADARAFDRGVRKAIEDLIEGSTTSSSTIHNEAELGDDDVFTPMPRPYRQVSFPDDDEEIVRINPREKIWMTGYEDYRHAPVRGKYPDPSEDADSSYVRFAKGEVPKHDYNYPYVDSSDFGLGEDPKGRGGSVIKTQPSRGKSRRRKEDGERSRCVYCRDMFNHEENRRGHCQDAPDSVRTCIRRVSCMWCADSMLY

SEQ ID NO: 83711 - protein, 103 aa, Homo sapiens
  Payload ID: 16658
  Gene Symbol: SPRED2
  Gene Name: sprouty-related, EVH1 domain containing 2
  ENSP ID: ENSP00000414551
GVCKVMHPEGNGRSGFLIHGERQKDKLVVLECYVRKDLVYTKANPTFHHWKVDNRKFGLTFQSPADARAFDRGVRKAIEDLIEEVENGFWRAQKAPGLPTVLL

SEQ ID NO: 83712 - protein, 410 aa, Homo sapiens
  Payload ID: 16659
  Gene Symbol: SPRED3
  Gene Name: sprouty-related, EVH1 domain containing 3
  Uniprot ID: Q2MJR0
  ENSP ID: ENSP00000345405
MVRVRAVVMARDDSSGGWLPVGGGGLSQVSVCRVRGARPEGGARQGHYVIHGERLRDQKTTLECTLKPGLVYNKVNPIFHHWSLGDCKFGLTFQSPAEADEFQKSLLAALAALGRGSLTPSSSSSSSSPSQDTAETPCPLTSHVDSDSSSSHSRQETPPSAAAAPIITMESASGFGPTTPPQRRRSSAQSYPPLLPFTGIPEPSEPLAGAGGLGWGGRGYEDYRRSGPPAPLALSTCVVRFAKTGALRGAALGPPAALPAPLTEAAPPAPPARPPPGPGPSSAPAKASPEAEEAARCVHCRALFRRRADGRGGRCAEAPDPGRLLVRRLSCLWCAESLLYHCLSDAEGDFSDPCACEPGHPRPAARWAALAALSLAVPCLCCYAPLRACHWVAARCGCAGCGGRHEEAAR

SEQ ID NO: 83713 - protein, 121 aa, Homo sapiens
  Payload ID: 16659
  Gene Symbol: SPRED3
  Gene Name: sprouty-related, EVH1 domain containing 3
  ENSP ID: ENSP00000465713
MVRVRAVVMARDDSSGGWLPVGGGGLSQTTLECTLKPGLVYNKVNPIFHHWSLGDCKFGLTFQSPAEADEFQKSLLAALAALGRGSLTPSSSSSSSSPSQDTAETPCPLTLSQYFRHMLCP

SEQ ID NO: 83714 - protein, 410 aa, Homo sapiens; identical to SEQ ID NO: 83712
  Payload ID: 16659
  Gene Symbol: SPRED3
  Gene Name: sprouty-related, EVH1 domain containing 3
  Uniprot ID: Q2MJR0
  ENSP ID: ENSP00000466568

SEQ ID NO: 83715 - protein, 181 aa, Homo sapiens
  Payload ID: 16659
  Gene Symbol: SPRED3
  Gene Name: sprouty-related, EVH1 domain containing 3
  ENSP ID: ENSP00000467532
MVRVRAVVMARDDSSGGWLPVGGGGLSQVSVCRVRGARPEGGARQGHYVIHGERLRDQKTTLECTLKPGLVYNKVNPIFHHWSLGDCKFGLTFQSPAEADEFQKSLLAALAALGRGSLTPSSSSSSSSPSQDTAETPCPLTSHVDSDSSSSHSRQETPPSAAAAPIITMESASGFGPTTPP

SEQ ID NO: 83716 - protein, 454 aa, Homo sapiens
  Payload ID: 16659
  Gene Symbol: SPRED3
  Gene Name: sprouty-related, EVH1 domain containing 3
  ENSP ID: ENSP00000467540
MAQMGGKVGDPLWILRKWGLGGCSLELVPGSRTQQASKPASLLPLPQAAPSPPTRLPGSPSLPPRPGSRCPSPAPPEPAREPERKGGGGGRVAAARSPAGASQTTLECTLKPGLVYNKVNPIFHHWSLGDCKFGLTFQSPAEADEFQKSLLAALAALGRGSLTPSSSSSSSSPSQDTAETPCPLTSHVDSDSSSSHSRQETPPSAAAAPIITMESASGFGPTTPPQRRRSSAQSYPPLLPFTGIPEPSEPLAGAGGLGWGGRGYEDYRRSGPPAPLALSTCVVRFAKTGALRGAALGPPAALPAPLTEAAPPAPPARPPPGPGPSSAPAKASPEAEEAARCVHCRALFRRRADGRGGRCAEAPDPGRLLVRRLSCLWCAESLLYHCLSDAEGDFSDPCACEPGHPRPAARWAALAALSLAVPCLCCYAPLRACHWVAARCGCAGCGGRHEEAAR

SEQ ID NO: 83717 - protein, 207 aa, Homo sapiens
  Payload ID: 16660
  Gene Symbol: SPRTN
  Gene Name: SprT-like N-terminal domain
  Uniprot ID: Q9H040
  ENSP ID: ENSP00000008440
MDDDLMLALRLQEEWNLQEAERDHAQESLSLVDASWELVDPTPDLQALFVQFNDQFFWGQLEAVEVKWSVRMTLCAGICSYEGKGGMCSIRLSEPLLKLRPRKDLVEVYHTFHDEVDEYRRHWWRCNGPCQHRPPYYGYVKRATNREPSAHDYWWAEHQKTCGGTYIKIKEPENYSKKGKGKAKLGKEPVLAAENKGTFVYILLIFM

SEQ ID NO: 83718 - protein, 489 aa, Homo sapiens
  Payload ID: 16660
  Gene Symbol: SPRTN
  Gene Name: SprT-like N-terminal domain
  Uniprot ID: Q9H040
  ENSP ID: ENSP00000295050
MDDDLMLALRLQEEWNLQEAERDHAQESLSLVDASWELVDPTPDLQALFVQFNDQFFWGQLEAVEVKWSVRMTLCAGICSYEGKGGMCSIRLSEPLLKLRPRKDLVETLLHEMIHAYLFVTNNDKDREGHGPEFCKHMHRINSLTGANITVYHTFHDEVDEYRRHWWRCNGPCQHRPPYYGYVKRATNREPSAHDYWWAEHQKTCGGTYIKIKEPENYSKKGKGKAKLGKEPVLAAENKDKPNRGEAQLVIPFSGKGYVLGETSNLPSPGKLITSHAINKTQDLLNQNHSANAVRPNSKIKVKFEQNGSSKNSHLVSPAVSNSHQNVLSNYFPRVSFANQKAFRGVNGSPRISVTVGNIPKNSVSSSSQRRVSSSKISLRNSSKVTESASVMPSQDVSGSEDTFPNKRPRLEDKTVFDNFFIKKEQIKSSGNDPKYSTTTAQNSSSSSSQSKMVNCPVCQNEVLESQINEHLDWCLEGDSIKVKSEESL

SEQ ID NO: 83719 - protein, 187 aa, Homo sapiens
  Payload ID: 16660
  Gene Symbol: SPRTN
  Gene Name: SprT-like N-terminal domain
  ENSP ID: ENSP00000355604
MKKTLLHEMIHAYLFVTNNDKDREGHGPEFCKHMHRINSLTGANITVYHTFHDEVDEYRRHWWRCNGPCQHRPPYYGYVKRATNREPSAHDYWWAEHQKTCGGTYIKIKEPENYSKKGKGKAKLGKEPVLAAENKDKPNRGEAQLVIPFSGKGYVLGETSNLPSPGKLITSHAINKTQDLLNQNHSA

SEQ ID NO: 83720 - protein, 250 aa, Homo sapiens
  Payload ID: 16660
  Gene Symbol: SPRTN
  Gene Name: SprT-like N-terminal domain
  Uniprot ID: Q9H040
  ENSP ID: ENSP00000375731
MDDDLMLALRLQEEWNLQEAERDHAQESLSLVDASWELVDPTPDLQALFVQFNDQFFWGQLEAVEVKWSVRMTLCAGICSYEGKGGMCSIRLSEPLLKLRPRKDLVETLLHEMIHAYLFVTNNDKDREGHGPEFCKHMHRINSLTGANITVYHTFHDEVDEYRRHWWRCNGPCQHRPPYYGYVKRATNREPSAHDYWWAEHQKTCGGTYIKIKEPENYSKKGKGKAKLGKEPVLAAENKGTFVYILLIFM

SEQ ID NO: 83721 - protein, 442 aa, Homo sapiens
  Payload ID: 16661
  Gene Symbol: SPRYD3
  Gene Name: SPRY domain containing 3
  Uniprot ID: Q8NCJ5
  ENSP ID: ENSP00000301463
MRRTRRPRFVLMNKMDDLNLHYRFLNWRRRIREIREVRAFRYQERFKHILVDGDTLSYHGNSGEVGCYVASRPLTKDSNYFEVSIVDSGVRGTIAVGLVPQYYSLDHQPGWLPDSVAYHADDGKLYNGRAKGRQFGSKCNSGDRIGCGIEPVSFDVQTAQIFFTKNGKRVGSTIMPMSPDGLFPAVGMHSLGEEVRLHLNAELGREDDSVMMVDSYEDEWGRLHDVRVCGTLLEYLGKGKSIVDVGLAQARHPLSTRSHYFEVEIVDPGEKCYIALGLARKDYPKNRHPGWSRGSVAYHADDGKIFHGSGVGDPFGPRCYKGDIMGCGIMFPRDYILDSEGDSDDSCDTVILSPTARAVRNVRNVMYLHQEGEEEEEEEEEEEDGEEIEPEHEGRKVVVFFTRNGKIIGKKDAVVPSGGFFPTIGMLSCGEKVKVDLHPLSG

SEQ ID NO: 83722 - protein, 165 aa, Homo sapiens
  Payload ID: 16661
  Gene Symbol: SPRYD3
  Gene Name: SPRY domain containing 3
  ENSP ID: ENSP00000446156
MRRTRRPRFVLMNKMDDLNLHYRFLNWRRRIREIREVRAFRYQERFKHILVDGDTLSYHGNSGEVGCYVASRPLTKDSNYFEVSIVDSGVRGTIAVGLVPQYYSLDHQPGWLPDSVAYHADDGKWALPSCPCPQMDCSQQWACTPWVRRCGCTSTLSWAVRTTAS

SEQ ID NO: 83723 - protein, 60 aa, Homo sapiens
  Payload ID: 16661
  Gene Symbol: SPRYD3
  Gene Name: SPRY domain containing 3
  ENSP ID: ENSP00000448845
  MOD_RES (1)..(1): Any amino acid
XDGEEIEPEHEGRKVVVFFTRNGKIIGKKDAVVPSGGFFPTIGMLSCGEKVKVDLHPLSG

SEQ ID NO: 83724 - protein, 479 aa, Homo sapiens
  Payload ID: 16661
  Gene Symbol: SPRYD3
  Gene Name: SPRY domain containing 3
  ENSP ID: ENSP00000449452
MRRTRRPRVLLCQPGWNVVAQSELTAALTCQTQAIFSLLSSWDYRFVLMNKMDDLNLHYRFLNWRRRIREIREVRAFRYQERFKHILVDGDTLSYHGNSGEVGCYVASRPLTKDSNYFEVSIVDSGVRGTIAVGLVPQYYSLDHQPGWLPDSVAYHADDGKLYNGRAKGRQFGSKCNSGDRIGCGIEPVSFDVQTAQIFFTKNGKRVGSTIMPMSPDGLFPAVGMHSLGEEVRLHLNAELGREDDSVMMVDSYEDEWGRLHDVRVCGTLLEYLGKGKSIVDVGLAQARHPLSTRSHYFEVEIVDPGEKCYIALGLARKDYPKNRHPGWSRGSVAYHADDGKIFHGSGVGDPFGPRCYKGDIMGCGIMFPRDYILDSEGDSDDSCDTVILSPTARAVRNVRNVMYLHQEGEEEEEEEEEEEDGEEIEPEHEGRKVVVFFTRNGKIIGKKDAVVPSGGFFPTIGMLSCGEKVKVDLHPLSG

SEQ ID NO: 83725 - protein, 207 aa, Homo sapiens
  Payload ID: 16662
  Gene Symbol: SPRYD4
  Gene Name: SPRY domain containing 4
  Uniprot ID: Q8WW59
  ENSP ID: ENSP00000338034
MALLFARSLRLCRWGAKRLGVASTEAQRGVSFKLEEKTAHSSLALFRDDTGVKYGLVGLEPTKVALNVERFREWAVVLADTAVTSGRHYWEVTVKRSQQFRIGVADVDMSRDSCIGVDDRSWVFTYAQRKWYTMLANEKAPVEGIGQPEKVGLLLEYEAQKLSLVDVSQVSVVHTLQTDFRGPVVPAFALWDGELLTHSGLEVPEGL

SEQ ID NO: 83726 - protein, 125 aa, Homo sapiens
  Payload ID: 16662
  Gene Symbol: SPRYD4
  Gene Name: SPRY domain containing 4
  ENSP ID: ENSP00000487087
MGVSSLTCFLQSLCLPLPRPFSDCIPSWGLIIQLCLNLLHHDTSPSLCPHVTCSWGSTRWLKSKSFLPLAEGVVQSMTWPFFYSTFRVWALAPSVSALLTQCVKMKTEPSFPSSSVPQTFSPTQL

SEQ ID NO: 83727 - protein, 196 aa, Homo sapiens
  Payload ID: 16663
  Gene Symbol: SPRYD7
  Gene Name: SPRY domain containing 7
  Uniprot ID: Q5W111
  ENSP ID: ENSP00000354774
MATSVLCCLRCCRDGGTGHIPLKEMPAVQLDTQHMGTDVVIVKNGRRICGTGGCLASAPLHQNKSYFEFKIQSTGIWGIGVATQKVNLNQIPLGRDMHSLVMRNDGALYHNNEEKNRLPANSLPQEGDVVGITYDHVELNVYLNGKNMHCPASGIRGTVYPVVYVDDSAILDCQFSEFYHTPPPGFEKILFEQQIF

SEQ ID NO: 83728 - protein, 157 aa, Homo sapiens
  Payload ID: 16663
  Gene Symbol: SPRYD7
  Gene Name: SPRY domain containing 7
  Uniprot ID: Q5W111
  ENSP ID: ENSP00000367437
MATSVLCCLRCCRDGGTGHIPLKEMPAVQLDTQHMGIWGIGVATQKVNLNQIPLGRDMHSLVMRNDGALYHNNEEKNRLPANSLPQEGDVVGITYDHVELNVYLNGKNMHCPASGIRGTVYPVVYVDDSAILDCQFSEFYHTPPPGFEKILFEQQIF

SEQ ID NO: 83729 - protein, 157 aa, Homo sapiens; identical to SEQ ID NO: 83728
  Payload ID: 16663
  Gene Symbol: SPRYD7
  Gene Name: SPRY domain containing 7
  Uniprot ID: Q5W111
  ENSP ID: ENSP00000484495

SEQ ID NO: 83730 - protein, 1047 aa, Homo sapiens
  Payload ID: 16664
  Gene Symbol: SUPT16H
  Gene Name: SPT16 homolog, facilitates chromatin remodeling subunit
  Uniprot ID: Q9Y5B9
  ENSP ID: ENSP00000216297
MAVTLDKDAYYRRVKRLYSNWRKGEDEYANVDAIVVSVGVDEEIVYAKSTALQTWLFGYELTDTIMVFCDDKIIFMASKKKVEFLKQIANTKGNENANGAPAITLLIREKNESNKSSFDKMIEAIKESKNGKKIGVFSKDKFPGEFMKSWNDCLNKEGFDKIDISAVVAYTIAVKEDGELNLMKKAASITSEVFNKFFKERVMEIVDADEKVRHSKLAESVEKAIEEKKYLAGADPSTVEMCYPPIIQSGGNYNLKFSVVSDKNHMHFGAITCAMGIRFKSYCSNLVRTLMVDPSQEVQENYNFLLQLQEELLKELRHGVKICDVYNAVMDVVKKQKPELLNKITKNLGFGMGIEFREGSLVINSKNQYKLKKGMVFSINLGFSDLTNKEGKKPEEKTYALFIGDTVLVDEDGPATVLTSVKKKVKNVGIFLKNEDEEEEEEEKDEAEDLLGRGSRAALLTERTRNEMTAEEKRRAHQKELAAQLNEEAKRRLTEQKGEQQIQKARKSNVSYKNPSLMPKEPHIREMKIYIDKKYETVIMPVFGIATPFHIATIKNISMSVEGDYTYLRINFYCPGSALGRNEGNIFPNPEATFVKEITYRASNIKAPGEQTVPALNLQNAFRIIKEVQKRYKTREAEEKEKEGIVKQDSLVINLNRSNPKLKDLYIRPNIAQKRMQGSLEAHVNGFRFTSVRGDKVDILYNNIKHALFQPCDGEMIIVLHFHLKNAIMFGKKRHTDVQFYTEVGEITTDLGKHQHMHDRDDLYAEQMEREMRHKLKTAFKNFIEKVEALTKEELEFEVPFRDLGFNGAPYRSTCLLQPTSSALVNATEWPPFVVTLDEVELIHFERVQFHLKNFDMVIVYKDYSKKVTMINAIPVASLDPIKEWLNSCDLKYTEGVQSLNWTKIMKTIVDDPEGFFEQGGWSFLEPEGEGSDAEEGDSESEIEDETFNPSEDDYEEEEEDSDEDYSSEAEESDYSKESLGSEEESGKDWDELEEEARKADRESRYEEEEEQSRSMSRKRKASVHSSGRGSNRGSRHSSAPPKKKRK

SEQ ID NO: 83731 - protein, 83 aa, Homo sapiens
  Payload ID: 16664
  Gene Symbol: SUPT16H
  Gene Name: SPT16 homolog, facilitates chromatin remodeling subunit
  ENSP ID: ENSP00000450910
MAVTLDKDAYYRRVKRLYSNWREFPGSVPHPFRCSRIIHRRRPRTLPLNRESPAFTLSCGHHHLPRVPALVMHSSTSRSLFPP

SEQ ID NO: 83732 - protein, 81 aa, Homo sapiens
  Payload ID: 16664
  Gene Symbol: SUPT16H
  Gene Name: SPT16 homolog, facilitates chromatin remodeling subunit
  ENSP ID: ENSP00000451517
MAVTLDKDAYYRRVKRLYSNWRKGEDEYANVDAIVVSVGVDEEIVYAKSTALQSSGTQAFSSSLFCHPKNIALLHVVQNGF

SEQ ID NO: 83733 - protein, 66 aa, Homo sapiens
  Payload ID: 16664
  Gene Symbol: SUPT16H
  Gene Name: SPT16 homolog, facilitates chromatin remodeling subunit
  ENSP ID: ENSP00000452259
MAVTLDKDAYYRRVKRLYSNWRKGEDEYANVDAIVVSVGVDEEIVYAKSTALQQEKSGVLETDCQH

SEQ ID NO: 83734 - protein, 685 aa, Homo sapiens
  Payload ID: 16665
  Gene Symbol: SPTY2D1
  Gene Name: SPT2 chromatin protein domain containing 1
  Uniprot ID: Q68D10
  ENSP ID: ENSP00000337991
MDFREILMIASKGQGVNNVPKRYSLAVGPPKKDPKVKGVQSAAVQAFLKRKEEELRRKALEEKRRKEELVKKRIELKHDKKARAMAKRTKDNFHGYNGIPIEEKSKKRQATESHTSQGTDREYEMEEENEFLEYNHAESEQEYEEEQEPPKVESKPKVPLKSAPPPMNFTDLLRLAEKKQFEPVEIKVVKKSEERPMTAEELREREFLERKHRRKKLETDGKLPPTVSKKAPSQKESVGTKLSKGSGDRHPSSKGMPLPHAEKKSRPSMANEKHLALSSSKSMPGERIKAGSGNSSQPSLREGHDKPVFNGAGKPHSSTSSPSVPKTSASRTQKSAVEHKAKKSLSHPSHSRPGPMVTPHNKAKSPGVRQPGSSSSSAPGQPSTGVARPTVSSGPVPRRQNGSSSSGPERSISGSKKPTNDSNPSRRTVSGTCGPGQPASSSGGPGRPISGSVSSARPLGSSRGPGRPVSSPHELRRPVSGLGPPGRSVSGPGRSISGSIPAGRTVSNSVPGRPVSSLGPGQTVSSSGPTIKPKCTVVSETISSKNIISRSSNGQMNGMKPPLSGYRAAQGPQRLPFPTGYKRQREYEEEDDDDDEYDSEMEDFIEDEGEPQEEISKHIREIFGYDRKKYKDESDYALRYMESSWKEQQKEEAKSLRLGMQEDLEEMRREEEEMQRRRAKKLKRR

SEQ ID NO: 83735 - protein, 779 aa, Homo sapiens
  Payload ID: 16666
  Gene Symbol: SUPT20H
  Gene Name: SPT20 homolog, SAGA complex component
  Uniprot ID: Q8NEM7
  ENSP ID: ENSP00000218894
MQQALELALDRAEYVIESARQRPPKRKYLSSGRKSVFQKLYDLYIEECEKEPEVKKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLICDVHSITSDNHKWTQEDKLLLESQLILATAEPLCLDPSIAVTCTANRLLYNKQKMNTRPMKRCFKRYSRSSLNRQQDLSHCPPPPQLRLLDFLQKRKERKAGQHYDLKISKAGNCVDMWKRSPCNLAIPSEVDVEKYAKVEKSIKSDDSQPTVWPAHDVKDDYVFECEAGTQYQKTKLTILQSLGDPLYYGKIQPCKADEESDSQMSPSHSSTDDHSNWFIIGSKTDAERVVNQYQELVQNEAKCPVKMSHSSSGSASLSQVSPGKETDQTETVSVQSSVLGKGVKHRPPPIKLPSSSGNSSSGNYFTPQQTSSFLKSPTPPPSSKPSSIPRKSSVDLNQVSMLSPAALSPASSSQRTTATQVMANSAGLNFINVVGSVCGAQALMSGSNPMLGCNTGAITPAGINLSGLLPSGGLLPNALPSAMQAASQAGVPFGLKNTSSLRPLNLLQLPGGSLIFNTLQQQQQQLSQFTPQQPQQPTTCSPQQPGEQGSEQGSTSQEQALSAQQAAVINLTGVGSFMQSQAAVLSQLGSAENRPEQSLPQQRFQLSSAFQQQQQQIQQLRFLQHQMAMAAAAAQTAQLHHHRHTGSQSKSKMKRGTPTTPKF

SEQ ID NO: 83736 - protein, 733 aa, Homo sapiens
  Payload ID: 16666
  Gene Symbol: SUPT20H
  Gene Name: SPT20 homolog, SAGA complex component
  Uniprot ID: Q8NEM7
  ENSP ID: ENSP00000348512
MQQALELALDRAEYVIESARQRPPKRKYLSSGRKSVFQKLYDLYIEECEKEPEVKQKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLICDVHSITSDNHKWTQEDKLLLESQLILATAEPLCLDPSIAVTCTANRLLYNKQKMNTRPMKRCFKRYSRSSLNRQQDLSHCPPPPQLRLLDFLQKRKERKAGQHYDLKISKAGNCVDMWKRSPCNLAIPSEVDVEKYAKVEKSIKSDDSQPTVWPAHDVKDDYVFECEAGTQYQKTKLTILQSLGDPLYYGKIQPCKADEESDSQMSPSHSSTDDHSNWFIIGSKTDAERVVNQYQELVQNEAKCPVKMSHSSSGSASLSQVSPGKETDQTETVSVQSSVLGKGVKHRPPPIKLPSSSGNSSSGNYFTPQQTSSFLKSPTPPPSSKPSSIPRKSSVDLNQVSMLSPAALSPASSSQRTTATQVMANSAGLNFINVVGSVCGAQALMSGSNPMLGCNTGAITPAGINLSGLLPSGGLLPNALPSAMQAASQAGVPFGLKNTSSLRPLNLLQLPGGSLIFNTLQQQQQQLSQFTPQQPQQPTTCSPQQPGEQGSEQGSTSQEQALSAQQAAVINLTGVGSFMQSQAAAVAILAASNGYGSSSSTNSSATSSSAYRQPVKK

SEQ ID NO: 83737 - protein, 733 aa, Homo sapiens; identical to SEQ ID NO: 83736
  Payload ID: 16666
  Gene Symbol: SUPT20H
  Gene Name: SPT20 homolog, SAGA complex component
  Uniprot ID: Q8NEM7
  ENSP ID: ENSP00000353388

SEQ ID NO: 83738 - protein, 811 aa, Homo sapiens
  Payload ID: 16666
  Gene Symbol: SUPT20H
  Gene Name: SPT20 homolog, SAGA complex component
  Uniprot ID: Q8NEM7
  ENSP ID: ENSP00000417510
MQQALELALDRAEYVIESARQRPPKRKYLSSGRKSVFQKLYDLYIEECEKEPEVKKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLICDVHSITSDNHKWTQEDKLLLESQLILATAEPLCLDPSIAVTCTANRLLYNKQKMNTRPMKRCFKRYSRSSLNRQQDLSHCPPPPQLRLLDFLQKRKERKAGQHYDLKISKAGNCVDMWKRSPCNLAIPSEVDVEKYAKVEKSIKSDDSQPTVWPAHDVKDDYVFECEAGTQYQKTKLTILQSLGDPLYYGKIQPCKADEESDSQMSPSHSSTDDHSNWFIIGSKTDAERVVNQYQELVQNEAKCPVKMSHSSSGSASLSQVSPGKETDQTETVSVQSSVLGKGVKHRPPPIKLPSSSGNSSSGNYFTPQQTSSFLKSPTPPPSSKPSSIPRKSSVDLNQVSMLSPAALSPASSSQRSGTPKPSTPTPTPSSTPHPPDAQSSTPSTPSATPTPQDSGFTPQPTLLTQFAQQQRSLSQAMPVTTIPLSTMVTSITPGTTATQVMANSAGLNFINVVGSVCGAQALMSGSNPMLGCNTGAITPAGINLSGLLPSGGLLPNALPSAMQAASQAGVPFGLKNTSSLRPLNLLQLPGGSLIFNTLQQQQQQLSQFTPQQPQQPTTCSPQQPGEQGSEQGSTSQEQALSAQQAAVINLTGVGSFMQSQAAAVAILAASNGYGSSSSTNSSATSSSAYRQPVKK

SEQ ID NO: 83739 - protein, 733 aa, Homo sapiens; identical to SEQ ID NO: 83736
  Payload ID: 16666
  Gene Symbol: SUPT20H
  Gene Name: SPT20 homolog, SAGA complex component
  Uniprot ID: Q8NEM7
  ENSP ID: ENSP00000419754

SEQ ID NO: 83740 - protein, 378 aa, Homo sapiens
  Payload ID: 16666
  Gene Symbol: SUPT20H
  Gene Name: SPT20 homolog, SAGA complex component
  ENSP ID: ENSP00000419787
  MOD_RES (1)..(1): Any amino acid
XSNWFIIGSKTDAERVVNQYQELVQNEAKCPVKMSHSSSGSASLSQVSPGKETDQTETVSVQSSVLGKGVKHRPPPIKLPSSSGNSSSGNYFTPQQTSSFLKSPTPPPSSKPSSIPRKSSVDLNQVSMLSPAALSPASSSQRTTATQVMANSAGLNFINVVGSVCGAQALMSGSNPMLGCNTGAITPAGINLSGLLPSGGLLPNALPSAMQAASQAGVPFGLKNTSSLRPLNLLQQQQQQLSQFTPQQPQQPTTCSPQQPGEQGSEQGSTSQEQALSAQQAAVINLTGVGSFMQSQAAVLSQLGSAENRPEQSLPQQRFQLSSAFQQQQQQIQQLRFLQHQMAMAAAAAQTAQLHHHRHTGSQSKSKMKRGTPTTPKF

SEQ ID NO: 83741 - protein, 190 aa, Homo sapiens
  Payload ID: 16666
  Gene Symbol: SUPT20H
  Gene Name: SPT20 homolog, SAGA complex component
  ENSP ID: ENSP00000420170
MQQALELALDRAEYVIESARQRPPKRKYLSSGRKSVFQKLYDLYIEECEKEPEVKQKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLICDVHSITSDNHKWTQ

SEQ ID NO: 83742 - protein, 736 aa, Homo sapiens [sequence omitted]

SEQ ID NO: 83743 - protein, 498 aa, Homo sapiens
  Payload ID: 16666
  Gene Symbol: SUPT20H
  Gene Name: SPT20 homolog, SAGA complex component
  ENSP ID: ENSP00000473416
MYVIESARQRPPKRKYLSSGRKSVFQKLYDLYIEECEKEPEVKKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLICDVHSITSDNHKWTQEDKLLLESQLILATAEPLCLDPSIAVTCTANRLLYNKQKMNTRPMKRCFKRYSRSSLNRQQDLSHCPPPPQLRLLDFLQKRKERKAGQHYDLKISKAGNCVDMWKRSPCNLAIPSEVDDVKDDYVFECEAGTQYQKTKLTILQSLGDPLYYGKIQPCKADEESDSQMSPSHSSTDDHSNWFIIGSKTDAERVVNQYQELVQNEAKCPVKMSHSSSGSASLSQVSPGKETDQTETVSVQSSVLGKGVKHRPPPIKLPSSSGNSSSGNYFTPQQTSSFLKSPTPPPSSKPSSIPRKSSVDLNQVSMLSPAALSPASSSQRHES

SEQ ID NO: 83744 - protein, 522 aa, Homo sapiens
  Payload ID: 16666
  Gene Symbol: SUPT20H
  Gene Name: SPT20 homolog, SAGA complex component
  ENSP ID: ENSP00000473592
MYVIESARQRPPKRKYLSSGRKSVFQKLYDLYIEECEKEPEVKKLRRNVNLLEKLVMQETLSCLVVNLYPGNEGYSLMLRGKNGSDSETIRLPYEEGELLEYLDAEELPPILVDLLEKSQVNIFHCGCVIAEIRDYRQSSNMKSPGYQSRHILLRPTMQTLICDVHSITSDNHKWTQEDKLLLESQLILATAEPLCLDPSIAVTCTANRLLYNKQKMNTRPMKRCFKRYSRSSLNRQQDLSHCPPPPQLRLLDFLQKRKERKAGQHYDLKISKAGNCVDMWKRSPCNLAIPSEVDVEKYAKVEKSIKSDDSQPTVWPAHDVKDDYVFECEAGTQYQKTKLTILQSLGDPLYYGKIQPCKADEESDSQMSPSHSSTDDHSNWFIIGSKTDAERVVNQYQELVQNEAKCPVKMSHSSSGSASLSQVSPGKETDQTETVSVQSSVLGKGVKHRPPPIKLPSSSGNSSSGNYFTPQQTSSFLKSPTPPPSSKPSSIPRKSSVDLNQVSMLSPAALSPASSSQRHES

SEQ ID NO: 83745 - protein, 165 aa, Homo sapiens
  Payload ID: 16667
  Gene Symbol: SUPT3H
  Gene Name: SPT3 homolog, SAGA and STAGA complex component
  ENSP ID: ENSP00000306718
MFEDDEIDEVKQERMERAERQTRIMDSAQYAEFCESRQLSFSKKASKFRDWLDCSSMEIKPNVVAMEILAYLAYETVAQLVDLALLVRQDMVTKAGDPFSHAISATFIQYHNSAESTAACGVEAHSDAIQPCHIREAIRRYSHRIGPLSPFTNAYRRNGMAFLAC

SEQ ID NO: 83746 - protein, 108 aa, Homo sapiens
  Payload ID: 16667
  Gene Symbol: SUPT3H
  Gene Name: SPT3 homolog, SAGA and STAGA complex component
  ENSP ID: ENSP00000360513
MEILAYLAYETVAQLVDLALLVRQDMVTKAGDPFSHAISATFIQYHNSAESTAACGVEAHSDAIQPCHIREAIRRYSHRIGPLSPFTISFSLTECLPQEWDGFSSLLM

SEQ ID NO: 83747 - protein, 317 aa, Homo sapiens
  Payload ID: 16667
  Gene Symbol: SUPT3H
  Gene Name: SPT3 homolog, SAGA and STAGA complex component
  Uniprot ID: O75486
  ENSP ID: ENSP00000360514
MNNTAASPMSTATSSSGRSTGKSISFATELQSMMYSLGDARRPLHETAVLVEDVVHTQLINLLQQAAEVSQLRGARVITPEDLLFLMRKDKKKLRRLLKYMFIRDYKSKIVKGIDEDDLLEDKLSGSNNANKRQKIAQDFLNSIDQTGELLAMFEDDEIDEVKQERMERAERQTRIMDSAQYAEFCESRQLSFSKKASKFRDWLDCSSMEIKPNVVAMEILAYLAYETVAQLVDLALLVRQDMVTKAGDPFSHAISATFIQYHNSAESTAACGVEAHSDAIQPCHIREAIRRYSHRIGPLSPFTNAYRRNGMAFLAC

SEQ ID NO: 83748 - protein, 328 aa, Homo sapiens
  Payload ID: 16667
  Gene Symbol: SUPT3H
  Gene Name: SPT3 homolog, SAGA and STAGA complex component
  Uniprot ID: O75486
  ENSP ID: ENSP00000360515
MVVFGTTFFNFDSFIGKTDSIEIIGKSVFPYCYHNILPLLNDSGRYSLGDARRPLHETAVLVEDVVHTQLINLLQQAAEVSQLRGARVITPEDLLFLMRKDKKKLRRLLKYMFIRDYKSKIVKGIDEDDLLEDKLSGSNNANKRQKIAQDFLNSIDQTGELLAMFEDDEIDEVKQERMERAERQTRIMDSAQYAEFCESRQLSFSKKASKFRDWLDCSSMEIKPNVVAMEILAYLAYETVAQLVDLALLVRQDMVTKAGDPFSHAISATFIQYHNSAESTAACGVEAHSDAIQPCHIREAIRRYSHRIGPLSPFTNAYRRNGMAFLAC

SEQ ID NO: 83749 - protein, 317 aa, Homo sapiens; identical to SEQ ID NO: 83747
  Payload ID: 16667
  Gene Symbol: SUPT3H
  Gene Name: SPT3 homolog, SAGA and STAGA complex component
  Uniprot ID: O75486
  ENSP ID: ENSP00000436411

SEQ ID NO: 83750 - protein, 117 aa, Homo sapiens
  Payload ID: 16668
  Gene Symbol: SUPT4H1
  Gene Name: SPT4 homolog, DSIF elongation factor subunit
  Uniprot ID: P63272
  ENSP ID: ENSP00000225504
MALETVPKDLRHLRACLLCSLVKTIDQFEYDGCDNCDAYLQMKGNREMVYDCTSSSFDGIIAMMSPEDSWVSKWQRVSNFKPGVYAVSVTGRLPQGIVRELKSRGVAYKSRDTAIKT

SEQ ID NO: 83751 - protein, 76 aa, Homo sapiens
  Payload ID: 16668
  Gene Symbol: SUPT4H1
  Gene Name: SPT4 homolog, DSIF elongation factor subunit
  ENSP ID: ENSP00000462100
MKGNREMVYDCTSSSFDGIIAMMSPEDSWVSKWQRVSNFKPGVYAVSVTGRLPQGIVRELKSRGVAYKSRDTAIKT

SEQ ID NO: 83752 - protein, 42 aa, Homo sapiens
  Payload ID: 16668
  Gene Symbol: SUPT4H1
  Gene Name: SPT4 homolog, DSIF elongation factor subunit
  ENSP ID: ENSP00000462602
MALETVPKDLRHLRACLLCSLVKVSVGDLVVGPMGDQDYRPV

SEQ ID NO: 83753 - protein, 117 aa, Homo sapiens; identical to SEQ ID NO: 83750
  Payload ID: 16668
  Gene Symbol: SUPT4H1
  Gene Name: SPT4 homolog, DSIF elongation factor subunit
  Uniprot ID: P63272
  ENSP ID: ENSP00000462670

SEQ ID NO: 83754 - protein, 59 aa, Homo sapiens
  Payload ID: 16668
  Gene Symbol: SUPT4H1
  Gene Name: SPT4 homolog, DSIF elongation factor subunit
  ENSP ID: ENSP00000463979
MALETVPKDLRHLRACLLCSLVKTIDQFEYDGCDNCDAYLQMKGNREMVYDCTSSSFDG

SEQ ID NO: 83755 - protein, 108 aa, Homo sapiens
  Payload ID: 16668
  Gene Symbol: SUPT4H1
  Gene Name: SPT4 homolog, DSIF elongation factor subunit
  ENSP ID: ENSP00000464618
MLISPFPLFFFHSQTIDQFEYDGCDNCDAYLQMKGNREMVYDCTSSSFDGIIAMMSPEDSWVSKWQRVSNFKPGVYAVSVTGRLPQGIVRELKSRGVAYKSRDTAIKT

SEQ ID NO: 83756 - protein, 1083 aa, Homo sapiens
  Payload ID: 16669
  Gene Symbol: SUPT5H
  Gene Name: SPT5 homolog, DSIF elongation factor subunit
  Uniprot ID: O00267
  ENSP ID: ENSP00000352117
MSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTPLQIKSVVAPEHVKGYIYVEAYKQTHVKQAIEGVGNLRLGYWNQQMVPIKEMTDVLKVVKEVANLKPKSWVRLKRGIYKDDIAQVDYVEPSQNTISLKMIPRIDYDRIKARMSLKDWFAKRKKFKRPPQRLFDAEKIRSLGGDVASDGDFLIFEGNRYSRKGFLFKSFAMSAVITEGVKPTLSELEKFEDQPEGIDLEVVTESTGKEREHNFQPGDNVEVCEGELINLQGKILSVDGNKITIMPKHEDLKDMLEFPAQELRKYFKMGDHVKVIAGRFEGDTGLIVRVEENFVILFSDLTMHELKVLPRDLQLCSETASGVDVGGQHEWGELVQLDPQTVGVIVRLERETFQVLNMYGKVVTVRHQAVTRKKDNRFAVALDSEQNNIHVKDIVKVIDGPHSGREGEIRHLFRSFAFLHCKKLVENGGMFVCKTRHLVLAGGSKPRDVTNFTVGGFAPMSPRISSPMHPSAGGQRGGFGSPGGGSGGMSRGRGRRDNELIGQTVRISQGPYKGYIGVVKDATESTARVELHSTCQTISVDRQRLTTVGSRRPGGMTSTYGRTPMYGSQTPMYGSGSRTPMYGSQTPLQDGSRTPHYGSQTPLHDGSRTPAQSGAWDPNNPNTPSRAEEEYEYAFDDEPTPSPQAYGGTPNPQTPGYPDPSSPQVNPQYNPQTPGTPAMYNTDQFSPYAAPSPQGSYQPSPSPQSYHQVAPSPAGYQNTHSPASYHPTPSPMAYQASPSPSPVGYSPMTPGAPSPGGYNPHTPGSGIEQNSSDWVTTDIQVKVRDTYLDTQVVGQTGVIRSVTGGMCSVYLKDSEKVVSISSEHLEPITPTKNNKVKVILGEDREATGVLLSIDGEDGIVRMDLDEQLKILNLRFLGKLLEA

SEQ ID NO: 83757 - protein, 1083 aa, Homo sapiens; identical to SEQ ID NO: 83756
  Payload ID: 16669
  Gene Symbol: SUPT5H
  Gene Name: SPT5 homolog, DSIF elongation factor subunit
  Uniprot ID: O00267
  ENSP ID: ENSP00000384505

SEQ ID NO: 83758 - protein, 1087 aa, Homo sapiens
  Payload ID: 16669
  Gene Symbol: SUPT5H
  Gene Name: SPT5 homolog, DSIF elongation factor subunit
  Uniprot ID: O00267
  ENSP ID: ENSP00000404029
MSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKEEIEASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTPLQIKSVVAPEHVKGYIYVEAYKQTHVKQAIEGVGNLRLGYWNQQMVPIKEMTDVLKVVKEVANLKPKSWVRLKRGIYKDDIAQVDYVEPSQNTISLKMIPRIDYDRIKARMSLKDWFAKRKKFKRPPQRLFDAEKIRSLGGDVASDGDFLIFEGNRYSRKGFLFKSFAMSAVITEGVKPTLSELEKFEDQPEGIDLEVVTESTGKEREHNFQPGDNVEVCEGELINLQGKILSVDGNKITIMPKHEDLKDMLEFPAQELRKYFKMGDHVKVIAGRFEGDTGLIVRVEENFVILFSDLTMHELKVLPRDLQLCSETASGVDVGGQHEWGELVQLDPQTVGVIVRLERETFQVLNMYGKVVTVRHQAVTRKKDNRFAVALDSEQNNIHVKDIVKVIDGPHSGREGEIRHLFRSFAFLHCKKLVENGGMFVCKTRHLVLAGGSKPRDVTNFTVGGFAPMSPRISSPMHPSAGGQRGGFGSPGGGSGGMSRGRGRRDNELIGQTVRISQGPYKGYIGVVKDATESTARVELHSTCQTISVDRQRLTTVGSRRPGGMTSTYGRTPMYGSQTPMYGSGSRTPMYGSQTPLQDGSRTPHYGSQTPLHDGSRTPAQSGAWDPNNPNTPSRAEEEYEYAFDDEPTPSPQAYGGTPNPQTPGYPDPSSPQVNPQYNPQTPGTPAMYNTDQFSPYAAPSPQGSYQPSPSPQSYHQVAPSPAGYQNTHSPASYHPTPSPMAYQASPSPSPVGYSPMTPGAPSPGGYNPHTPGSGIEQNSSDWVTTDIQVKVRDTYLDTQVVGQTGVIRSVTGGMCSVYLKDSEKVVSISSEHLEPITPTKNNKVKVILGEDREATGVLLSIDGEDGIVRMDLDEQLKILNLRFLGKLLEA

SEQ ID NO: 83759 - protein, 1087 aa, Homo sapiens; identical to SEQ ID NO: 83758
  Payload ID: 16669
  Gene Symbol: SUPT5H
  Gene Name: SPT5 homolog, DSIF elongation factor subunit
  Uniprot ID: O00267
  ENSP ID: ENSP00000469090

SEQ ID NO: 83760 - protein, 164 aa, Homo sapiens
  Payload ID: 16669
  Gene Symbol: SUPT5H
  Gene Name: SPT5 homolog, DSIF elongation factor subunit
  ENSP ID: ENSP00000469915
DQWEDGAEDILEKEEIEASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTVDYVEPSQNTISLKMIPRIDYDRIKARMSLKDWFAKRKKFKRPPQ

SEQ ID NO: 83761 - protein, 1087 aa, Homo sapiens; identical to SEQ ID NO: 83758
  Payload ID: 16669
  Gene Symbol: SUPT5H
  Gene Name: SPT5 homolog, DSIF elongation factor subunit
  Uniprot ID: O00267
  ENSP ID: ENSP00000470252

SEQ ID NO: 83762 - protein, 102 aa, Homo sapiens
  Payload ID: 16669
  Gene Symbol: SUPT5H
  Gene Name: SPT5 homolog, DSIF elongation factor subunit
  ENSP ID: ENSP00000470595
MSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEK

SEQ ID NO: 83763 - protein, 54 aa, Homo sapiens
  Payload ID: 16669
  Gene Symbol: SUPT5H
  Gene Name: SPT5 homolog, DSIF elongation factor subunit
  ENSP ID: ENSP00000471561
MSDSEDSNFSEEEDSERSSDGEEAEVDEERRSAAGSEKEEEPEDEEEEEEEEEY

SEQ ID NO: 83764 - protein, 102 aa, Homo sapiens; identical to SEQ ID NO: 83762
  Payload ID: 16669
  Gene Symbol: SUPT5H
  Gene Name: SPT5 homolog, DSIF elongation factor subunit
  ENSP ID: ENSP00000472675

SEQ ID NO: 83765 - protein, 1726 aa, Homo sapiens
  Payload ID: 16670
  Gene Symbol: SUPT6H
  Gene Name: SPT6 homolog, histone chaperone
  Uniprot ID: Q7KZ85
  ENSP ID: ENSP00000319104
MSDFVESEAEESEEEYNDEGEVVPRVTKKFVEEEDDDEEEEEENLDDQDEQGNLKGFINDDDDEDEGEEDEGSDSGDSEDDVGHKKRKRTSFDDRLEDDDFDLIEENLGVKVKRGQKYRRVKKMSDDEDDDEEEYGKEEHEKEAIAEEIFQDGEGEEGQEAMEAPMAPPEEEEEDDEESDIDDFIVDDDGQPLKKPKWRKKLPGYTDAALQEAQEIFGVDFDYDEFEKYNEYDEELEEEYEYEDDEAEGEIRVRPKKTTKKRVSRRSIFEMYEPSELESSHLTDQDNEIRATDLPERFQLRSIPVKGAEDDELEEEADWIYRNAFATPTISLQESCDYLDRGQPASSFSRKGPSTIQKIKEALGFMRNQHFEVPFIAFYRKEYVEPELHINDLWRVWQWDEKWTQLRIRKENLTRLFEKMQAYQYEQISADPDKPLADGIRALDTTDMERLKDVQSMDELKDVYNHFLLYYGRDIPKMQNAAKASRKKLKRVREEGDEEGEGDEAEDEEQRGPELKQASRRDMYTICQSAGLDGLAKKFGLTPEQFGENLRDSYQRHETEQFPAEPLELAKDYVCSQFPTPEAVLEGARYMVALQIAREPLVRQVLRQTFQERAKLNITPTKKGRKDVDEAHYAYSFKYLKNKPVKELRDDQFLKICLAEDEGLLTTDISIDLKGVEGYGNDQTYFEEIKQFYYRDEFSHQVQEWNRQRTMAIERALQQFLYVQMAKELKNKLLAEAKEYVIKACSRKLYNWLRVAPYRPDQQVEEDDDFMDENQGKGIRVLGIAFSSARDHPVFCALVNGEGEVTDFLRLPHFTKRRTAWREEEREKKAQDIETLKKFLLNKKPHVVTVAGENRDAQMLIEDVKRIVHELDQGQQLSSIGVELVDNELAILYMNSKKSEAEFRDYPPVLRQAVSLARRIQDPLIEFAQVCSSDEDILCLKFHPLQEHVVKEELLNALYCEFINRVNEVGVDVNRAIAHPYSQALIQYVCGLGPRKGTHLLKILKQNNTRLESRTQLVTMCHMGPKVFMNCAGFLKIDTASLGDSTDSYIEVLDGSRVHPETYEWARKMAVDALEYDESAEDANPAGALEEILENPERLKDLDLDAFAEELERQGYGDKHITLYDIRAELSCRYKDLRTAYRSPNTEEIFNMLTKETPETFYIGKLIICNVTGIAHRRPQGESYDQAIRNDETGLWQCPFCQQDNFPELSEVWNHFDSGSCPGQAIGVKTRLDNGVTGFIPTKFLSDKVVKRPEERVKVGMTVHCRIMKIDIEKFSADLTCRTSDLMDRNNEWKLPKDTYYDFDAEAADHKQEEDMKRKQQRTTYIKRVIAHPSFHNINFKQAEKMMETMDQGDVIIRPSSKGENHLTVTWKVSDGIYQHVDVREEGKENAFSLGATLWINSEEFEDLDEIVARYVQPMASFARDLLNHKYYQDCSGGDRKKLEELLIKTKKEKPTFIPYFICACKELPGKFLLGYQPRGKPRIEYVTVTPEGFRYRGQIFPTVNGLFRWFKDHYQDPVPGITPSSSSRTRTPASINATPANINLADLTRAVNALPQNMTSQMFSAIAAVTGQGQNPNATPAQWASSQYGYGGSGGGSSAYHVFPTPAQQPVATPLMTPSYSYTTPSQPITTPQYHQLQASTTPQSAQAQPQPSSSSRQRQQQPKSNSHAAIDWGKMAEQWLQEKEAERRKQKQRLTPRPSPSPMIESTPMSIAGDATPLLDEMDR

SEQ ID NO: 83766 - protein, 1726 aa, Homo sapiens; identical to SEQ ID NO: 83765
  Payload ID: 16670
  Gene Symbol: SUPT6H
  Gene Name: SPT6 homolog, histone chaperone
  Uniprot ID: Q7KZ85
  ENSP ID: ENSP00000338143

SEQ ID NO: 83767 - protein, 50 aa, Homo sapiens
  Payload ID: 16670
  Gene Symbol: SUPT6H
  Gene Name: SPT6 homolog, histone chaperone
  ENSP ID: ENSP00000464545
MSDFVESEAEESEEEYNDEGEVVPRVTKKFVEEEDDDEEEEEENLDDQDE

SEQ ID NO: 83768 - protein, 53 aa, Homo sapiens
  Payload ID: 16670
  Gene Symbol: SUPT6H
  Gene Name: SPT6 homolog, histone chaperone
  ENSP ID: ENSP00000465508
MSDFVESEAEESEEEYNDEGEVVPRVTKKFVEEEDDGEEAPASSFSPLLLSFG

SEQ ID NO: 83769 - protein, 414 aa, Homo sapiens
  Payload ID: 16671
  Gene Symbol: SUPT7L
  Gene Name: SPT7-like STAGA complex gamma subunit
  Uniprot ID: O94864
  ENSP ID: ENSP00000336750
MNLQRYWGEIPISSSQTNRSSFDLLPREFRLVEVHDPPLHQPSANKPKPPTMLDIPSEPCSLTIHTIQLIQHNRRLRNLIATAQAQNQQQTEGVKTEESEPLPSCPGSPPLPDDLLPLDCKNPNAPFQIRHSDPESDFYRGKGEPVTELSWHSCRQLLYQAVATILAHAGFDCANESVLETLTDVAHEYCLKFTKLLRFAVDREARLGQTPFPDVMEQVFHEVGIGSVLSLQKFWQHRIKDYHSYMLQISKQLSEEYERIVNPEKATEDAKPVKIKEEPVSDITFPVSEELEADLASGDQSLPMGVLGAQSERFPSNLEVEASPQASSAEVNASPLWNLAHVKMEPQESEEGNVSGHGVLGSDVFEEPMSGMSEAGIPQSPDDSDSSYGSHSTDSLMGSSPVFNQRCKKRMRKI

SEQ ID NO: 83770 - protein, 412 aa, Homo sapiens
  Payload ID: 16671
  Gene Symbol: SUPT7L
  Gene Name: SPT7-like STAGA complex gamma subunit
  Uniprot ID: O94864
  ENSP ID: ENSP00000384469
MLRYWGEIPISSSQTNRSSFDLLPREFRLVEVHDPPLHQPSANKPKPPTMLDIPSEPCSLTIHTIQLIQHNRRLRNLIATAQAQNQQQTEGVKTEESEPLPSCPGSPPLPDDLLPLDCKNPNAPFQIRHSDPESDFYRGKGEPVTELSWHSCRQLLYQAVATILAHAGFDCANESVLETLTDVAHEYCLKFTKLLRFAVDREARLGQTPFPDVMEQVFHEVGIGSVLSLQKFWQHRIKDYHSYMLQISKQLSEEYERIVNPEKATEDAKPVKIKEEPVSDITFPVSEELEADLASGDQSLPMGVLGAQSERFPSNLEVEASPQASSAEVNASPLWNLAHVKMEPQESEEGNVSGHGVLGSDVFEEPMSGMSEAGIPQSPDDSDSSYGSHSTDSLMGSSPVFNQRCKKRMRKI

SEQ ID NO: 83771 - protein, 279 aa, Homo sapiens
  Payload ID: 16671
  Gene Symbol: SUPT7L
  Gene Name: SPT7-like STAGA complex gamma subunit
  Uniprot ID: O94864
  ENSP ID: ENSP00000385218
MNLQSGKGEPVTELSWHSCRQLLYQAVATILAHAGFDCANESVLETLTDVAHEYCLKFTKLLRFAVDREARLGQTPFPDVMEQVFHEVGIGSVLSLQKFWQHRIKDYHSYMLQISKQLSEEYERIVNPEKATEDAKPVKIKEEPVSDITFPVSEELEADLASGDQSLPMGVLGAQSERFPSNLEVEASPQASSAEVNASPLWNLAHVKMEPQESEEGNVSGHGVLGSDVFEEPMSGMSEAGIPQSPDDSDSSYGSHSTDSLMGSSPVFNQRCKKRMRKI

SEQ ID NO: 83772 - protein, 412 aa, Homo sapiens; identical to SEQ ID NO: 83770
  Payload ID: 16671
  Gene Symbol: SUPT7L
  Gene Name: SPT7-like STAGA complex gamma subunit
  Uniprot ID: O94864
  ENSP ID: ENSP00000385436

SEQ ID NO: 83773 - protein, 412 aa, Homo sapiens; identical to SEQ ID NO: 83770
  Payload ID: 16671
  Gene Symbol: SUPT7L
  Gene Name: SPT7-like STAGA complex gamma subunit
  Uniprot ID: O94864
  ENSP ID: ENSP00000441110

SEQ ID NO: 83774 - protein, 59 aa, Homo sapiens
  Payload ID: 16672
  Gene Symbol: SPTY2D1-AS1
  Gene Name: SPTY2D1 antisense RNA 1
  ENSP ID: ENSP00000489079
MIVLGWMFFVGLVCYMGTFPELMPPTLKWQERWPVQESKTQLRRRALGEDLLQNHVEGI

SEQ ID NO: 83775 - protein, 56 aa, Homo sapiens
  Payload ID: 16672
  Gene Symbol: SPTY2D1-AS1
  Gene Name: SPTY2D1 antisense RNA 1
  ENSP ID: ENSP00000489122
MIVLGWMFFVGLVCYMGTFPELMPPTLKWQERWPVQESKTQLRRRALGLALPPRLE

SEQ ID NO: 83776 - protein, 40 aa, Homo sapiens
  Payload ID: 16672
  Gene Symbol: SPTY2D1-AS1
  Gene Name: SPTY2D1 antisense RNA 1
  ENSP ID: ENSP00000489253
MIVVLWMLLIAGTMWKGYKYPPGGTPVEVSKDDPGEVMQL

SEQ ID NO: 83777 - protein, 76 aa, Homo sapiens
  Payload ID: 16672
  Gene Symbol: SPTY2D1-AS1
  Gene Name: SPTY2D1 antisense RNA 1
  ENSP ID: ENSP00000489337
MIVLGWMFFVGLVCYMGTFPELMPPTLKWQERWPVQESKTQLRRRALGTMWKGYKYPPGGTPVEVSKDDPGEVMQL

SEQ ID NO: 83778 - protein, 59 aa, Homo sapiens; identical to SEQ ID NO: 83774
  Payload ID: 16672
  Gene Symbol: SPTY2D1-AS1
  Gene Name: SPTY2D1 antisense RNA 1
  ENSP ID: ENSP00000489616

SEQ ID NO: 83779 - protein, 574 aa, Homo sapiens
  Payload ID: 16673
  Gene Symbol: SQLE
  Gene Name: squalene epoxidase
  Uniprot ID: Q14534
  ENSP ID: ENSP00000265896
MWTFLGIATFTYFYKKFGDFITLANREVLLCVLVFLSLGLVLSYRCRHRNGGLLGRQQSGSQFALFSDILSGLPFIGFFWAKSPPESENKEQLEARRRRKGTNISETSLIGTAACTSTSSQNDPEVIIVGAGVLGSALAAVLSRDGRKVTVIERDLKEPDRIVGEFLQPGGYHVLKDLGLGDTVEGLDAQVVNGYMIHDQESKSEVQIPYPLSENNQVQSGRAFHHGRFIMSLRKAAMAEPNAKFIEGVVLQLLEEDDVVMGVQYKDKETGDIKELHAPLTVVADGLFSKFRKSLVSNKVSVSSHFVGFLMKNAPQFKANHAELILANPSPVLIYQISSSETRVLVDIRGEMPRNLREYMVEKIYPQIPDHLKEPFLEATDNSHLRSMPASFLPPSSVKKRGVLLLGDAYNMRHPLTGGGMTVAFKDIKLWRKLLKGIPDLYDDAAIFEAKKSFYWARKTSHSFVVNILAQALYELFSATDDSLHQLRKACFLYFKLGGECVAGPVGLLSVLSPNPLVLIGHFFAVAIYAVYFCFKSEPWITKPRALLSSGAVLYKACSVIFPLIYSEMKYMVH

SEQ ID NO: 83780 - protein, 184 aa, Homo sapiens
  Payload ID: 16673
  Gene Symbol: SQLE
  Gene Name: squalene epoxidase
  ENSP ID: ENSP00000428239
MLEFHFEGEEQPLSMMKKFLKSSWVRIGFVPEEERNVLRRRKGTNISETSLIGTAACTSTSSQNDPEVIIVGAGVLGSALAAVLSRDGRKVTVIERDLKEPDRIVGEFLQPGGYHVLKDLGLGDTVEGLDAQVVNGYMIHDQESKSEVQIPYPLSENNQVQSGRAFHHGRFIMSLRKAAMAEPK

SEQ ID NO: 83781 - protein, 163 aa, Homo sapiens
  Payload ID: 16673
  Gene Symbol: SQLE
  Gene Name: squalene epoxidase
  ENSP ID: ENSP00000429916
RGEMPRNLREYMVEKIYPQIPDHLKEPFLEATDNSHLRSMPASFLPPSSVKKRGVLLLGDAYNMRHPLTGGGMTVAFKDIKLWRKLLKGIPDLYDDAAIFEAKKSFYWARKTSHSFVVNILAQALYELFSATDDSLHQLRKACFLYFKLGGECVAGPVGLLSV

SEQ ID NO: 83782 - protein, 479 aa, Homo sapiens
  Payload ID: 16673
  Gene Symbol: SQLE
  Gene Name: squalene epoxidase
  ENSP ID: ENSP00000430331
MLRRKGTNISETSLIGTAACTSTSSQNDPEVIIVGAGVLGSALAAVLSRDGRKVTVIERDLKEPDRIVGEFLQPGGYHVLKDLGLGDTVEGLDAQVVNGYMIHDQESKSEVQIPYPLSENNQVQSGRAFHHGRFIMSLRKAAMAEPNAKFIEGVVLQLLEEDDVVMGVQYKDKETGDIKELHAPLTVVADGLFSKFRKSLVSNKVSVSSHFVGFLMKNAPQFKANHAELILANPSPVLIYQISSSETRVLVDIRGEMPRNLREYMVEKIYPQIPDHLKEPFLEATDNSHLRSMPASFLPPSSVKKRGVLLLGDAYNMRHPLTGGGMTVAFKDIKLWRKLLKGIPDLYDDAAIFEAKKSFYWARKTSHSFVVNILAQALYELFSATDDSLHQLRKACFLYFKLGGECVAGPVGLLSVLSPNPLVLIGHFFAVAIYAVYFCFKSEPWITKPRALLSSGAVLYKACSVIFPLIYSEMKYMVH

SEQ ID NO: 83783 - protein, 800 aa, Homo sapiens
  Payload ID: 16674
  Gene Symbol: SART1
  Gene Name: squamous cell carcinoma antigen recognized by T cells 1
  Uniprot ID: O43290
  ENSP ID: ENSP00000310448
MGSSKKHRGEKEAAGTTAAAGTGGATEQPPRHREHKKHKHRSGGSGGSGGERRKRSRERGGERGSGRRGAEAEARSSTHGRERSQAEPSERRVKREKRDDGYEAAASSKTSSGDASSLSIEETNKLRAKLGLKPLEVNAIKKEAGTKEEPVTADVINPMALRQREELREKLAAAKEKRLLNQKLGKIKTLGEDDPWLDDTAAWIERSRQLQKEKDLAEKRAKLLEEMDQEFGVSTLVEEEFGQRRQDLYSARDLQGLTVEHAIDSFREGETMILTLKDKGVLQEEEDVLVNVNLVDKERAEKNVELRKKKPDYLPYAEDESVDDLAQQKPRSILSKYDEELEGERPHSFRLEQGGTADGLRERELEEIRAKLRLQAQSLSTVGPRLASEYLTPEEMVTFKKTKRRVKKIRKKEKEVVVRADDLLPLGDQTQDGDFGSRLRGRGRRRVSEVEEEKEPVPQPLPSDDTRVENMDISDEEEGGAPPPGSPQVLEEDEAELELQKQLEKGRRLRQLQQLQQLRDSGEKVVEIVKKLESRQRGWEEDEDPERKGAIVFNATSEFCRTLGEIPTYGLAGNREEQEELMDFERDEERSANGGSESDGEENIGWSTVNLDEEKQQQDFSASSTTILDEEPIVNRGLAAALLLCQNKGLLETTVQKVARVKAPNKSLPSAVYCIEDKMAIDDKYSRREEYRGFTQDFKEKDGYKPDVKIEYVDETGRKLTPKEAFRQLSHRFHGKGSGKMKTERRMKKLDEEALLKKMSSSDTPLGTVALLQEKQKAQKTPYIVLSGSGKSMNANTITK

SEQ ID NO: 83784 - protein, 164 aa, Homo sapiens
  Payload ID: 16674
  Gene Symbol: SART1
  Gene Name: squamous cell carcinoma antigen recognized by T cells 1
  ENSP ID: ENSP00000436218
MGSSKKHRGEKEAAGTTAAAGTGGATEQPPRHREHKKHKHRSGGSGGSGGERRKRSRERGGERGSGRRGAEAEARSSTHGRERSQAEPSERRVKREKRDDGYEAAASSKTSSGDASSLSIEETNKLRAKLGLKPLEVNAIKKAMGGHSLTSGPPFQRRAPRRSP

SEQ ID NO: 83785 - protein, 963 aa, Homo sapiens
  Payload ID: 16675
  Gene Symbol: SART3
  Gene Name: squamous cell carcinoma antigen recognized by T cells 3
  Uniprot ID: Q15020
  ENSP ID: ENSP00000228284
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQLSINVYDYNCHVDLIRLLRLEGELTKVRMARQKMSEIFPLTEELWLEWLHDEISMAQDGLDREHVYDLFEKAVKDYICPNIWLEYGQYSVGGIGQKGGLEKVRSVFERALSSVGLHMTKGLALWEAYREFESAIVEAARLEKVHSLFRRQLAIPLYDMEATFAEYEEWSEDPIPESVIQNYNKALQQLEKYKPYEEALLQAEAPRLAEYQAYIDFEMKIGDPARIQLIFERALVENCLVPDLWIRYSQYLDRQLKVKDLVLSVHNRAIRNCPWTVALWSRYLLAMERHGVDHQVISVTFEKALNAGFIQATDYVEIWQAYLDYLRRRVDFKQDSSKELEELRAAFTRALEYLKQEVEERFNESGDPSCVIMQNWARIEARLCNNMQKARELWDSIMTRGNAKYANMWLEYYNLERAHGDTQHCRKALHRAVQCTSDYPEHVCEVLLTMERTEGSLEDWDIAVQKTETRLARVNEQRMKAAEKEAALVQQEEEKAEQRKRARAEKKALKKKKKIRGPEKRGADEDDEKEWGDDEEEQPSKRRRVENSIPAAGETQNVEVAAGPAGKCAAVDVEPPSKQKEKAASLKRDMPKVLHDSSKDSITVFVSNLPYSMQEPDTKLRPLFEACGEVVQIRPIFSNRGDFRGYCYVEFKEEKSALQALEMDRKSVEGRPMFVSPCVDKSKNPDFKVFRYSTSLEKHKLFISGLPFSCTKEELEEICKAHGTVKDLRLVTNRAGKPKGLAYVEYENESQASQAVMKMDGMTIKENIIKVAISNPPQRKVPEKPETRKAPGGPMLLPQTYGARGKGRTQLSLLPRALQRPSAAAPQAENGPAAAPAVAAPAATEAPKMSNADFAKLFLRK

SEQ ID NO: 83786 - protein, 927 aa, Homo sapiens
  Payload ID: 16675
  Gene Symbol: SART3
  Gene Name: squamous cell carcinoma antigen recognized by T cells 3
  Uniprot ID: Q15020
  ENSP ID: ENSP00000414453
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQLSINVYDYNCHVDLIRLLRLEGELTKVRMARQKMSEIFPLTEELWLEWLHDEISMAQDGLDREHVYDLFEKAVKDYICPNIWLEYGQYSVGGIGQKGGLEKVRSVFERALSSVGLHMTKGLALWEAYREFESAIVEAARLEKVHSLFRRQLAIPLYDMEATFAEYEEWSEDPIPESVIQNYNKALQQLEKYKPYEEALLQAEAPRLAEYQAYIDFEMKIGDPARIQLIFERALVENCLVPDLWIRYSQYLDRQLKVKDLVLSVHNRAIRNCPWTVALWSRYLLAMERHGVDHQVISDSSKELEELRAAFTRALEYLKQEVEERFNESGDPSCVIMQNWARIEARLCNNMQKARELWDSIMTRGNAKYANMWLEYYNLERAHGDTQHCRKALHRAVQCTSDYPEHVCEVLLTMERTEGSLEDWDIAVQKTETRLARVNEQRMKAAEKEAALVQQEEEKAEQRKRARAEKKALKKKKKIRGPEKRGADEDDEKEWGDDEEEQPSKRRRVENSIPAAGETQNVEVAAGPAGKCAAVDVEPPSKQKEKAASLKRDMPKVLHDSSKDSITVFVSNLPYSMQEPDTKLRPLFEACGEVVQIRPIFSNRGDFRGYCYVEFKEEKSALQALEMDRKSVEGRPMFVSPCVDKSKNPDFKVFRYSTSLEKHKLFISGLPFSCTKEELEEICKAHGTVKDLRLVTNRAGKPKGLAYVEYENESQASQAVMKMDGMTIKENIIKVAISNPPQRKVPEKPETRKAPGGPMLLPQTYGARGKGRTQLSLLPRALQRPSAAAPQAENGPAAAPAVAAPAATEAPKMSNADFAKLFLRK

SEQ ID NO: 83787 - protein, 305 aa, Homo sapiens
  Payload ID: 16675
  Gene Symbol: SART3
  Gene Name: squamous cell carcinoma antigen recognized by T cells 3
  ENSP ID: ENSP00000446577
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQLSINVYDYNCHVDLIRLLRLEGELTKVRMARQKMSEIFPLTEELWLEWLHDEISMAQDGLDREHVYDLFEKAVKDYICPNIWLEYGQYSVGGIGQKGGLEKVRSVFERALSSVGLHMTKGLALWEAYREFESAIVEAARLEKVHSLFRRQLAIPLYDMEATFAEYEEWSEDPIPESVIQNYNKALQQLEKYKPYEEALVKK

SEQ ID NO: 83788 - protein, 156 aa, Homo sapiens
  Payload ID: 16675
  Gene Symbol: SART3
  Gene Name: squamous cell carcinoma antigen recognized by T cells 3
  ENSP ID: ENSP00000447324
MARQKMSEIFPLTEELWLEWLHDEISMAQDGLDREHVYDLFEKAVKDYICPNIWLEYGQYSVGGIGQKGGLEKVRSVFERALSSVGLHMTKGLALWEAYREFESAIVEAARLEKVHSLFRRQLAIPLYDMEATFAEYEEWSEDPIPESVIQNYNKA

SEQ ID NO: 83789 - protein, 144 aa, Homo sapiens
  Payload ID: 16675
  Gene Symbol: SART3
  Gene Name: squamous cell carcinoma antigen recognized by T cells 3
  ENSP ID: ENSP00000447875
ALEMDRKSVEGRPMFVSPCVDKSKNPDFKVFRYSTSLEKHKLFISGLPFSCTKEELEEICKAHGTVKDLRLVTNRAGKPKGLAYVEYENESQASQAVMKMDGMTIKENIIKVAISNPPQRKVPEKPETRKAPGGPMLLPQTYGA

SEQ ID NO: 83790 - protein, 129 aa, Homo sapiens
  Payload ID: 16675
  Gene Symbol: SART3
  Gene Name: squamous cell carcinoma antigen recognized by T cells 3
  Uniprot ID: Q15020
  ENSP ID: ENSP00000448554
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQVGPGVGSGHLPVFQVLGSPCPGPPP

SEQ ID NO: 83791 - protein, 771 aa, Homo sapiens
  Payload ID: 16675
  Gene Symbol: SART3
  Gene Name: squamous cell carcinoma antigen recognized by T cells 3
  ENSP ID: ENSP00000449386
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQLSINVYDYNCHVDLIRLLRLEGELTKVRMARQKMSEIFPLTEELWLEWLHDEISMAQDGLDREHVYDLFEKAVKDYICPNIWLEYGQYSVGGIGQKGGLEKVRSVFERALSSVGLHMTKGLALWEAYREFESAIVEAARPVAGFLSPFDREQTFDSQLEKVHSLFRRQLAIPLYDMEATFAEYEEWSEDPIPESVIQNYNKALQQLEKYKPYEEALLQAEAPRLAEYQAYIDFEMKIGDPARIQLIFERALVENCLVPDLWIRYSQYLDRQLKVKDLVLSVHNRAIRNCPWTVALWSRYLLAMERHGVDHQVISVTFEKALNAGFIQATDYVEIWQAYLDYLRRRVDFKQDSSKELEELRAAFTRALEYLKQEVEERFNESGDPSCVIMQNWARIEARLCNNMQKARELWDSIMTRGNAKYANMWLEYYNLERAHGDTQHCRKALHRAVQCTSDYPEHVCEVLLTMERTEGSLEDWDIAVQKTETRLARVNEQRMKAAEKEAALVQQEEEKAEQRKRARAEKKALKKKKKIRGPEKRGADEDDEKEWGDDEEEQPSKRRRVENSIPAAGETQNVEVAAGPAGKCAAVDVEPPSKQKEKAASLKRDMPKVLHDSSKDSITVFVSNLPYSMQEPDTKLRPLFEACGEVVQIRPIFSNRGDFRGYCYVEF

SEQ ID NO: 83792 - protein, 111 aa, Homo sapiens
  Payload ID: 16675
  Gene Symbol: SART3
  Gene Name: squamous cell carcinoma antigen recognized by T cells 3
  ENSP ID: ENSP00000449602
MARQKMSEIFPLTEELWLEWLHDEISMAQDGLDREHVYDLFEKAVKDYICPNIWLEYGQYSVGGIGQKGGLEKVRSVFERALSSVGLHMTKGLALWEAYREFESAIVEAAR

SEQ ID NO: 83793 - protein, 364 aa, Homo sapiens
  Payload ID: 16675
  Gene Symbol: SART3
  Gene Name: squamous cell carcinoma antigen recognized by T cells 3
  Uniprot ID: Q15020
  ENSP ID: ENSP00000449743
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQLSINVYDYNCHVDLIRLLRLEGELTKVRMARQKMSEIFPLTEELWLEWLHDEISMAQDGLDREHVYDLFEKAVKDYICPNIWLEYGQYSVGGIGQKGGLEKVRSVFERALSSVGLHMTKGLALWEAYREFESAIVEAARLEKVHSLFRRQLAIPLYDMEATFAEYEEWSEDPIPESVIQNYNKALQQLEKYKPYEEALLQAEAPRLAEYQAYIDFEMKIGDPARIQLIFERALVENCLVPDLWIRYRSTTESKGFGFICT

SEQ ID NO: 83794 - protein, 107 aa, Homo sapiens
  Payload ID: 16676
  Gene Symbol: SLIRP
  Gene Name: SRA stem-loop interacting RNA binding protein
  Uniprot ID: Q9GZT3
  ENSP ID: ENSP00000238688
MAASAARGAAALRRSINQPVAFVRRIPWTAASSQLKEHFAQFGHVRRCILPFDKETGFHRGLGWVQFSSEEGLRNALQQENHIIDGVKVHTRRPKLPQTSDDEKKDF

SEQ ID NO: 83795 - protein, 56 aa, Homo sapiens
  Payload ID: 16676
  Gene Symbol: SLIRP
  Gene Name: SRA stem-loop interacting RNA binding protein
  ENSP ID: ENSP00000450587
VRRIPWTAASSQLKEHFAQFGHVRRTRRLAFTEVWVGFSFLQKKDFGMHYNRKIIL

SEQ ID NO: 83796 - protein, 96 aa, Homo sapiens
  Payload ID: 16676
  Gene Symbol: SLIRP
  Gene Name: SRA stem-loop interacting RNA binding protein
  ENSP ID: ENSP00000450770
  MOD_RES (1)..(1): Any amino acid
XSAARGAAALRRSINQPVAFVRRIPWTAASSQLKEHFAQFGHVRRCILPFDKETGFHRGLGWVQFSSEEGLRNALQQENHIIDGVKVNLFLCQIHT

SEQ ID NO: 83797 - protein, 124 aa, Homo sapiens
  Payload ID: 16676
  Gene Symbol: SLIRP
  Gene Name: SRA stem-loop interacting RNA binding protein
  ENSP ID: ENSP00000450849
MAASAARGAAALRRSINQPVAFVRRIPWTAASSQLKEHFAQFGHVRRCILPFDKETGFHRGLGWVQFSSEEGLRNALQQENHIIDGVKESLFRDTQWTAKGERPPQANGRKAAQSQPARFTPPK

SEQ ID NO: 83798 - protein, 109 aa, Homo sapiens
  Payload ID: 16676
  Gene Symbol: SLIRP
  Gene Name: SRA stem-loop interacting RNA binding protein
  Uniprot ID: Q9GZT3
  ENSP ID: ENSP00000450909
MAASAARGAAALRRSINQPVAFVRRIPWTAASSQLKEHFAQFGHVRRCILPFDKETGFHRGLGWVQFSSEEGLRNALQQENHIIDGVKVQVHTRRPKLPQTSDDEKKDF

SEQ ID NO: 83799 - protein, 40 aa, Homo sapiens
  Payload ID: 16676
  Gene Symbol: SLIRP
  Gene Name: SRA stem-loop interacting RNA binding protein
  ENSP ID: ENSP00000451606
  MOD_RES (1)..(1): Any amino acid
XAASAARGAAALRRSINQPVAFVRRIPWTAASRIIVHIAQ

SEQ ID NO: 83800 - protein, 98 aa, Homo sapiens
  Payload ID: 16676
  Gene Symbol: SLIRP
  Gene Name: SRA stem-loop interacting RNA binding protein
  ENSP ID: ENSP00000452057
MAASAARGAAALRRSINQPVAFVRRIPWTAASSQLKEHFAQFGHVRRCILPFDKETGFHRGLGWVQFSSEEGLRNALQQENHIIDGVKCLKSQPTIRS

SEQ ID NO: 83801 - protein, 72 aa, Homo sapiens
  Payload ID: 16676
  Gene Symbol: SLIRP
  Gene Name: SRA stem-loop interacting RNA binding protein
  ENSP ID: ENSP00000452162
NQPVAFVRRIPWTAASSQLKEHFAQFGHVRRCILPFESLFRDTQWTAKGERPPQANGRKAAQSQPARFTPPK

SEQ ID NO: 83802 - protein, 76 aa, Homo sapiens
  Payload ID: 16676
  Gene Symbol: SLIRP
  Gene Name: SRA stem-loop interacting RNA binding protein
  ENSP ID: ENSP00000452329
NQPVAFVRRIPWTAASSQLKEHFAQFGHVRRCILPFDKETGFHRGLGWVQFSSEEGLRNALQQENHIIDGVKSMVS

SEQ ID NO: 83803 - protein, 92 aa, Homo sapiens
  Payload ID: 16676
  Gene Symbol: SLIRP
  Gene Name: SRA stem-loop interacting RNA binding protein
  ENSP ID: ENSP00000478794
MAASAARGAAALRRSINQPVAFVRRIPWTAASSQLKEHFAQFGHVRRCILPFDKETGFHRGLGWVQFSSEEGLRNALQQENHIIDGVKCLFF

SEQ ID NO: 83804 - protein, 509 aa, Homo sapiens
  Payload ID: 16677
  Gene Symbol: SHB
  Gene Name: Src homology 2 domain containing adaptor protein B
  Uniprot ID: Q15464
  ENSP ID: ENSP00000366936
MAKWLNKYFSLGNSKTKSPPQPPRPDYREQRRRGERPSQPPQAVPQASSAASASCGPATASCFSASSGSLPDDSGSTSDLIRAYRAQKERDFEDPYNGPGSSLRKLRAMCRLDYCGGSGEPGGVQRAFSASSASGAAGCCCASSGAGAAASSSSSSGSPHLYRSSSERRPATPAEVRYISPKHRLIKVESAAGGGAGDPLGGACAGGRTWSPTACGGKKLLNKCAASAAEESGAGKKDKVTIADDYSDPFDAKNDLKSKAGKGESAGYMEPYEAQRIMTEFQRQESVRSQHKGIQLYDTPYEPEGQSVDSDSESTVSPRLRESKLPQDDDRPADEYDQPWEWNRVTIPALAAQFNGNEKRQSSPSPSRDRRRQLRAPGGGFKPIKHGSPEFCGILGERVDPAVPLEKQIWYHGAISRGDAENLLRLCKECSYLVRNSQTSKHDYSLSLRSNQGFMHMKLAKTKEKYVLGQNSPPFDSVPEVIHYYTTRKLPIKGAEHLSLLYPVAVRTL

SEQ ID NO: 83805 - protein, 495 aa, Homo sapiens
  Payload ID: 16678
  Gene Symbol: SHE
  Gene Name: Src homology 2 domain containing E
  Uniprot ID: Q5VZ18
  ENSP ID: ENSP00000307369
MQWSPTPGASACLGWASSLACSTAPTLLGRAGRGPLMAAKWFKEFPLNLKTVSERAKPGGGGGKLRKNSEAGGAGPGPGKGRKNSAAELGSGRAGVGPKDSRLSRDSLQGLIQAAAGKGRKNSRATEEEPHRGATKSSGCSTYINRLIKVDTQEKNGKSNYPSSSSSSSSSSSSASSSPSSLGPELDKGKIIKQQETVIILEDYADPYDAKRTKGQRDAERVGENDGYMEPYDAQQMITEIRRRGSKDPLVKALQLLDSPCEPADGGLKSETLAKRRSSKDLLGKPPQLYDTPYEPAEGGPRAEGKARPPDSRLPENDERPAAEYEQPWEWKKEQIVRALSVQFEGAERPSFREETVRQHHRQKSWTQKILKPALSDHSEGEKVDPGLPLEKQPWYHGAISRAEAESRLQPCKEAGYLVRNSESGNSRYSIALKTSQGCVHIIVAQTKDNKYTLNQTSAVFDSIPEVVHYYSNEKLPFKGAEHMTLLYPVHSKLH

SEQ ID NO: 83806 - protein, 132 aa, Homo sapiens
  Payload ID: 16678
  Gene Symbol: SHE
  Gene Name: Src homology 2 domain containing E
  ENSP ID: ENSP00000451961
  MOD_RES (1)..(1): Any amino acid
XEGKARPPDSRLPENDERPAAEYEQPWEWKKEQIVRALSVQFEGAERPSFREETVRQHHRQKSWTQKILKPALSDHSEGEKVDPGLPLEKQPWYHGAISRAEAESRLQPCKEAGYLVRNSESGNSRYSIALK

SEQ ID NO: 83807 - protein, 41 aa, Homo sapiens
  Payload ID: 16678
  Gene Symbol: SHE
  Gene Name: Src homology 2 domain containing E
  ENSP ID: ENSP00000452008
  MOD_RES (1)..(1): Any amino acid
XSRAEAESRLQPCKEAGYLVRNSESGNSRYSIALKNHHLLS

SEQ ID NO: 83808 - protein, 423 aa, Homo sapiens
  Payload ID: 16679
  Gene Symbol: SHF
  Gene Name: Src homology 2 domain containing F
  Uniprot ID: Q7M4L6
  ENSP ID: ENSP00000290894
MQQEGGPVRSAPCRTGTLEGSRQGSPGHRKRASPKGSLSSAQPHSWMLTPSPLNSHCAHREPISSSPQPVANGPKQKKKSNWRSTTRLRIIRLRDRLEPRPLAILEDYADPFDVQETGEGSAGASGAPEKVPENDGYMEPYEAQKMMAEIRGSKETATQPLPLYDTPYEPEEDGATAEGEGAPWPRESRLPEDDERPPEEYDQPWEWKKERISKAFAVDIKVIKDLPWPPPVGQLDSSPSLPDGDRDISGPASPLPEPSLEDSSAQFEGPEKSCLSPGREEKGRLPPRLSAGNPKSAKPLSMEPSSPLGEWTDPALPLENQVWYHGAISRTDAENLLRLCKEASYLVRNSETSKNDFSLSLKSSQGFMHMKLSRTKEHKYVLGQNSPPFSSVPEIVHHYASRKLPIKGAEHMSLLYPVAIRTL

SEQ ID NO: 83809 - protein, 239 aa, Homo sapiens
  Payload ID: 16679
  Gene Symbol: SHF
  Gene Name: Src homology 2 domain containing F
  ENSP ID: ENSP00000411530
MEPYEAQKMMAEIRGSKETATQPLPLYDTPYEPEEDGATAEGEGAPWPRESRLPEDDERPPEEYDQPWEWKKERISKAFAAQFEGPEKSCLSPGREEKGRLPPRLSAGNPKSAKPLSMEPSSPLGEWTDPALPLENQVWYHGAISRTDAENLLRLCKEASYLVRNSETSKNDFSLSLKSSQGFMHMKLSRTKEHKYVLGQNSPPFSSVPEIVHHYASRKLPIKGAEHMSLLYPVAIRTL

SEQ ID NO: 83810 - protein, 199 aa, Homo sapiens
  Payload ID: 16679
  Gene Symbol: SHF
  Gene Name: Src homology 2 domain containing F
  ENSP ID: ENSP00000452726
  MOD_RES (1)..(1): Any amino acid
XGEGSAGASGAPEKVPENDGYMEPYEAQKMMAEIRGSKETATQPLPLYDTPYEPEEDGATAEGEGAPWPRESRLPEDDERPPEEYDQPWEWKKERISKAFAAQFEGPEKSCLSPGREEKGRLPPRLSAGNPKSAKPLSMEPSSPLGEWTDPALPLENQVWYHGAISRTDAENLLRLCKEASYLVRNSETSKNDFSLSLK

SEQ ID NO: 83811 - protein, 290 aa, Homo sapiens
  Payload ID: 16679
  Gene Symbol: SHF
  Gene Name: Src homology 2 domain containing F
  ENSP ID: ENSP00000453168
MLLSGAPPAGSRPGPRTQGSAGGGPGGSRRGAGGAGAGPGGGGSGGVAKWLREHLGFRGGGGGGGGSKPAPPEPDYRPPAPSPAAPPAPPPDILAAYRLQRERDFEDPYSGGSSGSAALATPVAPGPTPPPRHGSPPHRLIRVETPGPPAPPADERISGPPASSDRLAILEDYADPFDVQETGEGSAGASGAPEKVPENDGYMEPYEAQKMMAEIRGSKETATQPLPLYDTPYEPEEDGATAEGEGAPWPRESRLPEDDERPPEEYDQPWEWKKERISKAFAGAARDSCT

SEQ ID NO: 83812 - protein, 414 aa, Homo sapiens
  Payload ID: 16679
  Gene Symbol: SHF
  Gene Name: Src homology 2 domain containing F
  ENSP ID: ENSP00000453260
MLLSGAPPAGSRPGPRTQGSAGGGPGGSRRGAGGAGAGPGGGGSGGVAKWLREHLGFRGGGGGGGGSKPAPPEPDYRPPAPSPAAPPAPPPDILAAYRLQRERDFEDPYSGGSSGSAALATPVAPGPTPPPRHGSPPHRLIRVETPGPPAPPADERISGPPASSDRLAILEDYADPFDVQETGEGSAGASGAPEKVPENDGYMEPYEAQKMMAEIRGSKETATQPLPLYDTPYEPEEDGATAEGEGAPWPRESRLPEDDERPPEEYDQPWEWKKERISKAFAVDIKVIKDLPWPPPVGQLDSSPSLPDGDRDISGPASPLPEPSLEDSSAQFEGPEKSCLSPGREEKGRLPPRLSAGNPKSAKPLSMEPSSPLGEWTDPALPLENQLVSRGHQPNRRREPAPAVQRGQLPGAQQ

SEQ ID NO: 83813 - protein, 367 aa, Homo sapiens
  Payload ID: 16679
  Gene Symbol: SHF
  Gene Name: Src homology 2 domain containing F
  ENSP ID: ENSP00000453370
MLLSGAPPAGSRPGPRTQGSAGGGPGGSRRGAGGAGAGPGGGGSGGVAKWLREHLGFRGGGGGGGGSKPAPPEPDYRPPAPSPAAPPAPPPDILAAYRLQRERDFEDPYSGGSSGSAALATPVAPGPTPPPRHGSPPHRLIRVETPGPPAPPADERISGPPASSDRLAILEDYADPFDVQETGEGSAGASGAPEKVPENDGYMEPYEAQKMMAEIRGSKETATQPLPLYDTPYEPEEDGATAEGEGAPWPRESRLPEDDERPPEEYDQPWEWKKERISKAFAAQFEGPEKSCLSPGREEKGRLPPRLSAGNPKSAKPLSMEPSSPLGEWTDPALPLENQLVSRGHQPNRRREPAPAVQRGQLPGAQQ

SEQ ID NO: 83814 - protein, 161 aa, Homo sapiens
  Payload ID: 16679
  Gene Symbol: SHF
  Gene Name: Src homology 2 domain containing F
  ENSP ID: ENSP00000453676
  MOD_RES (1)..(1): Any amino acid
XSPSLPDGDRDISGPASPLPEPSLEDSSAQFEGPEKSCLSPGREEKGRLPPRLSAGNPKSAKPLSMEPSSPLGEWTDPALPLENQVWYHGAISRTDAENLLRLCKEASYLLSYSRSLNCKIKEAFPRKVFVKNLIYITSEMCIALKIIKFMEHTKQPVYHF

SEQ ID NO: 83815 - protein, 146 aa, Homo sapiens
  Payload ID: 16679
  Gene Symbol: SHF
  Gene Name: Src homology 2 domain containing F
  ENSP ID: ENSP00000453827
  MOD_RES (1)..(1): Any amino acid
XDQPWEWKKERISKAFAVDIKVIKDLPWPPPVGQLDSSPSLPDGDRDISGPASPLPEPSLEDSSAQFEGPEKSCLSPGREEKGRLPPRLSAGNPKSAKPLSMEPSSPLGEWTDPALPLENQVGHPQWVGLDSEGPSRDAPLPLSHP

SEQ ID NO: 83816 - protein, 26 aa, Homo sapiens
  Payload ID: 16679
  Gene Symbol: SHF
  Gene Name: Src homology 2 domain containing F
  ENSP ID: ENSP00000453986
MEPYEAQKMMAEIRGSKETATQPLPL

SEQ ID NO: 83817 - protein, 163 aa, Homo sapiens
  Payload ID: 16679
  Gene Symbol: SHF
  Gene Name: Src homology 2 domain containing F
  ENSP ID: ENSP00000454034
  MOD_RES (1)..(1): Any amino acid
XPWPRESRLPEDDERPPEEYDQPWEWKKERISKAFAGDTHNGWAWTARDPAEMPPFLSLILSWYHGAISRTDAENLLRLCKEASYLVRNSETSKNDFSLSLKSSQGFMHMKLSRTKEHKYVLGQNSPPFSSVPEIVHHYASRKLPIKGAEHMSLLYPVAIRTL

SEQ ID NO: 83818 - protein, 340 aa, Homo sapiens
  Payload ID: 16680
  Gene Symbol: SHD
  Gene Name: Src homology 2 domain containing transforming protein D
  Uniprot ID: Q96IW2
  ENSP ID: ENSP00000446058
MAKWLRDYLSFGGRRPPPQPPTPDYTESDILRAYRAQKNLDFEDPYEDAESRLEPDPAGPGDSKNPGDAKYGSPKHRLIKVEAADMARAKALLGGPGEELEADTEYLDPFDAQPHPAPPDDGYMEPYDAQWVMSELPGRGVQLYDTPYEEQDPETADGPPSGQKPRQSRMPQEDERPADEYDQPWEWKKDHISRAFAVQFDSPEWERTPGSAKELRRPPPRSPQPAERVDPALPLEKQPWFHGPLNRADAESLLSLCKEGSYLVRLSETNPQDCSLSLRSSQGFLHLKFARTRENQVVLGQHSGPFPSVPELVLHYSSRPLPVQGAEHLALLYPVVTQTP

SEQ ID NO: 83819 - protein, 300 aa, Homo sapiens
  Payload ID: 16680
  Gene Symbol: SHD
  Gene Name: Src homology 2 domain containing transforming protein D
  ENSP ID: ENSP00000470181
MAKWLRDYLSFGGRRPPPQPPTPDYTESDILRAYRAQKNLDFEDPYEDAESRLEPDPAGPGDSKNPGDAKYGSPKHRLIKVEAADMARAKALLGGPGEELEADTEYLDPFDAQPHPAPPDDGYMEPYDAQWVMSELPGRGVQLYDTPYEEQDPETADGPPSGQKPRQSRMPQEDERPADEYDQPWEWKKDHISRAFAVQFDSPEWERTPGSAKELRRPPPRSPQPAERVDPALPLEKQPSSQGFLHLKFARTRENQVVLGQHSGPFPSVPELVLHYSSRPLPVQGAEHLALLYPVVTQTP

SEQ ID NO: 83820 - protein, 38 aa, Homo sapiens
  Payload ID: 16680
  Gene Symbol: SHD
  Gene Name: Src homology 2 domain containing transforming protein D
  ENSP ID: ENSP00000472139
DTPYEEQDPETADGPPSGQKPRQSRMPQEDERPADDAV

SEQ ID NO: 83821 - protein, 359 aa, Homo sapiens
  Payload ID: 16681
  Gene Symbol: SKAP1
  Gene Name: src kinase associated phosphoprotein 1
  Uniprot ID: Q86WV1
  ENSP ID: ENSP00000338171
MQAAALPEEIRWLLEDAEEFLAEGLRNENLSAVARDHRDHILRGFQQIKARYYWDFQPQGGDIGQDSSDDNHSGTLGLSLTSDAPFLSDYQDEGMEDIVKGAQELDNVIKQGYLEKKSKDHSFFGSEWQKRWCVVSRGLFYYYANEKSKQPKGTFLIKGYGVRMAPHLRRDSKKESCFELTSQDRRSYEFTATSPAEARDWVDQISFLLKDLSSLTIPYEEDEEEEEKEETYDDIDGFDSPSCGSQCRPTILPGSVGIKEPTEEKEEEDIYEVLPDEEHDLEEDESGTRRKGVDYASYYQGLWDCHGDQPDELSFQRGDLIRILSKEYNMYGWWVGELNSLVGIVPKEYLTTAFEVEER

SEQ ID NO: 83822 - protein, 92 aa, Homo sapiens
  Payload ID: 16681
  Gene Symbol: SKAP1
  Gene Name: src kinase associated phosphoprotein 1
  ENSP ID: ENSP00000462360
  MOD_RES (1)..(1): Any amino acid
XGDIGQDSSDDNHSGTLGLSLTSDAPFLSDYQDEGMEDIVKGAQELDNVIKQGYLEKKSKDHSFFGSEWQKRWCVVSRGLFYYYANEKIYSY

SEQ ID NO: 83823 - protein, 38 aa, Homo sapiens
  Payload ID: 16681
  Gene Symbol: SKAP1
  Gene Name: src kinase associated phosphoprotein 1
  ENSP ID: ENSP00000462437
GTLGLSLTSDAPFLSDYQDEVETGFHRVSQDGLDLLTS

SEQ ID NO: 83824 - protein, 103 aa, Homo sapiens
  Payload ID: 16681
  Gene Symbol: SKAP1
  Gene Name: src kinase associated phosphoprotein 1
  ENSP ID: ENSP00000463284
MQAAALPEEIRWLLEDAEEFLAEGLRNENLSAVARDHRDHILRGFQQIKARYYWDFQPQGGDIGQDSSDDNHSGTLGLSLTSDAPFLSDYQDEGILRRMNRRV

SEQ ID NO: 83825 - protein, 99 aa, Homo sapiens
  Payload ID: 16681
  Gene Symbol: SKAP1
  Gene Name: src kinase associated phosphoprotein 1
  ENSP ID: ENSP00000464198
MAPHLRRDSKKESCFELTSQDRRSYEFTATSPAEARDWVDQISFLLKDLSSLTIPYEEDEEEEEKEETYDDIDGFDSPSCGSQCRPTILPGSVGIKEPT

SEQ ID NO: 83826 - protein, 359 aa, Homo sapiens; identical to SEQ ID NO: 83821
  Payload ID: 16681
  Gene Symbol: SKAP1
  Gene Name: src kinase associated phosphoprotein 1
  Uniprot ID: Q86WV1
  ENSP ID: ENSP00000464311

SEQ ID NO: 83827 - protein, 32 aa, Homo sapiens
  Payload ID: 16681
  Gene Symbol: SKAP1
  Gene Name: src kinase associated phosphoprotein 1
  ENSP ID: ENSP00000464509
YNMYGWWVGELNSLVGIVPKEYLTTAFEVEER

SEQ ID NO: 83828 - protein, 359 aa, Homo sapiens
  Payload ID: 16682
  Gene Symbol: SKAP2
  Gene Name: src kinase associated phosphoprotein 2
  Uniprot ID: O75563
  ENSP ID: ENSP00000005587
MPNPSSTSSPYPLPEEIRNLLADVETFVADILKGENLSKKAKEKRESLIKKIKDVKSIYLQEFQDKGDAEDGEEYDDPFAGPPDTISLASERYDKDDEAPSDGAQFPPIAAQDLPFVLKAGYLEKRRKDHSFLGFEWQKRWCALSKTVFYYYGSDKDKQQKGEFAIDGYSVRMNNTLRKDGKKDCCFEISAPDKRIYQFTAASPKDAEEWVQQLKFVLQDMESDIIPEDYDERGELYDDVDHPLPISNPLTSSQPIDDEIYEELPEEEEDSAPVKVEEQRKMSQDSVHHTSGDKSTDYANFYQGLWDCTGAFSDELSFKRGDVIYILSKEYNRYGWWVGEMKGAIGLVPKAYIMEMYDI

SEQ ID NO: 83829 - protein, 126 aa, Homo sapiens
  Payload ID: 16682
  Gene Symbol: SKAP2
  Gene Name: src kinase associated phosphoprotein 2
  ENSP ID: ENSP00000408163
MTTRSVLDVETFVADILKGENLSKKAKEKRESLIKKIKDVKSIYLQEFQDKGDAEDGEEYDDPFAGPPDTISLASERYDKDDEAPSDGAQFPPIAAQDLPFVLKAGYLEKRRKDHSFLGFEWQKRW

SEQ ID NO: 83830 - protein, 306 aa, Homo sapiens
  Payload ID: 16683
  Gene Symbol: SRCIN1
  Gene Name: SRC kinase signaling inhibitor 1
  ENSP ID: ENSP00000477811
  MOD_RES (1)..(1): Any amino acid
XSEELEVQKPQVKLRRAVSEVARPASTPPIMASAIKDEDDEDRIIAELEVFERSSVSSLPPTPRRQLIPTLLSPQDLGPPGGSAPGPTRKAAPGPRAFCVPRIILTECAPNPPSPPEARLEELGPRTAPTPRPQTLADSTRGWDGPQSPPGVVGETSGPRSSFMPRKEGAALKRLGGGGSSLEDGGARVQCPQGPAQDGTPETSTADTYPEEILKDSGHDAQTCSREHQGQAAANSGRTTWGATAQQMDSLEETLRELEATLSNMGTGPAMGSPGSPPPLPLRPQVAARFSSSSAAFLLHFQSQTE

SEQ ID NO: 83831 - protein, 473 aa, Homo sapiens
  Payload ID: 16683
  Gene Symbol: SRCIN1
  Gene Name: SRC kinase signaling inhibitor 1
  ENSP ID: ENSP00000478342
MQPWQCLRRFALAWWERTAEGRARSPREEAGPRDPGGRGEPDPERSSPPMLSADDAEYPREYRTLGGGGGGGSGGRRFSNVGLVHTSERRHTVIAAQSLEALSGLQKADADRKRDAFMDHLKSKYPQHALALRGQQDRMREQVGGWTVDPVCLLSSLCSHLHGDSAPSGAGQPAQTRSSRHTQGAQPGLADQAAKLSYASAESLETMSEAELPLGFSRMNRFRQSLPLSRSASQTKLRSPGVLFLQFGEETRRVHITHEVSSLDTLHALIAHMFPQKLTMGMLKSPNTAILIKDEARNVFYELEDVRDIQDRSIIKIYRKEPLYAAFPGSHLTNGDLRREMVYASRESSPTRRLNNLSPAPHLASGSPPPGLPSGLPSGLQSGSPSRSRLSYAGGRPPSYAGSPVHHAAERLGGAPAAQGVSPSPSAILERRDVKPDEDLASKAGGMVLVKGEGLYADPYGLLHEGRLSLAAA

SEQ ID NO: 83832 - protein, 928 aa, Homo sapiens
  Payload ID: 16683
  Gene Symbol: SRCIN1
  Gene Name: SRC kinase signaling inhibitor 1
  ENSP ID: ENSP00000479718
  MOD_RES (1)..(1): Any amino acid
XFPQKLTMGMLKSPNTAILIKDEARNVFYELEDVRDIQDRSIIKIYRKEPLYAAFPGSHLTNGDLRREMVYASRESSPTRRLNNLSPAPHLASGSPPPGLPSGLPSGLQSGSPSRSRLSYAGGRPPSYAGSPVHHAAERLGGAPAAQGVSPSPSAILERRDVKPDEDLASKAGGMVLVKGEGLYADPYGLLHEGRLSLAAAAGDPFAYPGAGGLYKRGSVRSLSTYSAAALQSDLEDSLYKAAGGGGPLYGDGYGFRLPPSSPQKLADVAAPPGGPPPPHSPYSGPPSRGSPVRQSFRKDSGSSSVFAESPGGKTRSAGSASTAGAPPSELFPGPGERSLVGFGPPVPAKDTETRERMEAMEKQIASLTGLVQSALLRGSEPETPSEKIEGSNGAATPSAPCGSGGRSSGATPVSGPPPPSASSTPAGQPTAVSRLQMQLHLRGLQNSASDLRGQLQQLRKLQLQNQESVRALLKRTEAELSMRVSEAARRQEDPLQRQRTLVEEERLRYLNDEELITQQLNDLEKSVEKIQRDVSHNHRLVPGPELEEKALVLKQLGETLTELKAHFPGLQSKMRVVLRVEVEAVKFLKEEPQRLDGLLKRCRGVTDTLAQIRRQVDEGVWPPPNNLLSQSPKKVTAETDFNKSVDFEMPPPSPPLNLHELSGPAEGASLTPKGGNPTKGLDTPGKRSVDKAVSVEAAERDWEEKRAALTQYSAKDINRLLEETQAELLKAIPDLDCASKAHPGPAPTPDHKPPKAPHGQKAAPRTEPSGRRGSDELTVPRYRTEKPSKSPPPPPPRRSFPSSHGLTTTRTGEVVVTSKKDSAFIKKAESEELEVQKPQVKLRRAVSEVARPASTPPIMASAIKDEDDEDRIIAELESGGGSVPPMKVVTPGASRLKAAQGQAGSPDKSKHGKQRAEYMRIQAQQQV

SEQ ID NO: 83833 - protein, 1183 aa, Homo sapiens
  Payload ID: 16683
  Gene Symbol: SRCIN1
  Gene Name: SRC kinase signaling inhibitor 1
  Uniprot ID: Q9C0H9
  ENSP ID: ENSP00000480869
MGNAPSQDPERSSPPMLSADDAEYPREYRTLGGGGGGGSGGRRFSNVGLVHTSERRHTVIAAQSLEALSGLQKADADRKRDAFMDHLKSKYPQHALALRGQQDRMREQPNYWSFKTRSSRHTQGAQPGLADQAAKLSYASAESLETMSEAELPLGFSRMNRFRQSLPLSRSASQTKLRSPGVLFLQFGEETRRVHITHEVSSLDTLHALIAHMFPQKLTMGMLKSPNTAILIKDEARNVFYELEDVRDIQDRSIIKIYRKEPLYAAFPGSHLTNGDLRREMVYASRESSPTRRLNNLSPAPHLASGSPPPGLPSGLPSGLQSGSPSRSRLSYAGGRPPSYAGSPVHHAAERLGGAPAAQGVSPSPSAILERRDVKPDEDLASKAGGMVLVKGEGLYADPYGLLHEGRLSLAAAAGDPFAYPGAGGLYKRGSVRSLSTYSAAALQSDLEDSLYKAAGGGGPLYGDGYGFRLPPSSPQKLADVAAPPGGPPPPHSPYSGPPSRGSPVRQSFRKDSGSSSVFAESPGGKTRSAGSASTAGAPPSELFPGPGERSLVGFGPPVPAKDTETRERMEAMEKQIASLTGLVQSALLRGSEPETPSEKIEGSNGAATPSAPCGSGGRSSGATPVSGPPPPSASSTPAGQPTAVSRLQMQLHLRGLQNSASDLRGQLQQLRKLQLQNQESVRALLKRTEAELSMRVSEAARRQEDPLQRQRTLVEEERLRYLNDEELITQQLNDLEKSVEKIQRDVSHNHRLVPGPELEEKALVLKQLGETLTELKAHFPGLQSKMRVVLRVEVEAVKFLKEEPQRLDGLLKRCRGVTDTLAQIRRQVDEGVWPPPNNLLSQSPKKVTAETDFNKSVDFEMPPPSPPLNLHELSGPAEGASLTPKGGNPTKGLDTPGKRSVDKAVSVEAAERDWEEKRAALTQYSAKDINRLLEETQAELLKAIPDLDCASKAHPGPAPTPDHKPPKAPHGQKAAPRTEPSGRRGSDELTVPRYRTEKPSKSPPPPPPRRSFPSSHGLTTTRTGEVVVTSKKDSAFIKKAESEELEVQKPQVKLRRAVSEVARPASTPPIMASAIKDEDDEDRIIAELESGGGSVPPMKVVTPGASRLKAAQGQAGSPDKSKHGKQRAEYMRIQAQQQATKPSKEMSGSNETSSPVSEKPSASRTSIPVLTSFGARNSSISF

SEQ ID NO: 83834 - protein, 1217 aa, Homo sapiens
  Payload ID: 16683
  Gene Symbol: SRCIN1
  Gene Name: SRC kinase signaling inhibitor 1
  ENSP ID: ENSP00000483931
MGNAPSQDPERSSPPMLSADDAEYPREYRTLGGGGGGGSGGRRFSNVGLVHTSERRHTVIAAQSLEALSGLQKADADRKRDAFMDHLKSKYPQHALALRGQQDRMREQVGGWTVDPVCLLSSLCSHLHGDSAPSGAGQPAQQPNYWSFKTRSSRHTQGAQPGLADQAAKLSYASAESLETMSEAELPLGFSRMNRFRQSLPLSRSASQTKLRSPGVLFLQFGEETRRVHITHEVSSLDTLHALIAHMFPQKLTMGMLKSPNTAILIKDEARNVFYELEDVRDIQDRSIIKIYRKEPLYAAFPGSHLTNGDLRREMVYASRESSPTRRLNNLSPAPHLASGSPPPGLPSGLPSGLQSGSPSRSRLSYAGGRPPSYAGSPVHHAAERLGGAPAAQGVSPSPSAILERRDVKPDEDLASKAGGMVLVKGEGLYADPYGLLHEGRLSLAAAAGDPFAYPGAGGLYKRGSVRSLSTYSAAALQSDLEDSLYKAAGGGGPLYGDGYGFRLPPSSPQKLADVAAPPGGPPPPHSPYSGPPSRGSPVRQSFRKDSGSSSVFAESPGGKTRSAGSASTAGAPPSELFPGPGERSLVGFGPPVPAKDTETRERMEAMEKQIASLTGLVQSALLRGSEPETPSEKIEGSNGAATPSAPCGSGGRSSGATPVSGPPPPSASSTPAGQPTAVSRLQMQLHLRGLQNSASDLRGQLQQLRKLQLQNQESVRALLKRTEAELSMRVSEAARRQEDPLQRQRTLVEEERLRYLNDEELITQQLNDLEKSVEKIQRDVSHNHRLVPGPELEEKALVLKQLGETLTELKAHFPGLQSKMRVVLRVEVEAVKFLKEEPQRLDGLLKRCRGVTDTLAQIRRQVDEGVWPPPNNLLSQSPKKVTAETDFNKSVDFEMPPPSPPLNLHELSGPAEGASLTPKGGNPTKGLDTPGKRSVDKAVSVEAAERDWEEKRAALTQYSAKDINRLLEETQAELLKAIPDLDCASKAHPGPAPTPDHKPPKAPHGQKAAPRTEPSGRRGSDELTVPRYRTEKPSKSPPPPPPRRSFPSSHGLTTTRTGEVVVTSKKDSAFIKKAESEELEVQKPQVKLRRAVSEVARPASTPPIMASAIKDEDDEDRIIAELESGGGSVPPMKVVTPGASRLKAAQGQAGSPDKSKHGKQRAEYMRIQAQQQATKPSKEMSGSNETSSPVSEKPSASRTSIPVLTSFGARNSSISF

SEQ ID NO: 83835 - protein, 1183 aa, Homo sapiens; identical to SEQ ID NO: 83833
  Payload ID: 16683
  Gene Symbol: SRCIN1
  Gene Name: SRC kinase signaling inhibitor 1
  Uniprot ID: Q9C0H9
  ENSP ID: ENSP00000484715

SEQ ID NO: 83836 - protein, 473 aa, Homo sapiens; identical to SEQ ID NO: 83831
  Payload ID: 16683
  Gene Symbol: SRCIN1
  Gene Name: SRC kinase signaling inhibitor 1
  ENSP ID: ENSP00000487679

SEQ ID NO: 83837 - protein, 1217 aa, Homo sapiens; identical to SEQ ID NO: 83834
  Payload ID: 16683
  Gene Symbol: SRCIN1
  Gene Name: SRC kinase signaling inhibitor 1
  ENSP ID: ENSP00000488014

SEQ ID NO: 83838 - protein, 306 aa, Homo sapiens; identical to SEQ ID NO: 83830
  Payload ID: 16683
  Gene Symbol: SRCIN1
  Gene Name: SRC kinase signaling inhibitor 1
  ENSP ID: ENSP00000488254
  MOD_RES (1)..(1): Any amino acid

SEQ ID NO: 83839 - protein, 928 aa, Homo sapiens; identical to SEQ ID NO: 83832
  Payload ID: 16683
  Gene Symbol: SRCIN1
  Gene Name: SRC kinase signaling inhibitor 1
  ENSP ID: ENSP00000488440
  MOD_RES (1)..(1): Any amino acid

SEQ ID NO: 83840 - protein, 536 aa, Homo sapiens
  Payload ID: 16684
  Gene Symbol: SRC
  Gene Name: SRC proto-oncogene, non-receptor tyrosine kinase
  Uniprot ID: P12931
  ENSP ID: ENSP00000350941
MGSNKSKPKDASQRRRSLEPAENVHGAGGGAFPASQTPSKPASADGHRGPSAAFAPAAAEPKLFGGFNSSDTVTSPQRAGPLAGGVTTFVALYDYESRTETDLSFKKGERLQIVNNTEGDWWLAHSLSTGQTGYIPSNYVAPSDSIQAEEWYFGKITRRESERLLLNAENPRGTFLVRESETTKGAYCLSVSDFDNAKGLNVKHYKIRKLDSGGFYITSRTQFNSLQQLVAYYSKHADGLCHRLTTVCPTSKPQTQGLAKDAWEIPRESLRLEVKLGQGCFGEVWMGTWNGTTRVAIKTLKPGTMSPEAFLQEAQVMKKLRHEKLVQLYAVVSEEPIYIVTEYMSKGSLLDFLKGETGKYLRLPQLVDMAAQIASGMAYVERMNYVHRDLRAANILVGENLVCKVADFGLARLIEDNEYTARQGAKFPIKWTAPEAALYGRFTIKSDVWSFGILLTELTTKGRVPYPGMVNREVLDQVERGYRMPCPPECPESLHDLMCQCWRKEPEERPTFEYLQAFLEDYFTSTEPQYQPGENL

SEQ ID NO: 83841 - protein, 542 aa, Homo sapiens
  Payload ID: 16684
  Gene Symbol: SRC
  Gene Name: SRC proto-oncogene, non-receptor tyrosine kinase
  Uniprot ID: P12931
  ENSP ID: ENSP00000362659
MGSNKSKPKDASQRRRSLEPAENVHGAGGGAFPASQTPSKPASADGHRGPSAAFAPAAAEPKLFGGFNSSDTVTSPQRAGPLAGGVTTFVALYDYESRTETDLSFKKGERLQIVNNTRKVDVREGDWWLAHSLSTGQTGYIPSNYVAPSDSIQAEEWYFGKITRRESERLLLNAENPRGTFLVRESETTKGAYCLSVSDFDNAKGLNVKHYKIRKLDSGGFYITSRTQFNSLQQLVAYYSKHADGLCHRLTTVCPTSKPQTQGLAKDAWEIPRESLRLEVKLGQGCFGEVWMGTWNGTTRVAIKTLKPGTMSPEAFLQEAQVMKKLRHEKLVQLYAVVSEEPIYIVTEYMSKGSLLDFLKGETGKYLRLPQLVDMAAQIASGMAYVERMNYVHRDLRAANILVGENLVCKVADFGLARLIEDNEYTARQGAKFPIKWTAPEAALYGRFTIKSDVWSFGILLTELTTKGRVPYPGMVNREVLDQVERGYRMPCPPECPESLHDLMCQCWRKEPEERPTFEYLQAFLEDYFTSTEPQYQPGENL

SEQ ID NO: 83842 - protein, 536 aa, Homo sapiens; identical to SEQ ID NO: 83840
  Payload ID: 16684
  Gene Symbol: SRC
  Gene Name: SRC proto-oncogene, non-receptor tyrosine kinase
  Uniprot ID: P12931
  ENSP ID: ENSP00000362668

SEQ ID NO: 83843 - protein, 536 aa, Homo sapiens; identical to SEQ ID NO: 83840
  Payload ID: 16684
  Gene Symbol: SRC
  Gene Name: SRC proto-oncogene, non-receptor tyrosine kinase
  Uniprot ID: P12931
  ENSP ID: ENSP00000362680

SEQ ID NO: 83844 - protein, 276 aa, Homo sapiens
  Payload ID: 16685
  Gene Symbol: SLA
  Gene Name: Src-like-adaptor
  Uniprot ID: Q13239
  ENSP ID: ENSP00000337548
MGNSMKSTPAPAERPLPNPEGLDSDFLAVLSDYPSPDISPPIFRRGEKLRVISDEGGWWKAISLSTGRESYIPGICVARVYHGWLFEGLGRDKAEELLQLPDTKVGSFMIRESETKKGFYSLSVRHRQVKHYRIFRLPNNWYYISPRLTFQCLEDLVNHYSEVADGLCCVLTTPCLTQSTAAPAVRASSSPVTLRQKTVDWRRVSRLQEDPEGTENPLGVDESLFSYGLRESIASYLSLTSEDNTSFDRKKKSISLMYGGSKRKSSFFSSPPYFED

SEQ ID NO: 83845 - protein, 293 aa, Homo sapiens
  Payload ID: 16685
  Gene Symbol: SLA
  Gene Name: Src-like-adaptor
  Uniprot ID: Q13239
  ENSP ID: ENSP00000378759
MLHRLWASPAAPGKKKEMGNSMKSTPAPAERPLPNPEGLDSDFLAVLSDYPSPDISPPIFRRGEKLRVISDEGGWWKAISLSTGRESYIPGICVARVYHGWLFEGLGRDKAEELLQLPDTKVGSFMIRESETKKGFYSLSVRHRQVKHYRIFRLPNNWYYISPRLTFQCLEDLVNHYSEVADGLCCVLTTPCLTQSTAAPAVRASSSPVTLRQKTVDWRRVSRLQEDPEGTENPLGVDESLFSYGLRESIASYLSLTSEDNTSFDRKKKSISLMYGGSKRKSSFFSSPPYFED

SEQ ID NO: 83846 - protein, 316 aa, Homo sapiens
  Payload ID: 16685
  Gene Symbol: SLA
  Gene Name: Src-like-adaptor
  Uniprot ID: Q13239
  ENSP ID: ENSP00000394049
MLSKLGHSPLGGLRARLTFPVCLLYHRLWASPAAPGKKKEMGNSMKSTPAPAERPLPNPEGLDSDFLAVLSDYPSPDISPPIFRRGEKLRVISDEGGWWKAISLSTGRESYIPGICVARVYHGWLFEGLGRDKAEELLQLPDTKVGSFMIRESETKKGFYSLSVRHRQVKHYRIFRLPNNWYYISPRLTFQCLEDLVNHYSEVADGLCCVLTTPCLTQSTAAPAVRASSSPVTLRQKTVDWRRVSRLQEDPEGTENPLGVDESLFSYGLRESIASYLSLTSEDNTSFDRKKKSISLMYGGSKRKSSFFSSPPYFED

SEQ ID NO: 83847 - protein, 168 aa, Homo sapiens
  Payload ID: 16685
  Gene Symbol: SLA
  Gene Name: Src-like-adaptor
  Uniprot ID: Q13239
  ENSP ID: ENSP00000427928
MIRESETKKGFYSLSVRHRQVKHYRIFRLPNNWYYISPRLTFQCLEDLVNHYSEVADGLCCVLTTPCLTQSTAAPAVRASSSPVTLRQKTVDWRRVSRLQEDPEGTENPLGVDESLFSYGLRESIASYLSLTSEDNTSFDRKKKSISLMYGGSKRKSSFFSSPPYFED

SEQ ID NO: 83848 - protein, 40 aa, Homo sapiens
  Payload ID: 16685
  Gene Symbol: SLA
  Gene Name: Src-like-adaptor
  ENSP ID: ENSP00000428087
MGNSMKSTPAPAERPLPNPEGLDSDFLAVLSDYPSPDISP

SEQ ID NO: 83849 - protein, 249 aa, Homo sapiens
  Payload ID: 16685
  Gene Symbol: SLA
  Gene Name: Src-like-adaptor
  Uniprot ID: Q13239
  ENSP ID: ENSP00000428559
MLHRLWASPAAPGKKKEMGNSMKSTPAPAERPLPNPEGLDSDFLAVLSDYPSPDISPPIFRRGEKLRVISDEGGWWKAISLSTGRESYIPGICVARVYHGWLFEGLGRDKAEELLQLPDTKVGSFMIRESETKKEVADGLCCVLTTPCLTQSTAAPAVRASSSPVTLRQKTVDWRRVSRLQEDPEGTENPLGVDESLFSYGLRESIASYLSLTSEDNTSFDRKKKSISLMYGGSKRKSSFFSSPPYFED

SEQ ID NO: 83850 - protein, 28 aa, Homo sapiens
  Payload ID: 16685
  Gene Symbol: SLA
  Gene Name: Src-like-adaptor
  ENSP ID: ENSP00000428971
MGNSMKSTPAPAERPLPNPEGLDSDFLA

SEQ ID NO: 83851 - protein, 14 aa, Homo sapiens
  Payload ID: 16685
  Gene Symbol: SLA
  Gene Name: Src-like-adaptor
  ENSP ID: ENSP00000429143
MGNSMKSTPAPAER

SEQ ID NO: 83852 - protein, 91 aa, Homo sapiens
  Payload ID: 16685
  Gene Symbol: SLA
  Gene Name: Src-like-adaptor
  ENSP ID: ENSP00000429681
MGNSMKSTPAPAERPLPNPEGLDSDFLAVLSDYPSPDISPPIFRRGEKLRVISDEGGWWKAISLSTGRESYIPGICVARVYHGWLFEGLGR

SEQ ID NO: 83853 - protein, 55 aa, Homo sapiens
  Payload ID: 16685
  Gene Symbol: SLA
  Gene Name: Src-like-adaptor
  ENSP ID: ENSP00000429844
MGNSMKSTPAPAERPLPNPEGVTTHGSQQPLQHRPGRSSLAQMAALSAEPDREVD

SEQ ID NO: 83854 - protein, 48 aa, Homo sapiens
  Payload ID: 16685
  Gene Symbol: SLA
  Gene Name: Src-like-adaptor
  ENSP ID: ENSP00000430184
MGNSMKSTPAPAERPLPNPEGLDSDFLAVLSDYPSPDISPPIFRRGEK

SEQ ID NO: 83855 - protein, 158 aa, Homo sapiens
  Payload ID: 16685
  Gene Symbol: SLA
  Gene Name: Src-like-adaptor
  ENSP ID: ENSP00000430596
MGNSMKSTPAPAERPLPNPEGLDSDFLAVLSDYPSPDISPPIFRRGEKLRVISDEGGWWKAISLSTGRESYIPGICVARVYHGWLFEGLGRDKAEELLQLPDTKVGSFMIRESETKKGFYSLSVRHRQVKHYRIFRLPNNWYYISPRLTFQCLEDLVN

SEQ ID NO: 83856 - protein, 261 aa, Homo sapiens
  Payload ID: 16686
  Gene Symbol: SLA2
  Gene Name: Src-like-adaptor 2
  Uniprot ID: Q9H6Q3
  ENSP ID: ENSP00000262866
MGSLPSRRKSLPSPSLSSSVQGQGPVTMEAERSKATAVALGSFPAGGPAELSLRLGEPLTIVSEDGDWWTVLSEVSGREYNIPSVHVAKVSHGWLYEGLSREKAEELLLLPGNPGGAFLIRESQTRRGSYSLSVRLSRPASWDRIRHYRIHCLDNGWLYISPRLTFPSLQALVDHYSELADDICCLLKEPCVLQRAGPLPGKDIPLPVTVQRTPLNWKELDSSLLFSEAATGEESLLSEGLRESLSFYISLNDEAVSLDDA

SEQ ID NO: 83857 - protein, 210 aa, Homo sapiens
  Payload ID: 16686
  Gene Symbol: SLA2
  Gene Name: Src-like-adaptor 2
  Uniprot ID: Q9H6Q3
  ENSP ID: ENSP00000353890
MGSLPSRRKSLPSPSLSSSVQGQGPVTMEAERSKATAVALGSFPAGGPAELSLRLGEPLTIVSEDGDWWTVLSEVSGREYNIPSVHVAKVSHGWLYEGLSREKAEELLLLPGNPGGAFLIRESQTRRGSYSLSVRLSRPASWDRIRHYRIHCLDNGWLYISPRLTFPSLQALVDHYSEGWPAPWQGYTPTCDCAEDTTQLERAGQLPPVF

SEQ ID NO: 83858 - protein, 488 aa, Homo sapiens
  Payload ID: 16687
  Gene Symbol: SRMS
  Gene Name: src-related kinase lacking C-terminal regulatory tyrosine and N-terminal myristylation sites
  Uniprot ID: Q9H3Y6
  ENSP ID: ENSP00000217188
MEPFLRRRLAFLSFFWDKIWPAGGEPDHGTPGSLDPNTDPVPTLPAEPCSPFPQLFLALYDFTARCGGELSVRRGDRLCALEEGGGYIFARRLSGQPSAGLVPITHVAKASPETLSDQPWYFSGVSRTQAQQLLLSPPNEPGAFLIRPSESSLGGYSLSVRAQAKVCHYRVSMAADGSLYLQKGRLFPGLEELLTYYKANWKLIQNPLLQPCMPQKAPRQDVWERPHSEFALGRKLGEGYFGEVWEGLWLGSLPVAIKVIKSANMKLTDLAKEIQTLKGLRHERLIRLHAVCSGGEPVYIVTELMRKGNLQAFLGTPEGRALRLPPLLGFACQVAEGMSYLEEQRVVHRDLAARNVLVDDGLACKVADFGLARLLKDDIYSPSSSSKIPVKWTAPEAANYRVFSQKSDVWSFGVLLHEVFTYGQCPYEGMTNHETLQQIMRGYRLPRPAACPAEVYVLMLECWRSSPEERPSFATLREKLHAIHRCHP

SEQ ID NO: 83859 - protein, 1279 aa, Homo sapiens
  Payload ID: 16688
  Gene Symbol: SCAP
  Gene Name: SREBF chaperone
  Uniprot ID: Q12770
  ENSP ID: ENSP00000265565
MTLTERLREKISRAFYNHGLLCASYPIPIILFTGFCILACCYPLLKLPLPGTGPVEFTTPVKDYSPPPVDSDRKQGEPTEQPEWYVGAPVAYVQQIFVKSSVFPWHKNLLAVDVFRSPLSRAFQLVEEIRNHVLRDSSGIRSLEELCLQVTDLLPGLRKLRNLLPEHGCLLLSPGNFWQNDWERFHADPDIIGTIHQHEPKTLQTSATLKDLLFGVPGKYSGVSLYTRKRMVSYTITLVFQHYHAKFLGSLRARLMLLHPSPNCSLRAESLVHVHFKEEIGVAELIPLVTTYIILFAYIYFSTRKIDMVKSKWGLALAAVVTVLSSLLMSVGLCTLFGLTPTLNGGEIFPYLVVVIGLENVLVLTKSVVSTPVDLEVKLRIAQGLSSESWSIMKNMATELGIILIGYFTLVPAIQEFCLFAVVGLVSDFFLQMLFFTTVLSIDIRRMELADLNKRLPPEACLPSAKPVGQPTRYERQLAVRPSTPHTITLQPSSFRNLRLPKRLRVVYFLARTRLAQRLIMAGTVVWIGILVYTDPAGLRNYLAAQVTEQSPLGEGALAPMPVPSGMLPPSHPDPAFSIFPPDAPKLPENQTSPGESPERGGPAEVVHDSPVPEVTWGPEDEELWRKLSFRHWPTLFSYYNITLAKRYISLLPVIPVTLRLNPREALEGRHPQDGRSAWPPPGPIPAGHWEAGPKGPGGVQAHGDVTLYKVAALGLATGIVLVLLLLCLYRVLCPRNYGQLGGGPGRRRRGELPCDDYGYAPPETEIVPLVLRGHLMDIECLASDGMLLVSCCLAGHVCVWDAQTGDCLTRIPRPGRQRRDSGVGSGLEAQESWERLSDGGKAGPEEPGDSPPLRHRPRGPPPPSLFGDQPDLTCLIDTNFSAQPRSSQPTQPEPRHRAVCGRSRDSPGYDFSCLVQRVYQEEGLAAVCTPALRPPSPGPVLSQAPEDEGGSPEKGSPSLAWAPSAEGSIWSLELQGNLIVVGRSSGRLEVWDAIEGVLCCSSEEVSSGITALVFLDKRIVAARLNGSLDFFSLETHTALSPLQFRGTPGRGSSPASPVYSSSDTVACHLTHTVPCAHQKPITALKAAAGRLVTGSQDHTLRVFRLEDSCCLFTLQGHSGAITTVYIDQTMVLASGGQDGAICLWDVLTGSRVSHVFAHRGDVTSLTCTTSCVISSGLDDLISIWDRSTGIKFYSIQQDLGCGASLGVISDNLLVTGGQGCVSFWDLNYGDLLQTVYLGKNSEAQPARQILVLDNAAIVCNFGSELSLVYVPSVLEKLD

SEQ ID NO: 83860 - protein, 165 aa, Homo sapiens
  Payload ID: 16688
  Gene Symbol: SCAP
  Gene Name: SREBF chaperone
  ENSP ID: ENSP00000324296
MTLTERLREKISRAFYNHGLLCASYPIPIILFTGFCILACCYPLLKLPLPGTGPVEFTTPVKDYSPPPVDSDRKQGEPTEQPEWRDFPLPCGGYWVRECVGAHQVCGLNPGRPGGEAADRPRPKQRELVHHEEHGHGAGHHPHRLLHPSARHPGVLSLCCRGAGV

SEQ ID NO: 83861 - protein, 352 aa, Homo sapiens
  Payload ID: 16688
  Gene Symbol: SCAP
  Gene Name: SREBF chaperone
  ENSP ID: ENSP00000401819
MVKSKWGLALAAVVTVLSSLLMSVGLCTLFGLTPTLNGGEIFPYLVVVIGLENVLVLTKSVVSTPVDLEVKLRIAQGLSSESWSIMKNMATELGIILIGYFTLVPAIQEFCLFAVVGLVSDFFLQMLFFTTVLSIDIRRMELADLNKRLPPEACLPSAKPVGQPTRYERQLAVRPSTPHTITLQPSSFRNLRLPKRLRVVYFLAPTGAHTCWALGSRTQGPRWGAGPWRRHAVQGGGAGPGHRHRLGAAAALPLPRAMPAQLRAAGWWARAAEARGAALRRLRLCATRDGDRAACAARPPHGHRVPGQRRHAAGELLPGRPRLRVGRADRGLPNAHSAPRQAAPGQWRGQRA

SEQ ID NO: 83862 - protein, 136 aa, Homo sapiens
  Payload ID: 16688
  Gene Symbol: SCAP
  Gene Name: SREBF chaperone
  ENSP ID: ENSP00000408102
MTLTERLREKISRAFYNHGLLCASYPIPIILFTGFCILACCYPLLKLPLPGTGPVEFTTPVKDYSPPPVDSDRKQGEPTEQPEWYVGAPVAYVQQIFVKSSVFPWHKNLLAVDVFRSPLSRAFQLVEEIRNHVLRD

SEQ ID NO: 83863 - protein, 85 aa, Homo sapiens
  Payload ID: 16688
  Gene Symbol: SCAP
  Gene Name: SREBF chaperone
  ENSP ID: ENSP00000409183
MTLTERLREKISRAFYNHGLLCASYPIPIILFTGFCILACCYPLLKLPLPGTGPVEFTTPVKDYSPPPVDSDRKQGEPTEQPEWA

SEQ ID NO: 83864 - protein, 88 aa, Homo sapiens
  Payload ID: 16688
  Gene Symbol: SCAP
  Gene Name: SREBF chaperone
  ENSP ID: ENSP00000415195
MTLTERLREKISRAFYNHGLLCASYPIPIILFTGFCILACCYPLLKLPLPGTGPVEFTTPVKDYSPPPVDSDRKQGEPTEQPEWVGTR

SEQ ID NO: 83865 - protein, 121 aa, Homo sapiens
  Payload ID: 16688
  Gene Symbol: SCAP
  Gene Name: SREBF chaperone
  ENSP ID: ENSP00000416847
MTLTERLREKISRAFYNHGLLCASYPIPIILFTGFCILACCYPLLKLPLPGTGPVEFTTPVKDYSPPPVDSDRKQGEPTEQPEWVPGQPACPPDASAPQPQLQPSGGEPGPRALQGGDWCR

SEQ ID NO: 83866 - protein, 132 aa, Homo sapiens
  Payload ID: 16688
  Gene Symbol: SCAP
  Gene Name: SREBF chaperone
  ENSP ID: ENSP00000423419
MTLTERLREKISRAFYNHGLLCASYPIPIILFTGFCILACCYPLLKLPLPGTGPVEFTTPVKDYSPPPVDSDRKQGEPTEQPEWYVGAPVAYVQQIFVKSSVFPWHKNLLAVDVFRSPLSRAFQLVEEIRNH

SEQ ID NO: 83867 - protein, 905 aa, Homo sapiens
  Payload ID: 16688
  Gene Symbol: SCAP
  Gene Name: SREBF chaperone
  ENSP ID: ENSP00000438956
MTLTERLREKISRAFYNHGLLCASYPIPIILFGYFTLVPAIQEFCLFAVVGLVSDFFLQMLFFTTVLSIDIRRMELADLNKRLPPEACLPSAKPVGQPTRYERQLAVRPSTPHTITLQPSSFRNLRLPKRLRVVYFLARTRLAQRLIMAGTVVWIGILVYTDPAGLRNYLAAQVTEQSPLGEGALAPMPVPSGMLPPSHPDPAFSIFPPDAPKLPENQTSPGESPERGGPAEVVHDSPVPEVTWGPEDEELWRKLSFRHWPTLFSYYNITLAKRYISLLPVIPVTLRLNPREALEGRHPQDGRSAWPPPGPIPAGHWEAGPKGPGGVQAHGDVTLYKVAALGLATGIVLVLLLLCLYRVLCPRNYGQLGGGPGRRRRGELPCDDYGYAPPETEIVPLVLRGHLMDIECLASDGMLLVSCCLAGHVCVWDAQTGDCLTRIPRPGQRRDSGVGSGLEAQESWERLSDGGKAGPEEPGDSPPLRHRPRGPPPPSLFGDQPDLTCLIDTNFSAQPRSSQPTQPEPRHRAVCGRSRDSPGYDFSCLVQRVYQEEGLAAVCTPALRPPSPGPVLSQAPEDEGGSPEKGSPSLAWAPSAEGSIWSLELQGNLIVVGRSSGRLEVWDAIEGVLCCSSEEVSSGITALVFLDKRIVAARLNGSLDFFSLETHTALSPLQFRGTPGRGSSPASPVYSSSDTVACHLTHTVPCAHQKPITALKAAAGRLVTGSQDHTLRVFRLEDSCCLFTLQGHSGAITTVYIDQTMVLASGGQDGAICLWDVLTGSRVSHVFAHRGDVTSLTCTTSCVISSGLDDLISIWDRSTGIKFYSIQQDLGCGASLGVISDNLLVTGGQGCVSFWDLNYGDLLQTVYLGKNSEAQPARQILVLDNAAIVCNFGSELSLVYVPSVLEKLD

SEQ ID NO: 83868 - protein, 155 aa, Homo sapiens
  Payload ID: 16689
  Gene Symbol: SREK1IP1
  Gene Name: SREK1-interacting protein 1
  Uniprot ID: Q8N9Q2
  ENSP ID: ENSP00000427401
MAVPGCNKDSVRAGCKKCGYPGHLTFECRNFLRVDPKRDIVLDVSSTSSEDSDEENEELNKLQALQEKRINEEEEKKKEKSKEKIKLKKKRKRSYSSSSTEEDTSKQKKQKYQKKEKKKEKKSKSKKGKHHKKEKKKRKKEKHSSTPNSSEFSRK

SEQ ID NO: 83869 - protein, 98 aa, Homo sapiens
  Payload ID: 16689
  Gene Symbol: SREK1IP1
  Gene Name: SREK1-interacting protein 1
  ENSP ID: ENSP00000481414
MAVPGCNKDSVRAGCKKCGYPGHLTFECRNFLRVDPKRDIVLDVSSTSSEDSDEENEELNKLQALQEKRINEEEEKKKKQRKNQIEKKKEKVLLIQFH

SEQ ID NO: 83870 - protein, 339 aa, Homo sapiens
  Payload ID: 16690
  Gene Symbol: SRRD
  Gene Name: SRR1 domain containing
  Uniprot ID: Q9UH36
  ENSP ID: ENSP00000215917
MAAAAAAALESWQAAAPRKRRSAARRPRRREAAPRGREAAPRGREAAPRGPEAEFESDSGVVLRRIWEAEKDLFISDFWSSALETINRCLTKHLEQLKAPVGTLSDIFGNLHLDSLPEESDVATDSIPREILVTGTCHLKCVCYGIGNFATCIVARNQLTFLLLLLEKCQIPRSHCWVYDPLFSQLEIEVLNTLGVTVLSENEEGKRSIRGEPTIFYMLHCGTALYNNLLWSNWSVDALSKMVIIGNSFKGLEERLLARILQKNYPYIAKILKGLEELEFPQTSQYMDIFNDTSVHWFPVQKLEQLSIDIWEFREEPDYQDCEDLEIIRNKREDPSATD

SEQ ID NO: 83871 - protein, 335 aa, Homo sapiens
  Payload ID: 16690
  Gene Symbol: SRRD
  Gene Name: SRR1 domain containing
  ENSP ID: ENSP00000482019
MAAAAAAALESWQAAAPRKRRGSTAAARRPRGREAAPRGREAAPRGPEAEFESDSGVVLRRIWEAEKDLFISDFWSSALETINRCLTKHLEQLKAPVGTLSDIFGNLHLDSLPEESDVATDSIPREILVTGTCHLKCVCYGIGNFATCIVARNQLTFLLLLLEKCQIPRSHCWVYDPLFSQLEIEVLNTLGVTVLSENEEGKRSIRGEPTIFYMLHCGTALYNNLLWSNWSVDALSKMVIIGNSFKGLEERLLARILQKNYPYIAKILKGLEELEFPQTSQYMDIFNDTSVHWFPVQKLEQLSIDIWEFREEPDYQDCEDLEIIRNKREDPSATD

SEQ ID NO: 83872 - protein, 1312 aa, Homo sapiens
  Payload ID: 16691
  Gene Symbol: SCAF1
  Gene Name: SR-related CTD-associated factor 1
  Uniprot ID: Q9H7N4
  ENSP ID: ENSP00000353769
MEEEDESRGKTEESGEDRGDGPPDRDPTLSPSAFILRAIQQAVGSSLQGDLPNDKDGSRCHGLRWRRCRSPRSEPRSQESGGTDTATVLDMATDSFLAGLVSVLDPPDTWVPSRLDLRPGESEDMLELVAEVRIGDRDPIPLPVPSLLPRLRAWRTGKTVSPQSNSSRPTCARHLTLGTGDGGPAPPPAPSSASSSPSPSPSSSSPSPPPPPPPPAPPAPPAPRFDIYDPFHPTDEAYSPPPAPEQKYDPFEPTGSNPSSSAGTPSPEEEEEEEEEEEEEEEDEEEEEGLSQSISRISETLAGIYDDNSLSQDFPGDESPRPDAQPTQPTPAPGTPPQVDSTRADGAMRRRVFVVGTEAEACREGKVSVEVVTAGGAALPPPLLPPGDSEIEEGEIVQPEEEPRLALSLFRPGGRAARPTPAASATPTAQPLPQPPAPRAPEGDDFLSLHAESDGEGALQVDLGEPAPAPPAADSRWGGLDLRRKILTQRRERYRQRSPSPAPAPAPAAAAGPPTRKKSRRERKRSGEAKEAASSSSGTQPAPPAPASPWDSKKHRSRDRKPGSHASSSARRRSRSRSRSRSTRRRSRSTDRRRGGSRRSRSREKRRRRRRSASPPPATSSSSSSRRERHRGKHRDGGGSKKKKKRSRSRGEKRSGDGSEKAPAPAPPPSGSTSCGDRDSRRRGAVPPSIQDLTDHDLFAIKRTITVGRLDKSDPRGPSPAPASSPKREVLYDSEGLSGEERGGKSSQKDRRRSGAASSSSSSREKGSRRKALDGGDRDRDRDRDRDRDRSSKKARPPKESAPSSGPPPKPPVSSGSGSSSSSSSCSSRKVKLQSKVAVLIREGVSSTTPAKDAASAGLGSIGVKFSRDRESRSPFLKPDERAPTEMAKAAPGSTKPKKTKVKAKAGAKKTKGTKGKTKPSKTRKKVRSGGGSGGSGGQVSLKKSKADSCSQAAGTKGAEETSWSGEERAAKVPSTPPPKAAPPPPALTPDSQTVDSSCKTPEVSFLPEEATEEAGVRGGAEEEEEEEEEEEEEEEEEEQQPATTTATSTAAAAPSTAPSAGSTAGDSGAEDGPASRVSQLPTLPPPMPWNLPAGVDCTTSGVLALTALLFKMEEANLASRAKAQELIQATNQILSHRKPPSSLGMTPAPVPTSLGLPPGPSSYLLPGSLPLGGCGSTPPTPTGLAATSDKREGSSSSEGRGDTDKYLKKLHTQERAVEEVKLAIKPYYQKKDITKEEYKDILRKAVHKICHSKSGEINPVKVSNLVRAYVQRYRYFRKHGRKPGDPPGPPRPPKEPGPPDKGGPGLPLPPL

SEQ ID NO: 83873 - protein, 119 aa, Homo sapiens
  Payload ID: 16691
  Gene Symbol: SCAF1
  Gene Name: SR-related CTD-associated factor 1
  ENSP ID: ENSP00000472276
MEEEDESRGKTEESGEDRGDGPPDRDPTLSPSAFILRAIQQAVGSSLQGDLPNDKDGSRCHGLRWRRCRSPRSEPRSQESGGTDTATVSVGHGHGQLPRRAGECPGSPGYLGSQPPGPA

SEQ ID NO: 83874 - protein, 98 aa, Homo sapiens
  Payload ID: 16691
  Gene Symbol: SCAF1
  Gene Name: SR-related CTD-associated factor 1
  ENSP ID: ENSP00000472649
MEEEDESRGKTEESGEDRGDGPPDRDPTLSPSAFILRAIQQAVGSSLQGDLPNDKDGSRCHGLRWRRCRSPRSEPRSQESGGTDTATVLDMATDSFLA

SEQ ID NO: 83875 - protein, 203 aa, Homo sapiens
  Payload ID: 16691
  Gene Symbol: SCAF1
  Gene Name: SR-related CTD-associated factor 1
  ENSP ID: ENSP00000473210
MEEEDESRGKTEESGEDRGDGPPDRDPTLSPSAFILRAIQQAVGSSLQGDLPNDKDGSRCHGLRWRRCRSPRSEPRSQESGGTDTATVLDMATDSFLAGLVSVLDPPDTWVPSRLDLRPGESEDMLELVAEVRIGDRDPIPLPVPSLLPRLRAWRTGKTVSPQSNSSRPTCARHLTLGTGDGGPAPPPAPSSASSSPSPSPSS

SEQ ID NO: 83876 - protein, 117 aa, Homo sapiens
  Payload ID: 16692
  Gene Symbol: SCAF11
  Gene Name: SR-related CTD-associated factor 11
  ENSP ID: ENSP00000266589
MIVSIFSNKETLFQREMKKKTVCTLNMGDKKYEDMEGEENGDNTISTGLLYSEADRCPICLNCLLEKEVGFPESCNHVFCMTCILKWAETLASCPIDRKPFQAVFKFSALEGYVKVQ

SEQ ID NO: 83877 - protein, 1463 aa, Homo sapiens
  Payload ID: 16692
  Gene Symbol: SCAF11
  Gene Name: SR-related CTD-associated factor 11
  Uniprot ID: Q99590
  ENSP ID: ENSP00000358374
MKKKTVCTLNMGDKKYEDMEGEENGDNTISTGLLYSEADRCPICLNCLLEKEVGFPESCNHVFCMTCILKWAETLASCPIDRKPFQAVFKFSALEGYVKVQVKKQLRETKDKKNENSFEKQVSCHENSKSCIRRKAIVREDLLSAKVCDLKWIHRNSLYSETGGKKNAAIKINKPQRSNWSTNQCFRNFFSNMFSSVSHSGESSFTYRAYCTEFIEASEISALIRQKRHELELSWFPDTLPGIGRIGFIPWNVETEVLPLISSVLPRTIFPTSTISFEHFGTSCKGYALAHTQEGEEKKQTSGTSNTRGSRRKPAMTTPTRRSTRNTRAETASQSQRSPISDNSGCDAPGNSNPSLSVPSSAESEKQTRQAPKRKSVRRGRKPPLLKKKLRSSVAAPEKSSSNDSVDEETAESDTSPVLEKEHQPDVDSSNICTVQTHVENQSANCLKSCNEQIEESEKHTANYDTEERVGSSSSESCAQDLPVLVGEEGEVKKLENTGIEANVLCLESEISENILEKGGDPLEKQDQISGLSQSEVKTDVCTVHLPNDFPTCLTSESKVYQPVSCPLSDLSENVESVVNEEKITESSLVEITEHKDFTLKTEELIESPKLESSEGEIIQTVDRQSVKSPEVQLLGHVETEDVEIIATCDTFGNEDFNNIQDSENNLLKNNLLNTKLEKSLEEKNESLTEHPRSTELPKTHIEQIQKHFSEDNNEMIPMECDSFCSDQNESEVEPSVNADLKQMNENSVTHCSENNMPSSDLADEKVETVSQPSESPKDTIDKTKKPRTRRSRFHSPSTTWSPNKDTPQEKKRPQSPSPRRETGKESRKSQSPSPKNESARGRKKSRSQSPKKDIARERRQSQSRSPKRDTTRESRRSESLSPRRETSRENKRSQPRVKDSSPGEKSRSQSRERESDRDGQRRERERRTRKWSRSRSHSRSPSRCRTKSKSSSFGRIDRDSYSPRWKGRWANDGWRCPRGNDRYRKNDPEKQNENTRKEKNDIHLDADDPNSADKHRNDCPNWITEKINSGPDPRTRNPEKLKESHWEENRNENSGNSWNKNFGSGWVSNRGRGRGNRGRGTYRSSFAYKDQNENRWQNRKPLSGNSNSSGSESFKFVEQQSYKRKSEQEFSFDTPADRSGWTSASSWAVRKTLPADVQNYYSRRGRNSSGPQSGWMKQEEETSGQDSSLKDQTNQQVDGSQLPINMMQPQMNVMQQQMNAQHQPMNIFPYPVGVHAPLMNIQRNPFNIHPQLPLHLHTGVPLMQVATPTSVSQGLPPPPPPPPPSQQVNYIASQPDGKQLQGIPSSSHVSNNMSTPVLPAPTAAPGNTGMVQGPSSGNTSSSSHSKASNAAVKLAESKVSVAVEASADSSKTDKKLQIQEKAAQEVKLAIKPFYQNKDITKEEYKEIVRKAVDKVCHSKSGEVNSTKVANLVKAYVDKYKYSRKGSQKKTLEEPVSTEKNIG

SEQ ID NO: 83878 - protein, 77 aa, Homo sapiens
  Payload ID: 16692
  Gene Symbol: SCAF11
  Gene Name: SR-related CTD-associated factor 11
  ENSP ID: ENSP00000378839
MKKKTVCTLNMGDKKYEDMEGEENGDNTISTGLLYSEADRCPICLNCLLEKEVGFPESCNHVFCMTCILKWAEGLFT

SEQ ID NO: 83879 - protein, 77 aa, Homo sapiens
  Payload ID: 16692
  Gene Symbol: SCAF11
  Gene Name: SR-related CTD-associated factor 11
  ENSP ID: ENSP00000378840
MKKKTVCTLNMGDKKYEDMEGEENGDNTISTGLLYSEADRCPICLNCLLEKEVGFPESCNHVFCMTCILKWAERSYL

SEQ ID NO: 83880 - protein, 935 aa, Homo sapiens
  Payload ID: 16692
  Gene Symbol: SCAF11
  Gene Name: SR-related CTD-associated factor 11
  ENSP ID: ENSP00000446746
MGRGKYNLLITFQTLASCPIDRKPFQAVFKFSALEGYVKVQVKKQLRETKDKKNENSFEKQVSCHENSKSCIRRKAIVREDLLSAKVCDLKWIHRNSLYSETGGKKNAAIKINKPQRSNWSTNQCFRNFFSNMFSSVSHSGESSFTYRAYCTEFIEASEISALIRQKRHELELSWFPDTLPGIGRIGFIPWNVETEVLPLISSVLPRTIFPTSTISFEHFGTSCKGYALAHTQEGEEKKQTSGTSNTRGSRRKPAMTTPTRRSTRNTRAETASQSQRSPISDNSGCDAPGNSNPSLSVPSSAESEKQTRQAPKRKSVRRGRKPPLLKKKLRSSVAAPEKSSSNDSVDEETAESDTSPVLEKEHQPDVDSSNICTVQTHVENQSANCLKSCNEQIEESEKHTANYDTEERVGSSSSESCAQDLPVLVGEEGEVKKLENTGIEANVLCLESEISENILEKGGDPLEKQDQISGLSQSEVKTDVCTVHLPNDFPTCLTSESKVYQPVSCPLSDLSENVESVVNEEKITESSLVEITEHKDFTLKTEELIESPKLESSEGEIIQTVDRQSVKSPEVQLLGHVETEDVEIIATCDTFGNEDFNNIQDSENNLLKNNLLNTKLEKSLEEKNESLTEHPRSTELPKTHIEQIQKHFSEDNNEMIPMECDSFCSDQNESEVEPSVNADLKQMNENSVTHCSENNMPSSDLADEKVETVSQPSESPKDTIDKTKKPRTRRSRFHSPSTTWSPNKDTPQEKKRPQSPSPRRETGKESRKSQSPSPKNESARGRKKSRSQSPKKDIARERRQSQSRSPKRDTTRESRRSESLSPRRETSRENKRSQPRVKDSSPGEKSRSQSRERESDRDGQRRERERRTRKWSRSRSHSRSPSRCRTKSKSSSFGRIDRDSYSPRWKGRWANDGWRCPRGNDRYRKNDPEKQNEN

SEQ ID NO: 83881 - protein, 1271 aa, Homo sapiens
  Payload ID: 16692
  Gene Symbol: SCAF11
  Gene Name: SR-related CTD-associated factor 11
  ENSP ID: ENSP00000448864
MFSSVSHSGESSFTYRAYCTEFIEASEISALIRQKRHELELSWFPDTLPGIGRIGFIPWNVETEVLPLISSVLPRTIFPTSTISFEHFGTSCKGYALAHTQEGEEKKQTSGTSNTRGSRRKPAMTTPTRRSTRNTRAETASQSQRSPISDNSGCDAPGNSNPSLSVPSSAESEKQTRQAPKRKSVRRGRKPPLLKKKLRSSVAAPEKSSSNDSVDEETAESDTSPVLEKEHQPDVDSSNICTVQTHVENQSANCLKSCNEQIEESEKHTANYDTEERVGSSSSESCAQDLPVLVGEEGEVKKLENTGIEANVLCLESEISENILEKGGDPLEKQDQISGLSQSEVKTDVCTVHLPNDFPTCLTSESKVYQPVSCPLSDLSENVESVVNEEKITESSLVEITEHKDFTLKTEELIESPKLESSEGEIIQTVDRQSVKSPEVQLLGHVETEDVEIIATCDTFGNEDFNNIQDSENNLLKNNLLNTKLEKSLEEKNESLTEHPRSTELPKTHIEQIQKHFSEDNNEMIPMECDSFCSDQNESEVEPSVNADLKQMNENSVTHCSENNMPSSDLADEKVETVSQPSESPKDTIDKTKKPRTRRSRFHSPSTTWSPNKDTPQEKKRPQSPSPRRETGKESRKSQSPSPKNESARGRKKSRSQSPKKDIARERRQSQSRSPKRDTTRESRRSESLSPRRETSRENKRSQPRVKDSSPGEKSRSQSRERESDRDGQRRERERRTRKWSRSRSHSRSPSRCRTKSKSSSFGRIDRDSYSPRWKGRWANDGWRCPRGNDRYRKNDPEKQNENTRKEKNDIHLDADDPNSADKHRNDCPNWITEKINSGPDPRTRNPEKLKESHWEENRNENSGNSWNKNFGSGWVSNRGRGRGNRGRGTYRSSFAYKDQNENRWQNRKPLSGNSNSSGSESFKFVEQQSYKRKSEQEFSFDTPADRSGWTSASSWAVRKTLPADVQNYYSRRGRNSSGPQSGWMKQEEETSGQDSSLKDQTNQQVDGSQLPINMMQPQMNVMQQQMNAQHQPMNIFPYPVGVHAPLMNIQRNPFNIHPQLPLHLHTGVPLMQVATPTSVSQGLPPPPPPPPPSQQVNYIASQPDGKQLQGIPSSSHVSNNMSTPVLPAPTAAPGNTGMVQGPSSGNTSSSSHSKASNAAVKLAESKVSVAVEASADSSKTDKKLQIQEKAAQEVKLAIKPFYQNKDITKEEYKEIVRKAVDKVCHSKSGEVNSTKVANLVKAYVDKYKYSRKGSQKKTLEEPVSTEKNIG

SEQ ID NO: 83882 - protein, 1148 aa, Homo sapiens
  Payload ID: 16692
  Gene Symbol: SCAF11
  Gene Name: SR-related CTD-associated factor 11
  Uniprot ID: Q99590
  ENSP ID: ENSP00000449812
MTTPTRRSTRNTRAETASQSQRSPISDNSGCDAPGNSNPSLSVPSSAESEKQTRQAPKRKSVRRGRKPPLLKKKLRSSVAAPEKSSSNDSVDEETAESDTSPVLEKEHQPDVDSSNICTVQTHVENQSANCLKSCNEQIEESEKHTANYDTEERVGSSSSESCAQDLPVLVGEEGEVKKLENTGIEANVLCLESEISENILEKGGDPLEKQDQISGLSQSEVKTDVCTVHLPNDFPTCLTSESKVYQPVSCPLSDLSENVESVVNEEKITESSLVEITEHKDFTLKTEELIESPKLESSEGEIIQTVDRQSVKSPEVQLLGHVETEDVEIIATCDTFGNEDFNNIQDSENNLLKNNLLNTKLEKSLEEKNESLTEHPRSTELPKTHIEQIQKHFSEDNNEMIPMECDSFCSDQNESEVEPSVNADLKQMNENSVTHCSENNMPSSDLADEKVETVSQPSESPKDTIDKTKKPRTRRSRFHSPSTTWSPNKDTPQEKKRPQSPSPRRETGKESRKSQSPSPKNESARGRKKSRSQSPKKDIARERRQSQSRSPKRDTTRESRRSESLSPRRETSRENKRSQPRVKDSSPGEKSRSQSRERESDRDGQRRERERRTRKWSRSRSHSRSPSRCRTKSKSSSFGRIDRDSYSPRWKGRWANDGWRCPRGNDRYRKNDPEKQNENTRKEKNDIHLDADDPNSADKHRNDCPNWITEKINSGPDPRTRNPEKLKESHWEENRNENSGNSWNKNFGSGWVSNRGRGRGNRGRGTYRSSFAYKDQNENRWQNRKPLSGNSNSSGSESFKFVEQQSYKRKSEQEFSFDTPADRSGWTSASSWAVRKTLPADVQNYYSRRGRNSSGPQSGWMKQEEETSGQDSSLKDQTNQQVDGSQLPINMMQPQMNVMQQQMNAQHQPMNIFPYPVGVHAPLMNIQRNPFNIHPQLPLHLHTGVPLMQVATPTSVSQGLPPPPPPPPPSQQVNYIASQPDGKQLQGIPSSSHVSNNMSTPVLPAPTAAPGNTGMVQGPSSGNTSSSSHSKASNAAVKLAESKVSVAVEASADSSKTDKKLQIQEKAAQEVKLAIKPFYQNKDITKEEYKEIVRKAVDKVCHSKSGEVNSTKVANLVKAYVDKYKYSRKGSQKKTLEEPVSTEKNIG

SEQ ID NO: 83883 - protein, 152 aa, Homo sapiens
  Payload ID: 16692
  Gene Symbol: SCAF11
  Gene Name: SR-related CTD-associated factor 11
  ENSP ID: ENSP00000477742
  MOD_RES (1)..(1): Any amino acid
XPPPSQQVNYIASQPDGKQLQGIPSSSHVSNNMSTPVLPAPTAAPGNTGMVQGPSSGNTSSSSHSKASNAAVKLAESKVSVAVEASADSSKTDKKLQIQEKAAQEVKLAIKPFYQNKDITKEEYKEIVRKAVDKVSYGFSGVCARCFEPPLF

SEQ ID NO: 83884 - protein, 71 aa, Homo sapiens
  Payload ID: 16692
  Gene Symbol: SCAF11
  Gene Name: SR-related CTD-associated factor 11
  ENSP ID: ENSP00000478596
  MOD_RES (1)..(1): Any amino acid
XKKQLRETKDKKNENSFEKQVSCHENSKSCIRRKAIVREDLLSAKVCDLKWIHSKLLFACGFYLFFCCFLI

SEQ ID NO: 83885 - protein, 1147 aa, Homo sapiens
  Payload ID: 16693
  Gene Symbol: SCAF4
  Gene Name: SR-related CTD-associated factor 4
  Uniprot ID: O95104
  ENSP ID: ENSP00000286835
MDAVNAFNQELFSLMDMKPPISRAKMILITKAAIKAIKLYKHVVQIVEKFIKKCKPEYKVPGLYVIDSIVRQSRHQFGTDKDVFGPRFSKNITATFQYLYLCPSEDKSKIVRVLNLWQKNGVFKIEIIQPLLDMAAGTSNAAPVAENVTNNEGSPPPPVKVSSEPPTQATPNSVPAVPQLPSSDAFAAVAQLFQTTQGQQLQQILQTFQQPPKPQSPALDNAVMAQVQAITAQLKTTPTQPSEQKAAFPPPEQKTAFDKKLLDRFDYDDEPEAVEESKKEDTTAVTTTAPAAAVPPAPTATVPAAAAPAAASPPPPQAPFGFPGDGMQQPAYTQHQNMDQFQPRMMGIQQDPMHHQVPLPPNGQMPGFGLLPTPPFPPMAQPVIPPTPPVQQPFQASFQAQNEPLTQKPHQQEMEVEQPCIQEVKRHMSDNRKSRSRSASRSPKRRRSRSGSRSRRSRHRRSRSRSRDRRRHSPRSRSQERRDREKERERRQKGLPQVKPETASVCSTTLWVGQLDKRTTQQDVASLLEEFGPIESINMIPPRGCAYIVMVHRQDAYRALQKLSRGNYKVNQKSIKIAWALNKGIKADYKQYWDVELGVTYIPWDKVKPEELESFCEGGMLDSDTLNPDWKGIPKKPENEVAQNGGAETSHTEPVSPIPKPLPVPVPPIPVPAPITVPPPQVPPHQPGPPVVGALQPPAFTPPLGIPPPGFGPGVPPPPPPPPFLRPGFNPMHLPPGFLPPGPPPPITPPVSIPPPHTPPISIPNSTIAGINEDTTKDLSIGNPIPTVVSGARGNAESGDSVKMYGSAVPPAAPTNLPTPPVTQPVSLLGTQGVAPGPVIGLQAPSTGLLGARPGLIPLQRPPGMPPPHLQRFPLMPPRPMPPHMMHRGPPPGPGGFAMPPPHGMKGPFPPHGPFVRPGGMPGLGGPGPGPGGPEDRDGRQQPPQQPQQQPQPQAPQQPQQQQQQQPPPSQQPPPTQQQPQQFRNDNRQQFNSGRDQERFGRRSFGNRVENDRERYGNRNDDRDNSNRDRREWGRRSPDRDRHRDLEERNRRSSGHRDRERDSRDRESRREKEEARGKEKPEVTDRAGGNKTVEPPISQVGNVDTASELEKGVSEAAVLKPSEELPAEATSSVEPEKDSGSAAEAPR

SEQ ID NO: 83886 - protein, 1125 aa, Homo sapiens
  Payload ID: 16693
  Gene Symbol: SCAF4
  Gene Name: SR-related CTD-associated factor 4
  Uniprot ID: O95104
  ENSP ID: ENSP00000382703
MDAVNAFNQELFSLMDMKPPISRAKMILITKAAIKAIKLYKHVVQIVEKFIKKCKPEYKVPGLYVIDSIVRQSRHQFGTDKDVFGPRFSKNITATFQYLYLCPSEDKSKIVRVLNLWQKNGVFKIEIIQPLLDMAAGTSNAAPVAENVTNNEGSPPPPVKVSSEPPTQATPNSVPAVPQLPSSDAFAAVAQLFQTTQGQQLQQILQTFQQPPKPQSPALDNAVMAQVQAITAQLKTTPTQPSEQKAAFPPPEQKTAFDKKLLDRFDYDDEPEAVEESKKEDTTAVTTTAPAAAVPPAPTATVPAAAAPAAASPPPPQAPFGFPGDGMQQPAYTQHQNMDQFQPRMMGIQQDPMHHQVPLPPNGQMPGFGLLPTPPFPPMAQPVIPPTPPVQQPFQASFQAQNEPLTQKPHQQEMEVEQPCIQEVKRHMSDNRKSRSRSASRSPKRRRSRSGSRSRRSRHRRSRSRSRDRRRHSPRSRSQERRDREKERERRQKGLPQVKPETASVCSTTLWVGQLDKRTTQQDVASLLEEFGPIESINMIPPRGCAYIVMVHRQDAYRALQKLSRGNYKVNQKSIKIAWALNKGIKADYKQYWDVELGVTYIPWDKVKPEELESFCEGGMLDSDTLNPDWKGIPKKPENEVAQNGGAETSHTEPVSPIPKPLPVPVPPIPVPAPITVPPPQVPPHQPGPPVVGALQPPAFTPPLGIPPPGFGPGVPPPPPPPPFLRPGFNPMHLPPGFLPPGPPPPITPPVSIPPPHTPPISIPNLVSGARGNAESGDSVKMYGSAVPPAAPTNLPTPPVTQPVSLLGTQGVAPGPVIGLQAPSTGLLGARPGLIPLQRPPGMPPPHLQRFPLMPPRPMPPHMMHRGPPPGPGGFAMPPPHGMKGPFPPHGPFVRPGGMPGLGGPGPGPGGPEDRDGRQQPPQQPQQQPQPQAPQQPQQQQQQQPPPSQQPPPTQQQPQQFRNDNRQQFNSGRDQERFGRRSFGNRVENDRERYGNRNDDRDNSNRDRREWGRRSPDRDRHRDLEERNRRSSGHRDRERDSRDRESRREKEEARGKEKPEVTDRAGGNKTVEPPISQVGNVDTASELEKGVSEAAVLKPSEELPAEATSSVEPEKDSGSAAEAPR

SEQ ID NO: 83887 - protein, 1132 aa, Homo sapiens
  Payload ID: 16693
  Gene Symbol: SCAF4
  Gene Name: SR-related CTD-associated factor 4
  Uniprot ID: O95104
  ENSP ID: ENSP00000402377
MDAVNAFNQELFSLMDMKPPISRAKMILITKAAIKAIKCKPEYKVPGLYVIDSIVRQSRHQFGTDKDVFGPRFSKNITATFQYLYLCPSEDKSKIVRVLNLWQKNGVFKIEIIQPLLDMAAGTSNAAPVAENVTNNEGSPPPPVKVSSEPPTQATPNSVPAVPQLPSSDAFAAVAQLFQTTQGQQLQQILQTFQQPPKPQSPALDNAVMAQVQAITAQLKTTPTQPSEQKAAFPPPEQKTAFDKKLLDRFDYDDEPEAVEESKKEDTTAVTTTAPAAAVPPAPTATVPAAAAPAAASPPPPQAPFGFPGDGMQQPAYTQHQNMDQFQPRMMGIQQDPMHHQVPLPPNGQMPGFGLLPTPPFPPMAQPVIPPTPPVQQPFQASFQAQNEPLTQKPHQQEMEVEQPCIQEVKRHMSDNRKSRSRSASRSPKRRRSRSGSRSRRSRHRRSRSRSRDRRRHSPRSRSQERRDREKERERRQKGLPQVKPETASVCSTTLWVGQLDKRTTQQDVASLLEEFGPIESINMIPPRGCAYIVMVHRQDAYRALQKLSRGNYKVNQKSIKIAWALNKGIKADYKQYWDVELGVTYIPWDKVKPEELESFCEGGMLDSDTLNPDWKGIPKKPENEVAQNGGAETSHTEPVSPIPKPLPVPVPPIPVPAPITVPPPQVPPHQPGPPVVGALQPPAFTPPLGIPPPGFGPGVPPPPPPPPFLRPGFNPMHLPPGFLPPGPPPPITPPVSIPPPHTPPISIPNSTIAGINEDTTKDLSIGNPIPTVVSGARGNAESGDSVKMYGSAVPPAAPTNLPTPPVTQPVSLLGTQGVAPGPVIGLQAPSTGLLGARPGLIPLQRPPGMPPPHLQRFPLMPPRPMPPHMMHRGPPPGPGGFAMPPPHGMKGPFPPHGPFVRPGGMPGLGGPGPGPGGPEDRDGRQQPPQQPQQQPQPQAPQQPQQQQQQQPPPSQQPPPTQQQPQQFRNDNRQQFNSGRDQERFGRRSFGNRVENDRERYGNRNDDRDNSNRDRREWGRRSPDRDRHRDLEERNRRSSGHRDRERDSRDRESRREKEEARGKEKPEVTDRAGGNKTVEPPISQVGNVDTASELEKGVSEAAVLKPSEELPAEATSSVEPEKDSGSAAEAPR

SEQ ID NO: 83888 - protein, 1271 aa, Homo sapiens
  Payload ID: 16694
  Gene Symbol: SCAF8
  Gene Name: SR-related CTD-associated factor 8
  Uniprot ID: Q9UPN6
  ENSP ID: ENSP00000356146
MEAVKTFNSELYSLNDYKPPISKAKMTQITKAAIKAIKFYKHVVQSVEKFIQKCKPEYKVPGLYVIDSIVRQSRHQFGQEKDVFAPRFSNNIISTFQNLYRCPGDDKSKIVRVLNLWQKNNVFKSEIIQPLLDMAAGIPPPVVTPVLASTTTAMSNTPGTPVTPVTPANVVQGLPDPWVSQITNTDTLAAVAQILQSPQGQQLQQLIQTLQIQQQKPQPSILQALDAGLVVQLQALTAQLTAAAAAANTLTPLEQGVSFNKKLMDRFDFGEDSEHSEEPKKEIPASQLSHVSESVNNSIFHQIAEQLQQQNLEHLRQQLLEQQQPQKATPQDSQEGTFGSEHSASPSQGSSQQHFLEPEVNLDDSIDIQQQDMDIDEGQDGVEEEVFEQEAKKVAVRSRSRTHSRSRSRSPRKRRSRSRSGSRKRKHRKRSRSRSRERKRKSSRSYSSERRAREREKERQKKGLPPIRSKTLSVCSTTLWVGQVDKKATQQDLTNLFEEFGQIESINMIPPRGCAYVCMVHRQDAFRALQKLSSGSYKIGSKVIKIAWALNKGVKTEYKQFWDVDLGVTYIPWEKVKVDDLEGFAEGGMIDQETVNTEWETVKSSEPVKETVQTTQSPTPVEKETVVTTQAEVFPPPVAMLQIPVAPAVPTVSLVPPAFPVSMPVPPPGFSPIPPPPFLRASFNPSQPPPGFMPPPVPPPVVPPPTIPPVVPTSLVQPSLSMTPETVKDVGFGSLVIPGGSVASNLATSALPAGNVFNAPTKQAEPEEKVPHLIDHQISSGENTRSVIPNDISSNAAILGGQPPNVTSNSGILGVQRPNVSSNSEILGVRPSNVSSSSGIIAAQPPNILNNSGILGIQPPSVSNSSGLLGVLPPNIPNNSGLVGVQPPNVPNTPGLLGTQPPAGPQNLPPLSIPNQRMPTMPMLDIRPGLIPQAPGPRFPLIQPGIPPQRGIPPPSVLDSALHPPPRGPFPPGDIFSQPERPFLAPGRQSVDNVTNPEKRIPLGNDNIQQEGDRDYRFPPIETRESISRPPPVDVRDVVGRPIDPREGPGRPPLDGRDHFGRPPVDIRENLVRPGIDHLGRRDHFGFNPEKPWGHRGDFDEREHRVLPVYGGPKGLHEERGRFRSGNYRFDPRSGPWNRGFGQEVHRDFDDRRRPWERQRDRDDRDFDFCREMNGNRLGRDRIQNTWVPPPHARVFDYFEGATSQRKGDNVPQVNGENTERHAQPPPIPVQNDPELYEKLTSSNEINKEKSDTVADIESEPVVESTETEGT

SEQ ID NO: 83889 - protein, 1337 aa, Homo sapiens
  Payload ID: 16694
  Gene Symbol: SCAF8
  Gene Name: SR-related CTD-associated factor 8
  Uniprot ID: Q9UPN6
  ENSP ID: ENSP00000356154
MPQPLLPALPPLSSPSGAGSCGPSGGECSGRRLFRRRARGLRSDNMEAVKTFNSEDCASTPACTDCFSSSMDTRSILYSLNDYKPPISKAKMTQITKAAIKAIKFYKHVVQSVEKFIQKCKPEYKVPGLYVIDSIVRQSRHQFGQEKDVFAPRFSNNIISTFQNLYRCPGDDKSKIVRVLNLWQKNNVFKSEIIQPLLDMAAGIPPPVVTPVLASTTTAMSNTPGTPVTPVTPANVVQGLPDPWVSQITNTDTLAAVAQILQSPQGQQLQQLIQTLQIQQQKPQPSILQALDAGLVVQLQALTAQLTAAAAAANTLTPLEQGVSFNKKLMDRFDFGEDSEHSEEPKKEIPASQLSHVSESVNNSIFHQIAEQLQQQNLEHLRQQLLEQQQPQKATPQDSQEGTFGSEHSASPSQGSSQQHFLEPEVNLDDSIDIQQQDMDIDEGQDGVEEEVFEQEAKKVAVRSRSRTHSRSRSRSPRKRRSRSRSGSRKRKHRKRSRSRSRERKRKSSRSYSSERRAREREKERQKKGLPPIRSKTLSVCSTTLWVGQVDKKATQQDLTNLFEEFGQIESINMIPPRGCAYVCMVHRQDAFRALQKLSSGSYKIGSKVIKIAWALNKGVKTEYKQFWDVDLGVTYIPWEKVKVDDLEGFAEGGMIDQETVNTEWETVKSSEPVKETVQTTQSPTPVEKETVVTTQAEVFPPPVAMLQIPVAPAVPTVSLVPPAFPVSMPVPPPGFSPIPPPPFLRASFNPSQPPPGFMPPPVPPPVVPPPTIPPVVPTSLVQPSLSMTPETVKDVGFGSLVIPGGSVASNLATSALPAGNVFNAPTKQAEPEEKVPHLIDHQISSGENTRSVIPNDISSNAAILGGQPPNVTSNSGILGVQRPNVSSNSEILGVRPSNVSSSSGIIAAQPPNILNNSGILGIQPPSVSNSSGLLGVLPPNIPNNSGLVGVQPPNVPNTPGLLGTQPPAGPQNLPPLSIPNQRMPTMPMLDIRPGLIPQAPGPRFPLIQPGIPPQRGIPPPSVLDSALHPPPRGPFPPGDIFSQPERPFLAPGRQSVDNVTNPEKRIPLGNDNIQQEGDRDYRFPPIETRESISRPPPVDVRDVVGRPIDPREGPGRPPLDGRDHFGRPPVDIRENLVRPGIDHLGRRDHFGFNPEKPWGHRGDFDEREHRVLPVYGGPKGLHEERGRFRSGNYRFDPRSGPWNRGFGQEVHRDFDDRRRPWERQRDRDDRDFDFCREMNGNRLGRDRIQNTWVPPPHARVFDYFEGATSQRKGDNVPQVNGENTERHAQPPPIPVQNDPELYEKLTSSNEINKEKSDTVADIESEPVVESTETEGT

SEQ ID NO: 83890 - protein, 1349 aa, Homo sapiens
  Payload ID: 16694
  Gene Symbol: SCAF8
  Gene Name: SR-related CTD-associated factor 8
  ENSP ID: ENSP00000413098
MPQPLLPALPPLSSPSGAGSCGPSGGEVKQEPVGGRGRREWRVAPSSRPRSSPRLALPTQCSGRRLFRRRARGLRSDNMEAVKTFNSELYSLNDYKPPISKAKMTQITKAAIKAIKFYKHVVQSVEKFIQKCKPEYKVPGLYVIDSIVRQSRHQFGQEKDVFAPRFSNNIISTFQNLYRCPGDDKSKIVRVLNLWQKNNVFKSEIIQPLLDMAAGIPPPVVTPVLASTTTAMSNTPGTPVTPVTPANVVQGLPDPWVSQITNTDTLAAVAQILQSPQGQQLQQLIQTLQIQQQKPQPSILQALDAGLVVQLQALTAQLTAAAAAANTLTPLEQGVSFNKKLMDRFDFGEDSEHSEEPKKEIPASQLSHVSESVNNSIFHQIAEQLQQQNLEHLRQQLLEQQQPQKATPQDSQEGTFGSEHSASPSQGSSQQHFLEPEVNLDDSIDIQQQDMDIDEGQDGVEEEVFEQEAKKVAVRSRSRTHSRSRSRSPRKRRSRSRSGSRKRKHRKRSRSRSRERKRKSSRSYSSERRAREREKERQKKGLPPIRSKTLSVCSTTLWVGQVDKKATQQDLTNLFEEFGQIESINMIPPRGCAYVCMVHRQDAFRALQKLSSGSYKIGSKVIKIAWALNKGVKTEYKQFWDVDLGVTYIPWEKVKVDDLEGFAEGGMIDQETVNTEWETVKSSEPVKETVQTTQSPTPVEKETVVTTQAEVFPPPVAMLQIPVAPAVPTVSLVPPAFPVSMPVPPPGFSPIPPPPFLRASFNPSQPPPGFMPPPVPPPVVPPPTIPPVVPTSLVQPSLSMTPETVKDVGFGSLVIPGGSVASNLATSALPAGNVFNAPTKQAEPEEKVPHLIDHQISSGENTRSVIPNDISSNAAILGGQPPNVTSNSGILGVQRPNVSSNSEILGVRPSNVSSSSGIIAAQPPNILNNSGILGIQPPSVSNSSGLLGVLPPNIPNNSGLVGVQPPNVPNTPGLLGTQPPAGPQNLPPLSIPNQRMPTMPMLDIRPGLIPQAPGPRFPLIQPGIPPQRGIPPPSVLDSALHPPPRGPFPPGDIFSQPERPFLAPGRQSVDNVTNPEKRIPLGNDNIQQEGDRDYRFPPIETRESISRPPPVDVRDVVGRPIDPREGPGRPPLDGRDHFGRPPVDIRENLVRPGIDHLGRRDHFGFNPEKPWGHRGDFDEREHRVLPVYGGPKGLHEERGRFRSGNYRFDPRSGPWNRGFGQEVHRDFDDRRRPWERQRDRDDRDFDFCREMNGNRLGRDRIQNTWVPPPHARVFDYFEGATSQRKGDNVPQVNGENTERHAQPPPIPVQNDPELYEKLTSSNEINKEKSDTVADIESEPVVESTETEGT

SEQ ID NO: 83891 - protein, 671 aa, Homo sapiens
  Payload ID: 16695
  Gene Symbol: SRPK1
  Gene Name: SRSF protein kinase 1
  ENSP ID: ENSP00000354674
KGERWSGLRHEGQWSPGRGPVLALQARKKRTKAKKDKAQRKSETQHRGSAPHSESDLPEQEEEILGSDDDEQEDPNDYCKGGYHLVKIGDLFNGRYHVIRKLGWGHFSTVWLSWDIQGKKFVAMKVVKSAEHYTETALDEIRLLKSVRNSDPNDPNREMVVQLLDDFKISGVNGTHICMVFEVLGHHLLKWIIKSNYQGLPLPCVKKIIQQVLQGLDYLHTKCRIIHTDIKPENILLSVNEQYIRRLAAEATEWQRSGAPPPSGSAVSTAPQPKPADKMSKNKKKKLKKKQKRQAELLEKRMQEIEEMEKESGPGQKRPNKQEESESPVERPLKENPPNKMTQEKLEESSTIGQDQTLMERDTEGGAAEINCNGVIEVINYTQNSNNETLRHKEDLHNANDCDVQNLNQESSFLSSQNGDSSTSQETDSCTPITSEVSDTMVCQSSSTVGQSFSEQHISQLQESIRAEIPCEDEQEQEHNGPLDNKGKSTAGNFLVNPLEPKNAEKLKVKIADLGNACWVHKHFTEDIQTRQYRSLEVLIGSGYNTPADIWSTACMAFELATGDYLFEPHSGEEYTRDEDHIALIIELLGKVPRKLIVAGKYSKEFFTKKGDLKHITKLKPWGLFEVLVEKYEWSQEEAAGFTDFLLPMLELIPEKRATAAECLRHPWLNS

SEQ ID NO: 83892 - protein, 826 aa, Homo sapiens
  Payload ID: 16695
  Gene Symbol: SRPK1
  Gene Name: SRSF protein kinase 1
  ENSP ID: ENSP00000362928
MERKGERWSGLRHEGQWSPGRGPGQRRELRLTAAVRFPDVRRPSTEVAPPHTPCLWAAGPRPSVRASSGAGRSRPLFPARPARALGPLQGPALGGRRRPPPARPLTRPETPPAHPARALLCAPWAASPTPAASPSPQPPPRQAPQPGLAPLLGLHPHLGRLLSSTFALHPSLSPAVLALQARKKRTKAKKDKAQRKSETQHRGSAPHSESDLPEQEEEILGSDDDEQEDPNDYCKGGYHLVKIGDLFNGRYHVIRKLGWGHFSTVWLSWDIQGKKFVAMKVVKSAEHYTETALDEIRLLKSVRNSDPNDPNREMVVQLLDDFKISGVNGTHICMVFEVLGHHLLKWIIKSNYQGLPLPCVKKIIQQVLQGLDYLHTKCRIIHTDIKPENILLSVNEQYIRRLAAEATEWQRSGAPPPSGSAVSTAPQPKPADKMSKNKKKKLKKKQKRQAELLEKRMQEIEEMEKESGPGQKRPNKQEESESPVERPLKENPPNKMTQEKLEESSTIGQDQTLMERDTEGGAAEINCNGVIEVINYTQNSNNETLRHKEDLHNANDCDVQNLNQESSFLSSQNGDSSTSQETDSCTPITSEVSDTMVCQSSSTVGQSFSEQHISQLQESIRAEIPCEDEQEQEHNGPLDNKGKSTAGNFLVNPLEPKNAEKLKVKIADLGNACWVHKHFTEDIQTRQYRSLEVLIGSGYNTPADIWSTACMAFELATGDYLFEPHSGEEYTRDEDHIALIIELLGKVPRKLIVAGKYSKEFFTKKGDLKHITKLKPWGLFEVLVEKYEWSQEEAAGFTDFLLPMLELIPEKRATAAECLRHPWLNS

SEQ ID NO: 83893 - protein, 655 aa, Homo sapiens
  Payload ID: 16695
  Gene Symbol: SRPK1
  Gene Name: SRSF protein kinase 1
  Uniprot ID: Q96SB4
  ENSP ID: ENSP00000362931
MERKVLALQARKKRTKAKKDKAQRKSETQHRGSAPHSESDLPEQEEEILGSDDDEQEDPNDYCKGGYHLVKIGDLFNGRYHVIRKLGWGHFSTVWLSWDIQGKKFVAMKVVKSAEHYTETALDEIRLLKSVRNSDPNDPNREMVVQLLDDFKISGVNGTHICMVFEVLGHHLLKWIIKSNYQGLPLPCVKKIIQQVLQGLDYLHTKCRIIHTDIKPENILLSVNEQYIRRLAAEATEWQRSGAPPPSGSAVSTAPQPKPADKMSKNKKKKLKKKQKRQAELLEKRMQEIEEMEKESGPGQKRPNKQEESESPVERPLKENPPNKMTQEKLEESSTIGQDQTLMERDTEGGAAEINCNGVIEVINYTQNSNNETLRHKEDLHNANDCDVQNLNQESSFLSSQNGDSSTSQETDSCTPITSEVSDTMVCQSSSTVGQSFSEQHISQLQESIRAEIPCEDEQEQEHNGPLDNKGKSTAGNFLVNPLEPKNAEKLKVKIADLGNACWVHKHFTEDIQTRQYRSLEVLIGSGYNTPADIWSTACMAFELATGDYLFEPHSGEEYTRDEDHIALIIELLGKVPRKLIVAGKYSKEFFTKKGDLKHITKLKPWGLFEVLVEKYEWSQEEAAGFTDFLLPMLELIPEKRATAAECLRHPWLNS

SEQ ID NO: 83894 - protein, 639 aa, Homo sapiens
  Payload ID: 16695
  Gene Symbol: SRPK1
  Gene Name: SRSF protein kinase 1
  Uniprot ID: Q96SB4
  ENSP ID: ENSP00000391069
MGIFVSFLRSETQHRGSAPHSESDLPEQEEEILGSDDDEQEDPNDYCKGGYHLVKIGDLFNGRYHVIRKLGWGHFSTVWLSWDIQGKKFVAMKVVKSAEHYTETALDEIRLLKSVRNSDPNDPNREMVVQLLDDFKISGVNGTHICMVFEVLGHHLLKWIIKSNYQGLPLPCVKKIIQQVLQGLDYLHTKCRIIHTDIKPENILLSVNEQYIRRLAAEATEWQRSGAPPPSGSAVSTAPQPKPADKMSKNKKKKLKKKQKRQAELLEKRMQEIEEMEKESGPGQKRPNKQEESESPVERPLKENPPNKMTQEKLEESSTIGQDQTLMERDTEGGAAEINCNGVIEVINYTQNSNNETLRHKEDLHNANDCDVQNLNQESSFLSSQNGDSSTSQETDSCTPITSEVSDTMVCQSSSTVGQSFSEQHISQLQESIRAEIPCEDEQEQEHNGPLDNKGKSTAGNFLVNPLEPKNAEKLKVKIADLGNACWVHKHFTEDIQTRQYRSLEVLIGSGYNTPADIWSTACMAFELATGDYLFEPHSGEEYTRDEDHIALIIELLGKVPRKLIVAGKYSKEFFTKKGDLKHITKLKPWGLFEVLVEKYEWSQEEAAGFTDFLLPMLELIPEKRATAAECLRHPWLNS

SEQ ID NO: 83895 - protein, 42 aa, Homo sapiens
  Payload ID: 16695
  Gene Symbol: SRPK1
  Gene Name: SRSF protein kinase 1
  ENSP ID: ENSP00000422886
SIRAEIPCEDEQEQEHNGPLDNKVLLMMPVVCRKIHGWKFSC

SEQ ID NO: 83896 - protein, 155 aa, Homo sapiens
  Payload ID: 16695
  Gene Symbol: SRPK1
  Gene Name: SRSF protein kinase 1
  ENSP ID: ENSP00000424068
MESCCTNQAGLELLASRDPLTTLASQITRITGMGIFVSFLRSETQHRGSAPHSESDLPEQEEEILGSDDDEQEDPNDYCKGGYHLVKIGDLFNGRYHVIRKLGWGHFSTVWLSWDIQGKKFVAMKVVKSAEHYTETALDEIRLLKSVRNSDPNDP

SEQ ID NO: 83897 - protein, 146 aa, Homo sapiens
  Payload ID: 16695
  Gene Symbol: SRPK1
  Gene Name: SRSF protein kinase 1
  ENSP ID: ENSP00000424170
MSKNKKKKLKKKQKRQAELLEKRMQEIEEMEKESGPGQKRPNKQEESESPVERPLKENPPNKMTQEKLEESSTIGQDQTLMERDTEGGAAEINCNGVIEVINYTQNSNNETLRHKEDLHNANDCDVQNLNQESSFLSSQNGDSSTS

SEQ ID NO: 83898 - protein, 118 aa, Homo sapiens
  Payload ID: 16695
  Gene Symbol: SRPK1
  Gene Name: SRSF protein kinase 1
  ENSP ID: ENSP00000424323
MASGQLGGSLSSNHVEESCCCSTPGLGLSSPGPAGKGCRRRTRARPVPFLPNSTEEAQTPLAWTSPPELVDHYRSVSELWSLLPAPQRLNLPPTSSRSETQHRGSAPHSESDLPEQEE

SEQ ID NO: 83899 - protein, 76 aa, Homo sapiens
  Payload ID: 16695
  Gene Symbol: SRPK1
  Gene Name: SRSF protein kinase 1
  ENSP ID: ENSP00000425172
MESCCTNQAGLELLASRDPLTTLASQITRITDLKLSTEALLPTLRVIYQSRKRRFWDLMMMSKKILMIIVKEVIIL

SEQ ID NO: 83900 - protein, 688 aa, Homo sapiens
  Payload ID: 16696
  Gene Symbol: SRPK2
  Gene Name: SRSF protein kinase 2
  Uniprot ID: P78362
  ENSP ID: ENSP00000349863
MSVNSEKSSSSERPEPQQKAPLVPPPPPPPPPPPPPLPDPTPPEPEEEILGSDDEEQEDPADYCKGGYHPVKIGDLFNGRYHVIRKLGWGHFSTVWLCWDMQGKRFVAMKVVKSAQHYTETALDEIKLLKCVRESDPSDPNKDMVVQLIDDFKISGMNGIHVCMVFEVLGHHLLKWIIKSNYQGLPVRCVKSIIRQVLQGLDYLHSKCKIIHTDIKPENILMCVDDAYVRRMAAEATEWQKAGAPPPSGSAVSTAPQQKPIGKISKNKKKKLKKKQKRQAELLEKRLQEIEELEREAERKIIEENITSAAPSNDQDGEYCPEVKLKTTGLEEAAEAETAKDNGEAEDQEEKEDAEKENIEKDEDDVDQELANIDPTWIESPKTNGHIENGPFSLEQQLDDEDDDEEDCPNPEEYNLDEPNAESDYTYSSSYEQFNGELPNGRHKIPESQFPEFSTSLFSGSLEPVACGSVLSEGSPLTEQEESSPSHDRSRTVSASSTGDLPKAKTRAADLLVNPLDPRNADKIRVKIADLGNACWVHKHFTEDIQTRQYRSIEVLIGAGYSTPADIWSTACMAFELATGDYLFEPHSGEDYSRDEDHIAHIIELLGSIPRHFALSGKYSREFFNRRGELRHITKLKPWSLFDVLVEKYGWPHEDAAQFTDFLIPMLEMVPEKRASAGECLRHPWLNS

SEQ ID NO: 83901 - protein, 699 aa, Homo sapiens
  Payload ID: 16696
  Gene Symbol: SRPK2
  Gene Name: SRSF protein kinase 2
  Uniprot ID: P78362
  ENSP ID: ENSP00000377262
MSSRKVLAIQARKRRPKREKHPKKPEPQQKAPLVPPPPPPPPPPPPPLPDPTPPEPEEEILGSDDEEQEDPADYCKGGYHPVKIGDLFNGRYHVIRKLGWGHFSTVWLCWDMQGKRFVAMKVVKSAQHYTETALDEIKLLKCVRESDPSDPNKDMVVQLIDDFKISGMNGIHVCMVFEVLGHHLLKWIIKSNYQGLPVRCVKSIIRQVLQGLDYLHSKCKIIHTDIKPENILMCVDDAYVRRMAAEATEWQKAGAPPPSGSAVSTAPQQKPIGKISKNKKKKLKKKQKRQAELLEKRLQEIEELEREAERKIIEENITSAAPSNDQDGEYCPEVKLKTTGLEEAAEAETAKDNGEAEDQEEKEDAEKENIEKDEDDVDQELANIDPTWIESPKTNGHIENGPFSLEQQLDDEDDDEEDCPNPEEYNLDEPNAESDYTYSSSYEQFNGELPNGRHKIPESQFPEFSTSLFSGSLEPVACGSVLSEGSPLTEQEESSPSHDRSRTVSASSTGDLPKAKTRAADLLVNPLDPRNADKIRVKIADLGNACWVHKHFTEDIQTRQYRSIEVLIGAGYSTPADIWSTACMAFELATGDYLFEPHSGEDYSRDEDHIAHIIELLGSIPRHFALSGKYSREFFNRRGELRHITKLKPWSLFDVLVEKYGWPHEDAAQFTDFLIPMLEMVPEKRASAGECLRHPWLNS

SEQ ID NO: 83902 - protein, 160 aa, Homo sapiens [sequence omitted]

SEQ ID NO: 83903 - protein, 68 aa, Homo sapiens
  Payload ID: 16696
  Gene Symbol: SRPK2
  Gene Name: SRSF protein kinase 2
  ENSP ID: ENSP00000417446
MSSRKVLAIQARKRRPKREKHPKKWSTSCCFKGRRLLTAFLHEISKEVLVFFLPGSSIDQEDDSDVVS

SEQ ID NO: 83904 - protein, 147 aa, Homo sapiens
  Payload ID: 16696
  Gene Symbol: SRPK2
  Gene Name: SRSF protein kinase 2
  ENSP ID: ENSP00000417946
MAFELATGDYLFEPHSGEDYSRDEDHIAHIIELLGSIPRHFALSGKYSREFFNRRDHIALIIELLGKVPRKYAMLGKYSKEFFTRKGELRHITKLKPWSLFDVLVEKYGWPHEDAAQFTDFLIPMLEMVPEKRASAGECLRHPWLNS

SEQ ID NO: 83905 - protein, 204 aa, Homo sapiens
  Payload ID: 16696
  Gene Symbol: SRPK2
  Gene Name: SRSF protein kinase 2
  ENSP ID: ENSP00000418786
  MOD_RES (1)..(1): Any amino acid
XDPRNADKIRVKIADLGNACWVHKHFTEDIQTRQYRSIEVLIGAGYSTPADIWSTACMAFELATGDYLFEPHSGEDYSRDEDHIAHIIELLGSIPRHFALSGKYSREFFNRRDHIALIIELLGKVPRKYAMLGKYSKEFFTRKGELRHITKLKPWSLFDVLVEKYGWPHEDAAQFTDFLIPMLEMVPEKRASAGECLRHPWLNS

SEQ ID NO: 83906 - protein, 231 aa, Homo sapiens [sequence omitted]

SEQ ID NO: 83907 - protein, 688 aa, Homo sapiens; identical to SEQ ID NO: 83900
  Payload ID: 16696
  Gene Symbol: SRPK2
  Gene Name: SRSF protein kinase 2
  Uniprot ID: P78362
  ENSP ID: ENSP00000419791

SEQ ID NO: 83908 - protein, 295 aa, Homo sapiens
  Payload ID: 16696
  Gene Symbol: SRPK2
  Gene Name: SRSF protein kinase 2
  ENSP ID: ENSP00000420208
  MOD_RES (1)..(1): Any amino acid
XEQQLDDEDDDEEDCPNPEEYNLDEPNAESDYTYSSSYEQFNGELPNGRHKIPESQFPEFSTSLFSGSLEPVACGSVLSEGSPLTEQEESSPSHDRSRTVSASSTGDLPKAKTRAADLLVNPLDPRNADKIRVKIADLGNACWVHKHFTEDIQTRQYRSIEVLIGAGYSTPADIWSTACMAFELATGDYLFEPHSGEDYSRDEDHIALIIELLGKVPRKYAMLGKYSKEFFTRKGELRHITKLKPWSLFDVLVEKYGWPHEDAAQFTDFLIPMLEMVPEKRASAGECLRHPWLNS

SEQ ID NO: 83909 - protein, 492 aa, Homo sapiens
  Payload ID: 16697
  Gene Symbol: SRPK3
  Gene Name: SRSF protein kinase 3
  ENSP ID: ENSP00000359118
MLQGLLGSDDEEQEDPKDYCKGGYHPVKIGDVFNGRYHVVRKLGWGHFSTVWLCWDIQRKRFVALKVVKSAGHYTETAVDEIKLLKCVRDSDPSDPKRETIVQLIDDFRISGVNGVHVCMVLEVLGHQLLKWIIKSNYQGLPVPCVKSIVRQVLHGLDYLHTKCKIIHTDIKPENILLCVGDAYIRRLAAEATEWQQAGAPPPSRSIVSTAPQEVLTGKLSKNKRKKMRRKRKQQKRLLEERLRDLQRLEAMEAATQAEDSGLRLDGGSGSTSSSGCFSGSLFSPASCSILSGSSNQRETGGLLSPSTPFGASNLLVNPLEPQNADKIKIKIADLGNACWVHKHFTEDIQTRQYRAVEVLIGAEYGPPADIWSTACMAFELATGDYLFEPHSGEDYSRDEDHIAHIVELLGDIPPAFALSGRYSREFFNRRGELRHIHNLKHWGLYEVLMEKYEWPLEQATQFSAFLLPMMEYIPEKRASAADCLQHPWLNP

SEQ ID NO: 83910 - protein, 567 aa, Homo sapiens
  Payload ID: 16697
  Gene Symbol: SRPK3
  Gene Name: SRSF protein kinase 3
  Uniprot ID: Q9UPE1
  ENSP ID: ENSP00000359119
MSASTGGGGDSGGSGGSSSSSQASCGPESSGSELALATPVPQMLQGLLGSDDEEQEDPKDYCKGGYHPVKIGDVFNGRYHVVRKLGWGHFSTVWLCWDIQRKRFVALKVVKSAGHYTETAVDEIKLLKCVRDSDPSDPKRETIVQLIDDFRISGVNGVHVCMVLEVLGHQLLKWIIKSNYQGLPVPCVKSIVRQVLHGLDYLHTKCKIIHTDIKPENILLCVGDAYIRRLAAEATEWQQAGAPPPSRSIVSTAPQEVLQTGKLSKNKRKKMRRKRKQQKRLLEERLRDLQRLEAMEAATQAEDSGLRLDGGSGSTSSSGCHPGGARAGPSPASSSPAPGGGRSLSAGSQTSGFSGSLFSPASCSILSGSSNQRETGGLLSPSTPFGASNLLVNPLEPQNADKIKIKIADLGNACWVHKHFTEDIQTRQYRAVEVLIGAEYGPPADIWSTACMAFELATGDYLFEPHSGEDYSRDEDHIAHIVELLGDIPPAFALSGRYSREFFNRRGELRHIHNLKHWGLYEVLMEKYEWPLEQATQFSAFLLPMMEYIPEKRASAADCLQHPWLNP

SEQ ID NO: 83911 - protein, 566 aa, Homo sapiens
  Payload ID: 16697
  Gene Symbol: SRPK3
  Gene Name: SRSF protein kinase 3
  Uniprot ID: Q9UPE1
  ENSP ID: ENSP00000359122
MSASTGGGGDSGGSGGSSSSSQASCGPESSGSELALATPVPQMLQGLLGSDDEEQEDPKDYCKGGYHPVKIGDVFNGRYHVVRKLGWGHFSTVWLCWDIQRKRFVALKVVKSAGHYTETAVDEIKLLKCVRDSDPSDPKRETIVQLIDDFRISGVNGVHVCMVLEVLGHQLLKWIIKSNYQGLPVPCVKSIVRQVLHGLDYLHTKCKIIHTDIKPENILLCVGDAYIRRLAAEATEWQQAGAPPPSRSIVSTAPQEVLTGKLSKNKRKKMRRKRKQQKRLLEERLRDLQRLEAMEAATQAEDSGLRLDGGSGSTSSSGCHPGGARAGPSPASSSPAPGGGRSLSAGSQTSGFSGSLFSPASCSILSGSSNQRETGGLLSPSTPFGASNLLVNPLEPQNADKIKIKIADLGNACWVHKHFTEDIQTRQYRAVEVLIGAEYGPPADIWSTACMAFELATGDYLFEPHSGEDYSRDEDHIAHIVELLGDIPPAFALSGRYSREFFNRRGELRHIHNLKHWGLYEVLMEKYEWPLEQATQFSAFLLPMMEYIPEKRASAADCLQHPWLNP

SEQ ID NO: 83912 - protein, 534 aa, Homo sapiens
  Payload ID: 16697
  Gene Symbol: SRPK3
  Gene Name: SRSF protein kinase 3
  ENSP ID: ENSP00000359126
MSASTGGGGDSGGSGGSSSSSQASCGPESSGSELALATPVPQMLQGLLGSDDEEQEDPKDYCKGGYHPVKIGDVFNGRYHVVRKLGWGHFSTVWLCWDIQRKRFVALKVVKSAGHYTETAVDEIKLLKCVRDSDPSDPKRETIVQLIDDFRISGVNGVHVCMVLEVLGHQLLKWIIKSNYQGLPVPCVKSIVRQVLHGLDYLHTKCKIIHTDIKPENILLCVGDAYIRRLAAEATEWQQAGAPPPSRSIVSTAPQEVLTGKLSKNKRKKMRRKRKQQKRLLEERLRDLQRLEAMEAATQAEDSGLRLDGGSGSTSSSGCFSGSLFSPASCSILSGSSNQRETGGLLSPSTPFGASNLLVNPLEPQNADKIKIKIADLGNACWVHKHFTEDIQTRQYRAVEVLIGAEYGPPADIWSTACMAFELATGDYLFEPHSGEDYSRDEDHIAHIVELLGDIPPAFALSGRYSREFFNRRGELRHIHNLKHWGLYEVLMEKYEWPLEQATQFSAFLLPMMEYIPEKRASAADCLQHPWLNP

SEQ ID NO: 83913 - protein, 533 aa, Homo sapiens
  Payload ID: 16697
  Gene Symbol: SRPK3
  Gene Name: SRSF protein kinase 3
  Uniprot ID: Q9UPE1
  ENSP ID: ENSP00000377376
MSASTGGGGDSGGSGGSSSSSQASCGPESSGSELALATPVPQMLQGLLGSDDEEQEDPKDYCKGGYHPVKIGDVFNGRYHVVRKLGWGHFSTVWLCWDIQRKRFVALKVVKSAGHYTETAVDEIKLLKCVRDSDPSDPKRETIVQLIDDFRISGVNGVHVCMVLEVLGHQLLKWIIKSNYQGLPVPCVKSIVRQVLHGLDYLHTKCKIIHTDIKPENILLCVGDAYIRRLAAEATEWQQAGAPPPSRSIVSTAPQEVLTGKLSKNKRKKMRRKRKQQKRLLEERLRDLQRLEAMEAATQAEDSGLRLDGGSGSTSSSGFSGSLFSPASCSILSGSSNQRETGGLLSPSTPFGASNLLVNPLEPQNADKIKIKIADLGNACWVHKHFTEDIQTRQYRAVEVLIGAEYGPPADIWSTACMAFELATGDYLFEPHSGEDYSRDEDHIAHIVELLGDIPPAFALSGRYSREFFNRRGELRHIHNLKHWGLYEVLMEKYEWPLEQATQFSAFLLPMMEYIPEKRASAADCLQHPWLNP

SEQ ID NO: 83914 - protein, 205 aa, Homo sapiens
  Payload ID: 16697
  Gene Symbol: SRPK3
  Gene Name: SRSF protein kinase 3
  ENSP ID: ENSP00000402300
  MOD_RES (1)..(1): Any amino acid
XAAAAAAVAAGRARLGHPEPLASLMPTATHPTRSSQASCGPESSGSELALATPVPQMLQGLLGSDDEEQEDPKDYCKGGYHPVKIGDVFNGRYHVVRKLGWGHFSTVWLCWDIQRKRFVALKVVKSAGHYTETAVDEIKLLKCVRDSDPSDPKRETIVQLIDDFRISGVNGVHVCMVLEVLGHQLLKWIIKSNYQGLPVPCVKSI

SEQ ID NO: 83915 - protein, 129 aa, Homo sapiens
  Payload ID: 16697
  Gene Symbol: SRPK3
  Gene Name: SRSF protein kinase 3
  ENSP ID: ENSP00000406166
  MOD_RES (1)..(1): Any amino acid
XTALAPARPQGSPCFQHKHFTEDIQTRQYRAVEVLIGAEYGPPADIWSTACMAFELATGDYLFEPHSGEDYSRDEDHIAHIVELLGDIPPAFALSGRYSREFFNRRGELRHIHNLKHWGLYEVLMEKYE

SEQ ID NO: 83916 - protein, 634 aa, Homo sapiens
  Payload ID: 16697
  Gene Symbol: SRPK3
  Gene Name: SRSF protein kinase 3
  ENSP ID: ENSP00000420058
MMQPLGHRPLSHHRTHGEVAMGLLVPSSEQLPAASLMSGYGAAHDRHLANGGEEEQALGARAPGSVAGAGSGLASSQASPQQACCLCSQASCGPESSGSELALATPVPQMLQGLLGSDDEEQEDPKDYCKGGYHPVKIGDVFNGRYHVVRKLGWGHFSTVWLCWDIQRKRFVALKVVKSAGHYTETAVDEIKLLKCVRDSDPSDPKRETIVQLIDDFRISGVNGVHVCMVLEVLGHQLLKWIIKSNYQGLPVPCVKSIVRQVLHGLDYLHTKCKIIHTDIKPENILLCVGDAYIRRLAAEATEWQQAGAPPPSRSIVSTAPQEVLQTGKLSKNKRKKMRRKRKQQKRLLEERLRDLQRLEAMEAATQAEDSGLRLDGGSGSTSSSGCHPGGARAGPSPASSSPAPGGGRSLSAGSQTSGFSGSLFSPASCSILSGSSNQRETGGLLSPSTPFGASNLLVNPLEPQNADKIKIKIADLGNACWVHKHFTEDIQTRQYRAVEVLIGAEYGPPADIWSTACMAFELATGDYLFEPHSGEDYSRDEDHIAHIVELLGDIPPAFALSGRYSREFFNRRGELRHIHNLKHWGLYEVLMEKYEWPLEQATQFSAFLLPMMEYIPEKRASAADCLQHPWLNP

SEQ ID NO: 83917 - protein, 391 aa, Homo sapiens
  Payload ID: 16698
  Gene Symbol: SOX1
  Gene Name: SRY (sex determining region Y)-box 1
  Uniprot ID: O00570
  ENSP ID: ENSP00000330218
MYSMMMETDLHSPGGAQAPTNLSGPAGAGGGGGGGGGGGGGGGAKANQDRVKRPMNAFMVWSRGQRRKMAQENPKMHNSEISKRLGAEWKVMSEAEKRPFIDEAKRLRALHMKEHPDYKYRPRRKTKTLLKKDKYSLAGGLLAAGAGGGGAAVAMGVGVGVGAAAVGQRLESPGGAAGGGYAHVNGWANGAYPGSVAAAAAAAAMMQEAQLAYGQHPGAGGAHPHAHPAHPHPHHPHAHPHNPQPMHRYDMGALQYSPISNSQGYMSASPSGYGGLPYGAAAAAAAAAGGAHQNSAVAAAAAAAAASSGALGALGSLVKSEPSGSPPAPAHSRAPCPGDLREMISMYLPAGEGGDPAAAAAAAAQSRLHSLPQHYQGAGAGVNGTVPLTHI

SEQ ID NO: 83918 - protein, 466 aa, Homo sapiens
  Payload ID: 16699
  Gene Symbol: SOX10
  Gene Name: SRY (sex determining region Y)-box 10
  Uniprot ID: P56693
  ENSP ID: ENSP00000354130
MAEEQDLSEVELSPVGSEEPRCLSPGSAPSLGPDGGGGGSGLRASPGPGELGKVKKEQQDGEADDDKFPVCIREAVSQVLSGYDWTLVPMPVRVNGASKSKPHVKRPMNAFMVWAQAARRKLADQYPHLHNAELSKTLGKLWRLLNESDKRPFIEEAERLRMQHKKDHPDYKYQPRRRKNGKAAQGEAECPGGEAEQGGTAAIQAHYKSAHLDHRHPGEGSPMSDGNPEHPSGQSHGPPTPPTTPKTELQSGKADPKRDGRSMGEGGKPHIDFGNVDIGEISHEVMSNMETFDVAELDQYLPPNGHPGHVSSYSAAGYGLGSALAVASGHSAWISKPPGVALPTVSPPGVDAKAQVKTETAGPQGPPHYTDQPSTSQIAYTSLSLPHYGSAFPSISRPQFDYSDHQPSGPYYGHSGQASGLYSAFSYMGPSQRPLYTAISDPSPSGPQSHSPTHWEQPVYTTLSRP

SEQ ID NO: 83919 - protein, 466 aa, Homo sapiens; identical to SEQ ID NO: 83918
  Payload ID: 16699
  Gene Symbol: SOX10
  Gene Name: SRY (sex determining region Y)-box 10
  Uniprot ID: P56693
  ENSP ID: ENSP00000380093

SEQ ID NO: 83920 - protein, 179 aa, Homo sapiens
  Payload ID: 16699
  Gene Symbol: SOX10
  Gene Name: SRY (sex determining region Y)-box 10
  ENSP ID: ENSP00000399777
  MOD_RES (1)..(1): Any amino acid
XQYPHLHNAELSKTLGKLWRLLNESDKRPFIEEAERLRMQHKKDHPDYKYQPRRRKNGKAAQGEAECPGGEAEQGGTAAIQAHYKSAHLDHRHPGEGSPMSDGNPEHPSGQSHGPPTPPTTPKTELQSGKADPKRDGRSMGEGGKPHIDFGNVDIGEISHEMGKLKFARLMLRSAGARI

SEQ ID NO: 83921 - protein, 213 aa, Homo sapiens
  Payload ID: 16699
  Gene Symbol: SOX10
  Gene Name: SRY (sex determining region Y)-box 10
  ENSP ID: ENSP00000414853
MAEEQDLSEVELSPVGSEEPRCLSPGSAPSLGPDGGGGGSGLRASPGPGELGKVKKEQQDGEADDDKFPVCIREAVSQVLSGYDWTLVPMPVRVNGASKSKPHVKRPMNAFMVWAQAARRKLADQYPHLHNAELSKTLGKLWRLLNESDKRPFIEEAERLRMQHKKDHPDYKYQPRRRKNGKAAQGEAECPGGEAEQGGTAAIQAHYKSAHLD

SEQ ID NO: 83922 - protein, 441 aa, Homo sapiens
  Payload ID: 16700
  Gene Symbol: SOX11
  Gene Name: SRY (sex determining region Y)-box 11
  Uniprot ID: P35716
  ENSP ID: ENSP00000322568
MVQQAESLEAESNLPREALDTEEGEFMACSPVALDESDPDWCKTASGHIKRPMNAFMVWSKIERRKIMEQSPDMHNAEISKRLGKRWKMLKDSEKIPFIREAERLRLKHMADYPDYKYRPRKKPKMDPSAKPSASQSPEKSAAGGGGGSAGGGAGGAKTSKGSSKKCGKLKAPAAAGAKAGAGKAAQSGDYGGAGDDYVLGSLRVSGSGGGGAGKTVKCVFLDEDDDDDDDDDELQLQIKQEPDEEDEEPPHQQLLQPPGQQPSQLLRRYNVAKVPASPTLSSSAESPEGASLYDEVRAGATSGAGGGSRLYYSFKNITKQHPPPLAQPALSPASSRSVSTSSSSSSGSSSGSSGEDADDLMFDLSLNFSQSAHSASEQQLGGGAAAGNLSLSLVDKDLDSFSEGSLGSHFEFPDYCTPELSEMIAGDWLEANFSDLVFTY

SEQ ID NO: 83923 - protein, 315 aa, Homo sapiens
  Payload ID: 16701
  Gene Symbol: SOX12
  Gene Name: SRY (sex determining region Y)-box 12
  Uniprot ID: O15370
  ENSP ID: ENSP00000347646
MVQQRGARAKRDGGPPPPGPGPAEEGAREPGWCKTPSGHIKRPMNAFMVWSQHERRKIMDQWPDMHNAEISKRLGRRWQLLQDSEKIPFVREAERLRLKHMADYPDYKYRPRKKSKGAPAKARPRPPGGSGGGSRLKPGPQLPGRGGRRAAGGPLGGGAAAPEDDDEDDDEELLEVRLVETPGRELWRMVPAGRAARGQAERAQGPSGEGAAAAAAASPTPSEDEEPEEEEEEAAAAEEGEEETVASGEESLGFLSRLPPGPAGLDCSALDRDPDLQPPSGTSHFEFPDYCTPEVTEMIAGDWRPSSIADLVFTY

SEQ ID NO: 83924 - protein, 622 aa, Homo sapiens
  Payload ID: 16702
  Gene Symbol: SOX13
  Gene Name: SRY (sex determining region Y)-box 13
  Uniprot ID: Q9UN79
  ENSP ID: ENSP00000356172
MSMRSPISAQLALDGVGTMVNCTIKSEEKKEPCHEAPQGSATAAEPQPGDPARASQDSADPQAPAQGNFRGSWDCSSPEGNGSPEPKRPGVSEAASGSQEKLDFNRNLKEVVPAIEKLLSSDWKERFLGRNSMEAKDVKGTQESLAEKELQLLVMIHQLSTLRDQLLTAHSEQKNMAAMLFEKQQQQMELARQQQEQIAKQQQQLIQQQHKINLLQQQIQQVNMPYVMIPAFPPSHQPLPVTPDSQLALPIQPIPCKPVEYPLQLLHSPPAPVVKRPGAMATHHPLQEPSQPLNLTAKPKAPELPNTSSSPSLKMSSCVPRPPSHGGPTRDLQSSPPSLPLGFLGEGDAVTKAIQDARQLLHSHSGALDGSPNTPFRKDLISLDSSPAKERLEDGCVHPLEEAMLSCDMDGSRHFPESRNSSHIKRPMNAFMVWAKDERRKILQAFPDMHNSSISKILGSRWKSMTNQEKQPYYEEQARLSRQHLEKYPDYKYKPRPKRTCIVEGKRLRVGEYKALMRTRRQDARQSYVIPPQAGQVQMSSSDVLYPRAAGMPLAQPLVEHYVPRSLDPNMPVIVNTCSLREEGEGTDDRHSVADGEMYRYSEDEDSEGEEKSDGELVVLTD

SEQ ID NO: 83925 - protein, 57 aa, Homo sapiens
  Payload ID: 16702
  Gene Symbol: SOX13
  Gene Name: SRY (sex determining region Y)-box 13
  ENSP ID: ENSP00000433595
MSMRSPISAQLALDGVGTMVNCTIKSEEKKEPCHEAPQGSATAAEPQPGDPARASQD

SEQ ID NO: 83926 - protein, 128 aa, Homo sapiens
  Payload ID: 16702
  Gene Symbol: SOX13
  Gene Name: SRY (sex determining region Y)-box 13
  ENSP ID: ENSP00000434093
  MOD_RES (1)..(1): Any amino acid
XTQESLAEKELQLLVMIHQLSTLRDQLLTAHSEQKNMAAMLFEKQQQQMELARQQQEQIAKQQQQLIQQQHKINLLQQQIQQVNMPYVMIPAFPPSHQPLPVTPDSQLALPIQPIPCKPGLFSLLPFP

SEQ ID NO: 83927 - protein, 179 aa, Homo sapiens
  Payload ID: 16702
  Gene Symbol: SOX13
  Gene Name: SRY (sex determining region Y)-box 13
  ENSP ID: ENSP00000436297
MSMRSPISAQLALDGVGTMVNCTIKSEEKKEPCHEAPQGSATAAEPQPGDPARASQDSADPQAPAQGNFRGSWDCSSPEGNGSPEPKRPGVSEAASGSQEKLDFNRNLKEVVPAIEKLLSSDWKERFLGRNSMEAKDVKGTQESLAEKELQLLVMIHQLSTLRDQLLTAHSEQKNMAAM

SEQ ID NO: 83928 - protein, 622 aa, Homo sapiens; identical to SEQ ID NO: 83924
  Payload ID: 16702
  Gene Symbol: SOX13
  Gene Name: SRY (sex determining region Y)-box 13
  Uniprot ID: Q9UN79
  ENSP ID: ENSP00000478239

SEQ ID NO: 83929 - protein, 240 aa, Homo sapiens
  Payload ID: 16703
  Gene Symbol: SOX14
  Gene Name: SRY (sex determining region Y)-box 14
  Uniprot ID: O95416
  ENSP ID: ENSP00000305343
MSKPSDHIKRPMNAFMVWSRGQRRKMAQENPKMHNSEISKRLGAEWKLLSEAEKRPYIDEAKRLRAQHMKEHPDYKYRPRRKPKNLLKKDRYVFPLPYLGDTDPLKAAGLPVGASDGLLSAPEKARAFLPPASAPYSLLDPAQFSSSAIQKMGEVPHTLATGALPYASTLGYQNGAFGSLSCPSQHTHTHPSPTNPGYVVPCNCTAWSASTLQPPVAYILFPGMTKTGIDPYSSAHATAM

SEQ ID NO: 83930 - protein, 233 aa, Homo sapiens [sequence omitted]

SEQ ID NO: 83931 - protein, 233 aa, Homo sapiens [sequence omitted]

SEQ ID NO: 83932 - protein, 178 aa, Homo sapiens
  Payload ID: 16704
  Gene Symbol: SOX15
  Gene Name: SRY (sex determining region Y)-box 15
  Uniprot ID: O60248
  ENSP ID: ENSP00000458286
MALPGSSQDQAWSLEPPAATAAASSSSGPQEREGAGSPAAPGTLPLEKVKRPMNAFMVWSSAQRRQMAQQNPKMHNSEISKRLGAQWKLLDEDEKRPFVEEAKRLRARHLRDYPDYKYRPRRKAKSSGAGPSRCGQGRGNLASGGPLWGPGYATTQPSRGFGYRPPSYSTAYLPGSYG

SEQ ID NO: 83933 - protein, 414 aa, Homo sapiens [sequence omitted]

SEQ ID NO: 83934 - protein, 384 aa, Homo sapiens [sequence omitted]

SEQ ID NO: 83935 - protein, 317 aa, Homo sapiens
  Payload ID: 16707
  Gene Symbol: SOX2
  Gene Name: SRY (sex determining region Y)-box 2
  Uniprot ID: P48431
  ENSP ID: ENSP00000323588
MYNMMETELKPPGPQQTSGGGGGNSTAAAAGGNQKNSPDRVKRPMNAFMVWSRGQRRKMAQENPKMHNSEISKRLGAEWKLLSETEKRPFIDEAKRLRALHMKEHPDYKYRPRRKTKTLMKKDKYTLPGGLLAPGGNSMASGVGVGAGLGAGVNQRMDSYAHMNGWSNGSYSMMQDQLGYPQHPGLNAHGAAQMQPMHRYDVSALQYNSMTSSQTYMNGSPTYSMSYSQQGTPGMALGSMGSVVKSEASSSPPVVTSSSHSRAPCQAGDLRDMISMYLPGAEVPEPAAPSRLHMSQHYQSGPVPGTAINGTLPLSHM

SEQ ID NO: 83936 - protein, 276 aa, Homo sapiens
  Payload ID: 16708
  Gene Symbol: SOX21
  Gene Name: SRY (sex determining region Y)-box 21
  Uniprot ID: Q9Y651
  ENSP ID: ENSP00000366144
MSKPVDHVKRPMNAFMVWSRAQRRKMAQENPKMHNSEISKRLGAEWKLLTESEKRPFIDEAKRLRAMHMKEHPDYKYRPRRKPKTLLKKDKFAFPVPYGLGGVADAEHPALKAGAGLHAGAGGGLVPESLLANPEKAAAAAAAAAARVFFPQSAAAAAAAAAAAAAGSPYSLLDLGSKMAEISSSSSGLPYASSLGYPTAGAGAFHGAAAAAAAAAAAAGGHTHSHPSPGNPGYMIPCNCSAWPSPGLQPPLAYILLPGMGKPQLDPYPAAYAAAL

SEQ ID NO: 83937 - protein, 446 aa, Homo sapiens
  Payload ID: 16709
  Gene Symbol: SOX3
  Gene Name: SRY (sex determining region Y)-box 3
  Uniprot ID: P41225
  ENSP ID: ENSP00000359567
MRPVRENSSGARSPRVPADLARSILISLPFPPDSLAHRPPSSAPTESQGLFTVAAPAPGAPSPPATLAHLLPAPAMYSLLETELKNPVGTPTQAAGTGGPAAPGGAGKSSANAAGGANSGGGSSGGASGGGGGTDQDRVKRPMNAFMVWSRGQRRKMALENPKMHNSEISKRLGADWKLLTDAEKRPFIDEAKRLRAVHMKEYPDYKYRPRRKTKTLLKKDKYSLPSGLLPPGAAAAAAAAAAAAAAASSPVGVGQRLDTYTHVNGWANGAYSLVQEQLGYAQPPSMSSPPPPPALPPMHRYDMAGLQYSPMMPPGAQSYMNVAAAAAAASGYGGMAPSATAAAAAAYGQQPATAAAAAAAAAAMSLGPMGSVVKSEPSSPPPAIASHSQRACLGDLRDMISMYLPPGGDAADAASPLPGGRLHGVHQHYQGAGTAVNGTVPLTHI

SEQ ID NO: 83938 - protein, 753 aa, Homo sapiens [sequence omitted]

SEQ ID NO: 83939 - protein, 501 aa, Homo sapiens
  Payload ID: 16710
  Gene Symbol: SOX30
  Gene Name: SRY (sex determining region Y)-box 30
  Uniprot ID: O94993
  ENSP ID: ENSP00000309343
MERARPEPPPQPRPLRPAPPPLPVEGTSFWAAAMEPPPSSPTLSAAASATLASSCGEAVASGLQPAVRRLLQVKPEQVLLLPQPQAQNEEAAASSAQARLLQFRPDLRLLQPPTASDGATSRPELHPVQPLALHVKAKKQKLGPSLDQSVGPRGAVETGPRASRVVKLEGPGPALGYFRGDEKGKLEAEEVMRDSMQGGAGKSPAAIREGVIKTEEPERLLEDCRLGAEPASNGLVHGSAEVILAPTSGAFGPHQQDLRIPLTLHTVPPGARIQFQGAPPSELIRLTKVPLTPVPTKMQSLLEPSVKIETKDVPLTVLPSDAGIPDTPFSKDRNGHVKRPMNAFMVWARIHRPALAKANPAANNAEISVQLGLEWNKLSEEQKKPYYDEAQKIKEKHREEFPGWVYQPRPGKRKRFPLSVSNVFSGTTQNIISTNPTTVYPYRSPTYSVVIPSLQNPITHPVVHALTVGLPLAMEIFRVQCQNALVIMKTGTQNMRVSFQL

SEQ ID NO: 83940 - protein, 448 aa, Homo sapiens
  Payload ID: 16710
  Gene Symbol: SOX30
  Gene Name: SRY (sex determining region Y)-box 30
  ENSP ID: ENSP00000427984
MEKCCRGKEQSLLCIQQGIPDTPFSKDRNGHVKRPMNAFMVWARIHRPALAKANPAANNAEISVQLGLEWNKLSEEQKKPYYDEAQKIKEKHREEFPGWVYQPRPGKRKRFPLSVSNVFSGTTQNIISTNPTTVYPYRSPTYSVVIPSLQNPITHPVGETSPAIQLPTPAVQSPSPVTLFQPSVSSAAQVAVQDPSLPVYPALPPQRFTGPSQTDTHQLHSEATHTVKQPTPVSLESANRISSSASTAHARFATSTIQPPREYSSVSPCPRSAPIPQASPIPHPHVYQPPPLGHPATLFGTPPRFSFHHPYFLPGPHYFPSSTCPYSRPPFGYGNFPSSMPECLSYYEDRYPKHEGIFSTLNRDYSFRDYSSECTHSENSRSCENMNGTSYYNSHSHSGEENLNPVPQLDIGTLENVFTAPTSTPSSIQQVNVTDSDEEEEEKVLRDL

SEQ ID NO: 83941 - protein, 474 aa, Homo sapiens
  Payload ID: 16711
  Gene Symbol: SOX4
  Gene Name: SRY (sex determining region Y)-box 4
  Uniprot ID: Q06945
  ENSP ID: ENSP00000244745
MVQQTNNAENTEALLAGESSDSGAGLELGIASSPTPGSTASTGGKADDPSWCKTPSGHIKRPMNAFMVWSQIERRKIMEQSPDMHNAEISKRLGKRWKLLKDSDKIPFIREAERLRLKHMADYPDYKYRPRKKVKSGNANSSSSAAASSKPGEKGDKVGGSGGGGHGGGGGGGSSNAGGGGGGASGGGANSKPAQKKSCGSKVAGGAGGGVSKPHAKLILAGGGGGGKAAAAAAASFAAEQAGAAALLPLGAAADHHSLYKARTPSASASASSAASASAALAAPGKHLAEKKVKRVYLFGGLGTSSSPVGGVGAGADPSDPLGLYEEEGAGCSPDAPSLSGRSSAASSPAAGRSPADHRGYASLRAASPAPSSAPSHASSSASSHSSSSSSSGSSSSDDEFEDDLLDLNPSSNFESMSLGSFSSSSALDRDLDFNFEPGSGSHFEFPDYCTPEVSEMISGDWLESSISNLVFTY

SEQ ID NO: 83942 - protein, 509 aa, Homo sapiens
  Payload ID: 16712
  Gene Symbol: SOX5
  Gene Name: SRY (sex determining region Y)-box 5
  ENSP ID: ENSP00000356174
MSVMSSKRPASPYGEADGEVAMVTSRQKVEEEESDGLPAFHLPLHVSFPNKPHSEEFQPVSLLTQETCGHRTPTSQHNTMEVDGNKVMSSFAPHNSSTSPQKAEEGGRQSGESLSSTALGTPERRKGSLADVVDTLKQRKMEELIKNEPEETPSIEKLLSKDWKDKLLAMGSGNFGEIKGTPESLAEKERQLMGMINQLTSLREQLLAAHDEQKKLAASQIEKQRQQMELAKQQQEQIARQQQQLLQQQHKINLLQQQIQVQGQLPPLMIPVFPPDQRTLAAAAQQGFLLPPGFSYKAGCSDPYPVQLIPTTMAAAAAATPGLGPLQLQQLYAAQLAAMQVSPGGKLPGIPQGNLGAAVSPTSIHTDKSTNSPPPKSKDEVAQPLNLSAKPKTSDGKSPTSPTSPHMPALRINSGAGPLKASVPAALASPSARVSTIGYLNDHDAVTKAIQEARQMKEQLRREQQVLDGKVAVVNSLGLNNCRTEKEVLESQSQEFIGNPEGVVAMNPT

SEQ ID NO: 83943 - protein, 642 aa, Homo sapiens
  Payload ID: 16712
  Gene Symbol: SOX5
  Gene Name: SRY (sex determining region Y)-box 5
  Uniprot ID: P35711
  ENSP ID: ENSP00000370788
MSSKRPASPYGEADGEVAMVTSRQKVEEEESDGLPAFHLPLHVSFPNKPHSEEFQPVSLLTQETCGHRTPTSQHNTMEVDGNKVMSSFAPHNSSTSPQKAEEGGRQSGESLSSTALGTPERRKGSLADVVDTLKQRKMEELIKNEPEETPSIEKLLSKDWKDKLLAMGSGNFGEIKGTPESLAEKERQLMGMINQLTSLREQLLAAHDEQKKLAASQIEKQRQQMELAKQQQEQIARQQQQLLQQQHKINLLQQQIQVQGQLPPLMIPVFPPDQRTLAAAAQQGFLLPPGFSYKAGCSDPYPVQLIPTTMAAAAAATPGLGPLQLQQLYAAQLAAMQVSPGGKLPGIPQGNLGAAVSPTSIHTDKSTNSPPPKSKEKTTLESLTQQLAVKQNEEGKFSHAMMDFNLSGDSDGSAGVSESRIYRESRGRGSNEPHIKRPMNAFMVWAKDERRKILQAFPDMHNSNISKILGSRWKAMTNLEKQPYYEEQARLSKQHLEKYPDYKYKPRPKRTCLVDGKKLRIGEYKAIMRNRRQEMRQYFNVGQQAQIPIATAGVVYPGAIAMAGMPSPHLPSEHSSVSSSPEPGMPVIQSTYGVKGEEPHIKEEIQAEDINGEIYDEYDEEEDDPDVDYGSDSENHIAGQAN

SEQ ID NO: 83944 - protein, 377 aa, Homo sapiens
  Payload ID: 16712
  Gene Symbol: SOX5
  Gene Name: SRY (sex determining region Y)-box 5
  Uniprot ID: P35711
  ENSP ID: ENSP00000379328
MHDEVAQPLNLSAKPKTSDGKSPTSPTSPHMPALRINSGAGPLKASVPAALASPSARVSTIGYLNDHDAVTKAIQEARQMKEQLRREQQVLDGKVAVVNSLGLNNCRTEKEKTTLESLTQQLAVKQNEEGKFSHAMMDFNLSGDSDGSAGVSESRIYRESRGRGSNEPHIKRPMNAFMVWAKDERRKILQAFPDMHNSNISKILGSRWKAMTNLEKQPYYEEQARLSKQHLEKYPDYKYKPRPKRTCLVDGKKLRIGEYKAIMRNRRQEMRQYFNVGQQAQIPIATAGVVYPGAIAMAGMPSPHLPSEHSSVSSSPEPGMPVIQSTYGVKGEEPHIKEEIQAEDINGEIYDEYDEEEDDPDVDYGSDSENHIAGQAN

SEQ ID NO: 83945 - protein, 128 aa, Homo sapiens
  Payload ID: 16712
  Gene Symbol: SOX5
  Gene Name: SRY (sex determining region Y)-box 5
  ENSP ID: ENSP00000393240
MLTDPDLPQEFERMSSKRPASPYGEADGEVAMVTSRQKVEEEESDGLPAFHLPLHEVDGNKVMSSFAPHNSSTSPQKAEEGGRQSGESLSSTALGTPERRKGSLADVVDTLKQRKMEELIKNEPEGSH

SEQ ID NO: 83946 - protein, 763 aa, Homo sapiens [sequence omitted]

SEQ ID NO: 83947 - protein, 750 aa, Homo sapiens
  Payload ID: 16712
  Gene Symbol: SOX5
  Gene Name: SRY (sex determining region Y)-box 5
  Uniprot ID: P35711
  ENSP ID: ENSP00000437487
MSSKRPASPYGEADGEVAMVTSRQKVEEEESDGLPAFHLPLHVSFPNKPHSEEFQPVSLLTQETCGHRTPTSQHNTMEVDGNKVMSSFAPHNSSTSPQKAEEGGRQSGESLSSTALGTPERRKGSLADVVDTLKQRKMEELIKNEPEETPSIEKLLSKDWKDKLLAMGSGNFGEIKGTPESLAEKERQLMGMINQLTSLREQLLAAHDEQKKLAASQIEKQRQQMELAKQQQEQIARQQQQLLQQQHKINLLQQQIQVQGQLPPLMIPVFPPDQRTLAAAAQQGFLLPPGFSYKAGCSDPYPVQLIPTTMAAAAAATPGLGPLQLQQLYAAQLAAMQVSPGGKLPGIPQGNLGAAVSPTSIHTDKSTNSPPPKSKDEVAQPLNLSAKPKTSDGKSPTSPTSPHMPALRINSGAGPLKASVPAALASPSARVSTIGYLNDHDAVTKAIQEARQMKEQLRREQQVLDGKVAVVNSLGLNNCRTEKEKTTLESLTQQLAVKQNEEGKFSHAMMDFNLSGDSDGSAGVSESRIYRESRGRGSNEPHIKRPMNAFMVWAKDERRKILQAFPDMHNSNISKILGSRWKAMTNLEKQPYYEEQARLSKQHLEKYPDYKYKPRPKRTCLVDGKKLRIGEYKAIMRNRRQEMRQYFNVGQQAQIPIATAGVVYPGAIAMAGMPSPHLPSEHSSVSSSPEPGMPVIQSTYGVKGEEPHIKEEIQAEDINGEIYDEYDEEEDDPDVDYGSDSENHIAGQAN

SEQ ID NO: 83948 - protein, 728 aa, Homo sapiens
  Payload ID: 16712
  Gene Symbol: SOX5
  Gene Name: SRY (sex determining region Y)-box 5
  ENSP ID: ENSP00000439832
MLTDPDLPQEFERMSSKRPASPYGEADGEVAMVTSRQKVEEEESDGLPAFHLPLHEVDGNKVMSSFAPHNSSTSPQKAEEGGRQSGESLSSTALGTPERRKGSLADVVDTLKQRKMEELIKNEPEETPSIEKLLSKDWKDKLLAMGSGNFGEIKGTPESLAEKERQLMGMINQLTSLREQLLAAHDEQKKLAASQIEKQRQQMELAKQQQEQIARQQQQLLQQQHKINLLQQQIQVQGQLPPLMIPVFPPDQRTLAAAAQQGFLLPPGFSYKAGCSDPYPVQLIPTTMAAAAAATPGLGPLQLQQLYAAQLAAMQVSPGGKLPGIPQGNLGAAVSPTSIHTDKSTNSPPPKSKDEVAQPLNLSAKPKTSDGKSPTSPTSPHMPALRINSGAGPLKASVPAALASPSARVSTIGYLNDHDAVTKAIQEARQMKEQLRREQQVLDGKVAVVNSLGLNNCRTEKEKTTLESLTQQLAVKQNEEGKFSHAMMDFNLSGDSDGSAGVSESRIYRESRGRGSNEPHIKRPMNAFMVWAKDERRKILQAFPDMHNSNISKILGSRWKAMTNLEKQPYYEEQARLSKQHLEKYPDYKYKPRPKRTCLVDGKKLRIGEYKAIMRNRRQEMRQYFNVGQQAQIPIATAGVVYPGAIAMAGMPSPHLPSEHSSVSSSPEPGMPVIQSTYGVKGEEPHIKEEIQAEDINGEIYDEYDEEEDDPDVDYGSDSENHIAGQAN

SEQ ID NO: 83949 - protein, 144 aa, Homo sapiens
  Payload ID: 16712
  Gene Symbol: SOX5
  Gene Name: SRY (sex determining region Y)-box 5
  ENSP ID: ENSP00000441579
MSSKRPASPYGEADGEVAMVTSRQKVEEEESDGLPAFHLPLHVSFPNKPHSEEFQPVSLLTQETCGHRTPTSQHNTMEVDGNKVMSSFAPHNSSTSPQKAEEGGRQSGESLSSTALGTPERRKGSLADVVDTLKQRKMEELIKN

SEQ ID NO: 83950 - protein, 642 aa, Homo sapiens; identical to SEQ ID NO: 83943
  Payload ID: 16712
  Gene Symbol: SOX5
  Gene Name: SRY (sex determining region Y)-box 5
  Uniprot ID: P35711
  ENSP ID: ENSP00000441973

SEQ ID NO: 83951 - protein, 241 aa, Homo sapiens [sequence omitted]

SEQ ID NO: 83952 - protein, 753 aa, Homo sapiens
  Payload ID: 16712
  Gene Symbol: SOX5
  Gene Name: SRY (sex determining region Y)-box 5
  Uniprot ID: P35711
  ENSP ID: ENSP00000443520
MSVMSSKRPASPYGEADGEVAMVTSRQKVEEEESDGLPAFHLPLHVSFPNKPHSEEFQPVSLLTQETCGHRTPTSQHNTMEVDGNKVMSSFAPHNSSTSPQKAEEGGRQSGESLSSTALGTPERRKGSLADVVDTLKQRKMEELIKNEPEETPSIEKLLSKDWKDKLLAMGSGNFGEIKGTPESLAEKERQLMGMINQLTSLREQLLAAHDEQKKLAASQIEKQRQQMELAKQQQEQIARQQQQLLQQQHKINLLQQQIQVQGQLPPLMIPVFPPDQRTLAAAAQQGFLLPPGFSYKAGCSDPYPVQLIPTTMAAAAAATPGLGPLQLQQLYAAQLAAMQVSPGGKLPGIPQGNLGAAVSPTSIHTDKSTNSPPPKSKDEVAQPLNLSAKPKTSDGKSPTSPTSPHMPALRINSGAGPLKASVPAALASPSARVSTIGYLNDHDAVTKAIQEARQMKEQLRREQQVLDGKVAVVNSLGLNNCRTEKEKTTLESLTQQLAVKQNEEGKFSHAMMDFNLSGDSDGSAGVSESRIYRESRGRGSNEPHIKRPMNAFMVWAKDERRKILQAFPDMHNSNISKILGSRWKAMTNLEKQPYYEEQARLSKQHLEKYPDYKYKPRPKRTCLVDGKKLRIGEYKAIMRNRRQEMRQYFNVGQQAQIPIATAGVVYPGAIAMAGMPSPHLPSEHSSVSSSPEPGMPVIQSTYGVKGEEPHIKEEIQAEDINGEIYDEYDEEEDDPDVDYGSDSENHIAGQAN

SEQ ID NO: 83953 - protein, 808 aa, Homo sapiens
  Payload ID: 16713
  Gene Symbol: SOX6
  Gene Name: SRY (sex determining region Y)-box 6
  Uniprot ID: P35712
  ENSP ID: ENSP00000324948
MSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKLEEMTRTEQEDSSCMEKLLSKDWKEKMERLNTSELLGEIKGTPESLAEKERQLSTMITQLISLREQLLAAHDEQKKLAASQIEKQRQQMDLARQQQEQIARQQQQLLQQQHKINLLQQQIQVQGHMPPLMIPIFPHDQRTLAAAAAAQQGFLFPPGITYKPGDNYPVQFIPSTMAAAAASGLSPLQLQKGHVSHPQINQRLKGLSDRFGRNLDTFEHGGGHSYNHKQIEQLYAAQLASMQVSPGAKMPSTPQPPNTAGTVSPTGIKNEKRGTSPVTQVKDEAAAQPLNLSSRPKTAEPVKSPTSPTQNLFPASKTSPVNLPNKSSIPSPIGGSLGRGSSLDILSSLNSPALFGDQDTVMKAIQEARKMREQIQREQQQQQPHGVDGKLSSINNMGLNSCRNEKERTRFENLGPQLTGKSNEDGKLGPGVIDLTRPEDAEGGATVAEARVYRDARGRASSEPHIKRPMNAFMVWAKDERRKILQAFPDMHNSNISKILGSRWKSMSNQEKQPYYEEQARLSKIHLEKYPNYKYKPRPKRTCIVDGKKLRIGEYKQLMRSRRQEMRQFFTVGQQPQIPITTGTGVVYPGAITMATTTPSPQMTSDCSSTSASPEPSLPVIQSTYGMKTDGGSLAGNEMINGEDEMEMYDDYEDDPKSDYSSENEAPEAVSAN

SEQ ID NO: 83954 - protein, 808 aa, Homo sapiens; identical to SEQ ID NO: 83953
  Payload ID: 16713
  Gene Symbol: SOX6
  Gene Name: SRY (sex determining region Y)-box 6
  Uniprot ID: P35712
  ENSP ID: ENSP00000379644

SEQ ID NO: 83955 - protein, 801 aa, Homo sapiens
  Payload ID: 16713
  Gene Symbol: SOX6
  Gene Name: SRY (sex determining region Y)-box 6
  Uniprot ID: P35712
  ENSP ID: ENSP00000432134
MSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKLEEMTRTEQEDSSCMEKLLSKDWKEKMERLNTSELLGEIKGTPESLAEKERQLSTMITQLISLREQLLAAHDEQKKLAASQIEKQRQQMDLARQQQEQIARQQQQLLQQQHKINLLQQQIQVQGHMPPLMIPIFPHDQRTLAAAAAAQQGFLFPPGITYKPGDNYPVQFIPSTMAAAAASGLSPLQLQQLYAAQLASMQVSPGAKMPSTPQPPNTAGTVSPTGIKNEKRGTSPVTQVKDEAAAQPLNLSSRPKTAEPVKSPTSPTQNLFPASKTSPVNLPNKSSIPSPIGGSLGRGSSLGKWKSQHQEETYELDILSSLNSPALFGDQDTVMKAIQEARKMREQIQREQQQQQPHGVDGKLSSINNMGLNSCRNEKERTRFENLGPQLTGKSNEDGKLGPGVIDLTRPEDAEGSKAMNGSAAKLQQYYCWPTGGATVAEARVYRDARGRASSEPHIKRPMNAFMVWAKDERRKILQAFPDMHNSNISKILGSRWKSMSNQEKQPYYEEQARLSKIHLEKYPNYKYKPRPKRTCIVDGKKLRIGEYKQLMRSRRQEMRQFFTVGQQPQIPITTGTGVVYPGAITMATTTPSPQMTSDCSSTSASPEPSLPVIQSTYGMKTDGGSLAGNEMINGEDEMEMYDDYEDDPKSDYSSENEAPEAVSAN

SEQ ID NO: 83956 - protein, 159 aa, Homo sapiens
  Payload ID: 16713
  Gene Symbol: SOX6
  Gene Name: SRY (sex determining region Y)-box 6
  ENSP ID: ENSP00000432577
MSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKLEEMTRTEQEASLSFKISGVP

SEQ ID NO: 83957 - protein, 79 aa, Homo sapiens
  Payload ID: 16713
  Gene Symbol: SOX6
  Gene Name: SRY (sex determining region Y)-box 6
  ENSP ID: ENSP00000432596
MSSKQATSPFACAADGEDAMTQDLTSREKEEGSDQHVASHLPLHPIMHNKPHSEELPTLVSTIQQDADWDSVLSSQQRM

SEQ ID NO: 83958 - protein, 828 aa, Homo sapiens
  Payload ID: 16713
  Gene Symbol: SOX6
  Gene Name: SRY (sex determining region Y)-box 6
  Uniprot ID: P35712
  ENSP ID: ENSP00000433233
MSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKLEEMTRTEQEDSSCMEKLLSKDWKEKMERLNTSELLGEIKGTPESLAEKERQLSTMITQLISLREQLLAAHDEQKKLAASQIEKQRQQMDLARQQQEQIARQQQQLLQQQHKINLLQQQIQVQGHMPPLMIPIFPHDQRTLAAAAAAQQGFLFPPGITYKPGDNYPVQFIPSTMAAAAASGLSPLQLQKGHVSHPQINQRLKGLSDRFGRNLDTFEHGGGHSYNHKQIEQLYAAQLASMQVSPGAKMPSTPQPPNTAGTVSPTGIKNEKRGTSPVTQVKDEAAAQPLNLSSRPKTAEPVKSPTSPTQNLFPASKTSPVNLPNKSSIPSPIGGSLGRGSSLDILSSLNSPALFGDQDTVMKAIQEARKMREQIQREQQQQQPHGVDGKLSSINNMGLNSCRNEKERTRFENLGPQLTGKSNEDGKLGPGVIDLTRPEDAEGSKAMNGSAAKLQQYYCWPTGGATVAEARVYRDARGRASSEPHIKRPMNAFMVWAKDERRKILQAFPDMHNSNISKILGSRWKSMSNQEKQPYYEEQARLSKIHLEKYPNYKYKPRPKRTCIVDGKKLRIGEYKQLMRSRRQEMRQFFTVGQQPQIPITTGTGVVYPGAITMATTTPSPQMTSDCSSTSASPEPSLPVIQSTYGMKTDGGSLAGNEMINGEDEMEMYDDYEDDPKSDYSSENEAPEAVSAN

SEQ ID NO: 83959 - protein, 804 aa, Homo sapiens
  Payload ID: 16713
  Gene Symbol: SOX6
  Gene Name: SRY (sex determining region Y)-box 6
  Uniprot ID: P35712
  ENSP ID: ENSP00000434455
MGRMSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKLEEMTRTEQEDSSCMEKLLSKDWKEKMERLNTSELLGEIKGTPESLAEKERQLSTMITQLISLREQLLAAHDEQKKLAASQIEKQRQQMDLARQQQEQIARQQQQLLQQQHKINLLQQQIQVQGHMPPLMIPIFPHDQRTLAAAAAAQQGFLFPPGITYKPGDNYPVQFIPSTMAAAAASGLSPLQLQQLYAAQLASMQVSPGAKMPSTPQPPNTAGTVSPTGIKNEKRGTSPVTQVKDEAAAQPLNLSSRPKTAEPVKSPTSPTQNLFPASKTSPVNLPNKSSIPSPIGGSLGRGSSLGKWKSQHQEETYELDILSSLNSPALFGDQDTVMKAIQEARKMREQIQREQQQQQPHGVDGKLSSINNMGLNSCRNEKERTRFENLGPQLTGKSNEDGKLGPGVIDLTRPEDAEGSKAMNGSAAKLQQYYCWPTGGATVAEARVYRDARGRASSEPHIKRPMNAFMVWAKDERRKILQAFPDMHNSNISKILGSRWKSMSNQEKQPYYEEQARLSKIHLEKYPNYKYKPRPKRTCIVDGKKLRIGEYKQLMRSRRQEMRQFFTVGQQPQIPITTGTGVVYPGAITMATTTPSPQMTSDCSSTSASPEPSLPVIQSTYGMKTDGGSLAGNEMINGEDEMEMYDDYEDDPKSDYSSENEAPEAVSAN

SEQ ID NO: 83960 - protein, 139 aa, Homo sapiens
  Payload ID: 16713
  Gene Symbol: SOX6
  Gene Name: SRY (sex determining region Y)-box 6
  ENSP ID: ENSP00000434892
MSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKL

SEQ ID NO: 83961 - protein, 159 aa, Homo sapiens
  Payload ID: 16713
  Gene Symbol: SOX6
  Gene Name: SRY (sex determining region Y)-box 6
  ENSP ID: ENSP00000436170
MSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKLEEMTRTEQEDSSCMEKLLSK

SEQ ID NO: 83962 - protein, 388 aa, Homo sapiens [sequence omitted]

SEQ ID NO: 83963 - protein, 446 aa, Homo sapiens [sequence omitted]

SEQ ID NO: 83964 - protein, 509 aa, Homo sapiens
  Payload ID: 16716
  Gene Symbol: SOX9
  Gene Name: SRY (sex determining region Y)-box 9
  Uniprot ID: P48436
  ENSP ID: ENSP00000245479
MNLLDPFMKMTDEQEKGLSGAPSPTMSEDSAGSPCPSGSGSDTENTRPQENTFPKGEPDLKKESEEDKFPVCIREAVSQVLKGYDWTLVPMPVRVNGSSKNKPHVKRPMNAFMVWAQAARRKLADQYPHLHNAELSKTLGKLWRLLNESEKRPFVEEAERLRVQHKKDHPDYKYQPRRRKSVKNGQAEAEEATEQTHISPNAIFKALQADSPHSSSGMSEVHSPGEHSGQSQGPPTPPTTPKTDVQPGKADLKREGRPLPEGGRQPPIDFRDVDIGELSSDVISNIETFDVNEFDQYLPPNGHPGVPATHGQVTYTGSYGISSTAATPASAGHVWMSKQQAPPPPPQQPPQAPPAPQAPPQPQAAPPQQPAAPPQQPQAHTLTTLSSEPGQSQRTHIKTEQLSPSHYSEQQQHSPQQIAYSPFNLPHYSPSYPPITRSQYDYTDHQNSSSYYSHAAGQGTGLYSTFTYMNPAQRPMYTPIADTSGVPSIPQTHSPQHWEQPVYTQLTRP

SEQ ID NO: 83965 - protein, 353 aa, Homo sapiens
  Payload ID: 16717
  Gene Symbol: SSUH2
  Gene Name: ssu-2 homolog (C. elegans)
  Uniprot ID: Q9Y2M2
  ENSP ID: ENSP00000324551
MPSPVGLLRALPLPWPQFLACTLRRLAGPRESTGPSQKPPPLCSVPCRVPAMTEEVAREALLSFVDSKCCYSSTVAGDLVIQELKRQTLCRYRLETFSESRISEWTFQPFTNHSVDGPQRGASPRLWDIKVQGPPMFQEDTRKFQVPHSSLVKECHKCHGRGRYKCSGCHGAGTVRCPSCCGAKRKAKQSRRCQLCAGSGRRRCSTCSGRGNKTCATCKGEKKLLHFIQLVIMWKNSLFEFVSEHRLNCPRELLAKAKGENLFKDENSVVYPIVDFPLRDISLASQRGIAEHSAALASRARVLQQRQTIELIPLTEVHYWYQGKTYVYYIYGTDHQVYAVDYPERYCCGCTIV

SEQ ID NO: 83966 - protein, 353 aa, Homo sapiens; identical to SEQ ID NO: 83965
  Payload ID: 16717
  Gene Symbol: SSUH2
  Gene Name: ssu-2 homolog (C. elegans)
  Uniprot ID: Q9Y2M2
  ENSP ID: ENSP00000339150

SEQ ID NO: 83967 - protein, 156 aa, Homo sapiens
  Payload ID: 16717
  Gene Symbol: SSUH2
  Gene Name: ssu-2 homolog (C. elegans)
  ENSP ID: ENSP00000388845
MDRDLNEDDSVVDLSFEAESPLAPPTELLERLPSYDWLLQGGRGQIFFPPLEAPGRPQEQRSWPSFLEHRKNPASSGESSLASPAHSVSCAAIHGSEDRRAPLCARAGGCWRYKCAELWINGSQGCHGEMHEDARGGRRILSSWRCWGQKDFKSLR

SEQ ID NO: 83968 - protein, 84 aa, Homo sapiens
  Payload ID: 16717
  Gene Symbol: SSUH2
  Gene Name: ssu-2 homolog (C. elegans)
  ENSP ID: ENSP00000389937
MLLLMSQCRKQFPPLCSAARRKQHCLGTRIITKNFSVNLSVCLLQLPVCPLWYLWKPVVGKSLLRYLMNLHISYTAHNKYPLNE

SEQ ID NO: 83969 - protein, 39 aa, Homo sapiens
  Payload ID: 16717
  Gene Symbol: SSUH2
  Gene Name: ssu-2 homolog (C. elegans)
  ENSP ID: ENSP00000390328
MTGFFKGAEDRYSSHLWRPQGGPRSKGPGPRSWNTESLR

SEQ ID NO: 83970 - protein, 173 aa, Homo sapiens
  Payload ID: 16717
  Gene Symbol: SSUH2
  Gene Name: ssu-2 homolog (C. elegans)
  ENSP ID: ENSP00000401289
MDRDLNEDDSVVDLSFEAESPLAPPTELLERLPSYDWLLQGGRGQIFFPPLEAPGRPQEQRSWPSFLEHRVPAMTEEVAREALLSFVDSKCCYSSTVAGDLVIQELKRQTLCRYRLETFSESRISEWTFQPFTNHSVDGPQRGASPRLWDIKVQGPPMFQEDTRKFQVPHSSL

SEQ ID NO: 83971 - protein, 315 aa, Homo sapiens
  Payload ID: 16717
  Gene Symbol: SSUH2
  Gene Name: ssu-2 homolog (C. elegans)
  ENSP ID: ENSP00000410757
MPSPVGLLRALPLPWPQFLACTLRRLAGPRESTGPSQKPPPLCSVPCRVPAMTEEVAREALLSFVDSKCCYSSTVAGDLVIQELKRQTLCRYRLETFSESRISEWTFQPFTNHSVDGPQRGASPRLWDIKVQGPPMFQEDTRKFQVPHSSLVKECHKCHGRGRYKCSGCHGAGTVRCPSCCGAKRKAKQSRRCQLCAGSGRRRCSTCSGRGNKTCATCKGEKKLLHFIQLVIMWKNSLFEFVSEHRLNCPRELLAKAKGENLFKDENSVVYPIVDFPLRDISLASQRGIAEHSAALASRARVLQQVSQGGGAIWL

SEQ ID NO: 83972 - protein, 85 aa, Homo sapiens
  Payload ID: 16717
  Gene Symbol: SSUH2
  Gene Name: ssu-2 homolog (C. elegans)
  ENSP ID: ENSP00000412333
MSLRVSQSVLIRRMESSFPYSNGLTLLLTDAGLDLLGSSSLLTSASQSAGITDVSYRSQLPLFLINGINVFLNGGRGNICQLYLC

SEQ ID NO: 83973 - protein, 375 aa, Homo sapiens
  Payload ID: 16717
  Gene Symbol: SSUH2
  Gene Name: ssu-2 homolog (C. elegans)
  Uniprot ID: Q9Y2M2
  ENSP ID: ENSP00000439378
MDRDLNEDDSVVDLSFEAESPLAPPTELLERLPSYDWLLQGGRGQIFFPPLEAPGRPQEQRSWPSFLEHRVPAMTEEVAREALLSFVDSKCCYSSTVAGDLVIQELKRQTLCRYRLETFSESRISEWTFQPFTNHSVDGPQRGASPRLWDIKVQGPPMFQEDTRKFQVPHSSLVKECHKCHGRGRYKCSGCHGAGTVRCPSCCGAKRKAKQSRRCQLCAGSGRRRCSTCSGRGNKTCATCKGEKKLLHFIQLVIMWKNSLFEFVSEHRLNCPRELLAKAKGENLFKDENSVVYPIVDFPLRDISLASQRGIAEHSAALASRARVLQQRQTIELIPLTEVHYWYQGKTYVYYIYGTDHQVYAVDYPERYCCGCTIV

SEQ ID NO: 83974 - protein, 194 aa, Homo sapiens
  Payload ID: 16718
  Gene Symbol: SSU72
  Gene Name: SSU72 homolog, RNA polymerase II CTD phosphatase
  Uniprot ID: Q9NP77
  ENSP ID: ENSP00000291386
MPSSPLRVAVVCSSNQNRSMEAHNILSKRGFSVRSFGTGTHVKLPGPAPDKPNVYDFKTTYDQMYNDLLRKDKELYTQNGILHMLDRNKRIKPRPERFQNCKDLFDLILTCEERVYDQVVEDLNSREQETCQPVHVVNVDIQDNHEEATLGAFLICELCQCIQHTEDMENEIDELLQEFEEKSGRTFLHTVCFY

SEQ ID NO: 83975 - protein, 153 aa, Homo sapiens
  Payload ID: 16718
  Gene Symbol: SSU72
  Gene Name: SSU72 homolog, RNA polymerase II CTD phosphatase
  Uniprot ID: Q9NP77
  ENSP ID: ENSP00000351955
MPSSPLRVAVVCSSNQNRSMEAHNILSKRGFSVRSFGTGTHVKLPGPAPDKPNVYDFKTTYDQMYNDLLRKDKELYPSGLPFKNPPCGPPWKVLRVARAQEACHPVQCTHWLLCLCESLVSIPGARRIVHGLVPVPPMAVGVVRRTDTVWGSP

SEQ ID NO: 83976 - protein, 179 aa, Homo sapiens
  Payload ID: 16719
  Gene Symbol: ST20-MTHFS
  Gene Name: ST20-MTHFS readthrough
  ENSP ID: ENSP00000455643
MARSRLTATSVSQVQVIAHSEYQKSKRISIFLSMQDEIETEEIIKDIFQRGKICFIPRYRFQSNHMDMVRIESPEEISLLPKTSWNIPQPGEGDVREEALSTGGLDLIFMPGLGFDKHGNRLGRGKGYYDAYLKRCLQHQEVKPYTLALAFKEQICLQVPVNENDMKVDEVLYEDSSTA

SEQ ID NO: 83977 - protein, 122 aa, Homo sapiens
  Payload ID: 16719
  Gene Symbol: ST20-MTHFS
  Gene Name: ST20-MTHFS readthrough
  ENSP ID: ENSP00000489298
MEDVNSNVNADQEVIAHSEYQKSKRISIFLSMQDEIETEEIIKDIFQRGKICFIPRYRFQSNHMDMVRIESPEEISLLPKTSWNIPQPGEGDVREEALSTGGLDLIFMPGLGFDKHGNRLGR

SEQ ID NO: 83978 - protein, 179 aa, Homo sapiens; identical to SEQ ID NO: 83976
  Payload ID: 16719
  Gene Symbol: ST20-MTHFS
  Gene Name: ST20-MTHFS readthrough
  ENSP ID: ENSP00000489525

SEQ ID NO: 83979 - protein, 340 aa, Homo sapiens
  Payload ID: 16720
  Gene Symbol: ST3GAL1
  Gene Name: ST3 beta-galactoside alpha-2,3-sialyltransferase 1
  Uniprot ID: Q11201
  ENSP ID: ENSP00000414073
MVTLRKRTLKVLTFLVLFIFLTSFFLNYSHTMVATTWFPKQMVLELSENLKRLIKHRPCTCTHCIGQRKLSAWFDERFNQTMQPLLTAQNALLEDDTYRWWLRLQREKKPNNLNDTIKELFRVVPGNVDPMLEKRSVGCRRCAVVGNSGNLRESSYGPEIDSHDFVLRMNKAPTAGFEADVGTKTTHHLVYPESFRELGDNVSMILVPFKTIDLEWVVSAITTGTISHTYIPVPAKIRVKQDKILIYHPAFIKYVFDNWLQGHGRYPSTGILSVIFSMHVCDEVDLYGFGADSKGNWHHYWENNPSAGAFRKTGVHDADFESNVTATLASINKIRIFKGR

SEQ ID NO: 83980 - protein, 46 aa, Homo sapiens
  Payload ID: 16720
  Gene Symbol: ST3GAL1
  Gene Name: ST3 beta-galactoside alpha-2,3-sialyltransferase 1
  ENSP ID: ENSP00000427720
MLEKRSVGCRRCAVVGNSGNLRESSYGPEIDSHDFVLRMNKAPTAG

SEQ ID NO: 83981 - protein, 47 aa, Homo sapiens
  Payload ID: 16720
  Gene Symbol: ST3GAL1
  Gene Name: ST3 beta-galactoside alpha-2,3-sialyltransferase 1
  ENSP ID: ENSP00000427786
MVTLRKRTLKVLTFLVLFIFLTSFFLNYSHTMVATTWFPKQMVLELS

SEQ ID NO: 83982 - protein, 340 aa, Homo sapiens; identical to SEQ ID NO: 83979
  Payload ID: 16720
  Gene Symbol: ST3GAL1
  Gene Name: ST3 beta-galactoside alpha-2,3-sialyltransferase 1
  Uniprot ID: Q11201
  ENSP ID: ENSP00000428540

SEQ ID NO: 83983 - protein, 97 aa, Homo sapiens
  Payload ID: 16720
  Gene Symbol: ST3GAL1
  Gene Name: ST3 beta-galactoside alpha-2,3-sialyltransferase 1
  ENSP ID: ENSP00000429638
MLEKRSVGCRRCAVVGNSGNLRESSYGPEIDSHDFVLRMNKAPTAGFEADVGTKTTHHLVYPESFRELGDNVSMILVPFKTIDLEWVVSAITTGTIS

SEQ ID NO: 83984 - protein, 72 aa, Homo sapiens
  Payload ID: 16720
  Gene Symbol: ST3GAL1
  Gene Name: ST3 beta-galactoside alpha-2,3-sialyltransferase 1
  ENSP ID: ENSP00000429936
MVTLRKRTLKVLTFLVLFIFLTSFFLNYSHTMVATTWFPKQMVLELSENLKRLIKHRPCTCTHCIGQRKLSA

SEQ ID NO: 83985 - protein, 49 aa, Homo sapiens
  Payload ID: 16720
  Gene Symbol: ST3GAL1
  Gene Name: ST3 beta-galactoside alpha-2,3-sialyltransferase 1
  ENSP ID: ENSP00000430135
MVTLRKRTLKVLTFLVLFIFLTSFFLNYSHTMVATTWFPKQMVLELSEN

SEQ ID NO: 83986 - protein, 340 aa, Homo sapiens; identical to SEQ ID NO: 83979
  Payload ID: 16720
  Gene Symbol: ST3GAL1
  Gene Name: ST3 beta-galactoside alpha-2,3-sialyltransferase 1
  Uniprot ID: Q11201
  ENSP ID: ENSP00000430515

SEQ ID NO: 83987 - protein, 350 aa, Homo sapiens
  Payload ID: 16721
  Gene Symbol: ST3GAL2
  Gene Name: ST3 beta-galactoside alpha-2,3-sialyltransferase 2
  Uniprot ID: Q16842
  ENSP ID: ENSP00000345477
MKCSLRVWFLSVAFLLVFIMSLLFTYSHHSMATLPYLDSGALDGTHRVKLVPGYAGLQRLSKERLSGKSCACRRCMGDAGASDWFDSHFDGNISPVWTRENMDLPPDVQRWWMMLQPQFKSHNTNEVLEKLFQIVPGENPYRFRDPHQCRRCAVVGNSGNLRGSGYGQDVDGHNFIMRMNQAPTVGFEQDVGSRTTHHFMYPESAKNLPANVSFVLVPFKVLDLLWIASALSTGQIRFTYAPVKSFLRVDKEKVQIYNPAFFKYIHDRWTEHHGRYPSTGMLVLFFALHVCDEVNVYGFGADSRGNWHHYWENNRYAGEFRKTGVHDADFEAHIIDMLAKASKIEVYRGN

SEQ ID NO: 83988 - protein, 350 aa, Homo sapiens; identical to SEQ ID NO: 83987
  Payload ID: 16721
  Gene Symbol: ST3GAL2
  Gene Name: ST3 beta-galactoside alpha-2,3-sialyltransferase 2
  Uniprot ID: Q16842
  ENSP ID: ENSP00000377257

SEQ ID NO: 83989 - protein, 444 aa, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000262915
MGLLVFVRNLLLALCLFLVLGFLYYSAWKLHLLQWEEDSSKYSHSSSPQEKPVADSVVLSFDSAGQTLGSEYDRLGFLLNLDSKLSPRTLCTVVFGLDCILESPGEPKKLLMPASHPLEILKSLSEDTAFALGFLKLPRPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 83990 - protein, 413 aa, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000316999
MGLLVFVRNLLLALCLFLVLGFLYYSAWKLHLLQWEEDSKYDRLGFLLNLDSKLSPRTLCTVVFGLDCILESPGEPKKLLMPASHPLEILKSLSEDTAFALGFLKLPRPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 83991 - protein, 390 aa, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000317192
MGLLVFVRNLLLALCLFLVLGFLYYSAWKLHLLQWEEDSSKYSHSSSPQEKPVADSVVLSFDSAGQTLGSEYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 83992 - protein, 344 aa, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000329755
MGLLVFVRNLLLALCLFLVLGFLYYSAWKLHLLQWEEDSNSVVLSFDSAGQTLGSEYDRLGFLLNLDSKLFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 83993 - protein, 277 aa, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000330463
MGLLVFVRNLLLALCLFLVLGFLYYSAWKLHLLQWEEDSNSVVLSFDSAGQTLGSEYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSWTHNIQREKEFLRKLVKARVITDLSSGI

SEQ ID NO: 83994 - protein, 101 aa, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000333494
MGLLVFVRNLLLALCLFLVLGFLYYSAWKLHLLQWEEDSKYDRLGFLLNLDSKLPAELATKYANFSEGACKPGYASALMTAIFPRPGRTISSERKSFCGSW

SEQ ID NO: 83995 - protein, 185 aa, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000335633
MGLLVFVRNLLLALCLFLVLGFLYYSAWKLHLLQWEEDSSKYSHSSSPQEKPVAEYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVR

SEQ ID NO: 83996 - protein, 444 aa, Homo sapiens; identical to SEQ ID NO: 83989
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000354657

SEQ ID NO: 83997 - protein, 359 aa, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000354748
MGLLVFVRNLLLALCLFLVLGFLYYSAWKLHLLQWEEDSKYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 83998 - protein, 170 aa, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000355201
MGLLVFVRNLLLALCLFLVLGFLYYSAWKLHLLQWEEDSSKYSHSSSPQEKPVADSVVLSFDSAGQTLGSEYDRLGFLLNLDSKLPAELATKYANFSEGACKPGYASALMTAIFPRFSKPAPMFLDDSFRKWARIREFVPPFGIKGQVLDAQYPARERVSAEAGESSRHH

SEQ ID NO: 83999 - protein, 375 aa, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000355341
MGLLVFVRNLLLALCLFLVLGFLYYSAWKLHLLQWEEDSNSVVLSFDSAGQTLGSEYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 84000 - protein, 155 aa, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000361437
MGLLVFVRNLLLALCLFLVLGFLYYSAWKLHLLQWEEDSNSVVLSFDSAGQTLGSEYDRLGFLLNLDSKLPAELATKYANFSEGACKPGYASALMTAIFPRFSKPAPMFLDDSFRKWARIREFVPPFGIKGQVLDAQYPARERVSAEAGESSRHH

SEQ ID NO: 84001 - protein, 186 aa, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000361440
MGLLVFVRNLLLALCLFLVLGFLYYSAWKLHLLQWEEDSNSVVLSFDSAGQTLGSEYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVR

SEQ ID NO: 84002 - protein, 185 aa, Homo sapiens; identical to SEQ ID NO: 83995
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000361441

SEQ ID NO: 84003 - protein, 201 aa, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000361442
MGLLVFVRNLLLALCLFLVLGFLYYSAWKLHLLQWEEDSSKYSHSSSPQEKPVAEYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVSPGRTISSERKSFCGSW

SEQ ID NO: 84004 - protein, 429 aa, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000361443
MGLLVFVRNLLLALCLFLVLGFLYYSAWKLHLLQWEEDSNSVVLSFDSAGQTLGSEYDRLGFLLNLDSKLSPRTLCTVVFGLDCILESPGEPKKLLMPASHPLEILKSLSEDTAFALGFLKLPRPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 84005 - protein, 345 aa, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000361444
MGLLVFVRNLLLALCLFLVLGFLYYSAWKLHLLQWEEDSNSVVLSFDSAGQTLGSEYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 84006 - protein, 413 aa, Homo sapiens; identical to SEQ ID NO: 83990
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000361447

SEQ ID NO: 84007 - protein, 344 aa, Homo sapiens; identical to SEQ ID NO: 83992
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000361449

SEQ ID NO: 84008 - protein, 189 aa, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000431700
MGLLVFVRNLLLALCLFLVLGFLYYSAWKLHLLQWEEDSNSVVLSFDSAGQTLGSEYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRPRL

SEQ ID NO: 84009 - protein, 85 aa, Homo sapiens
  Payload ID: 16722
  Gene Symbol: ST3GAL3
  Gene Name: ST3 beta-galactoside alpha-2,3-sialyltransferase 3
  ENSP ID: ENSP00000431816
MGLLVFVRNLLLALCLFLVLGFLYYSAWKLHLLQWEEDSNSVVLSFDSAGQTLGSGTVTADWNLWWFITMKKGSGSLTTEMPVAC

SEQ ID NO: 84010 - protein, 115 aa, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000432071
MGLLVFVRNLLLALCLFLVLGFLYYSAWKLHLLQWEEDSNSVVLSFDSAGQTLGSEYDRLGFLLNLDSKLPAELATKYANFSEGACKPGYASALMTAIFPREKVRTFMAWLAWYG

SEQ ID NO: 84011 - protein, 85 aa, Homo sapiens; identical to SEQ ID NO: 84009
  Payload ID: 16722
  Gene Symbol: ST3GAL3
  Gene Name: ST3 beta-galactoside alpha-2,3-sialyltransferase 3
  ENSP ID: ENSP00000432214

SEQ ID NO: 84012 - protein, 261 aa, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000432682
MGLLVFVRNLLLALCLFLVLGFLYYSAWKLHLLQWEEDSKYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSWTHNIQREKEFLRKLVKARVITDLSSGI

SEQ ID NO: 84013 - protein, 277 aa, Homo sapiens; identical to SEQ ID NO: 83993
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000432965

SEQ ID NO: 84014 - protein, 100 aa, Homo sapiens
  Payload ID: 16722
  Gene Symbol: ST3GAL3
  Gene Name: ST3 beta-galactoside alpha-2,3-sialyltransferase 3
  ENSP ID: ENSP00000433668
MGLLVFVRNLLLALCLFLVLGFLYYSAWKLHLLQWEEDSSKYSHSSSPQEKPVADSVVLSFDSAGQTLGSGTVTADWNLWWFITMKKGSGSLTTEMPVAC

SEQ ID NO: 84015 - protein, 101 aa, Homo sapiens; identical to SEQ ID NO: 83994
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000434378

SEQ ID NO: 84016 - protein, 106 aa, Homo sapiens
  Payload ID: 16722
  Gene Symbol: ST3GAL3
  Gene Name: ST3 beta-galactoside alpha-2,3-sialyltransferase 3
  ENSP ID: ENSP00000434686
MGLLVFVRNLLLALCLFLVLGFLYYSAWKLHLLQWEEDSNSVVLSFDSAGQTLGSEYDRLGFLLNLDSKLPAELATKYANFSEGACKPGYASALMTAIFPRENKRR

SEQ ID NO: 84017 - protein, 186 aa, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000434876
MGLLVFVRNLLLALCLFLVLGFLYYSAWKLHLLQWEEDSKYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVSPGRTISSERKSFCGSW

SEQ ID NO: 84018 - protein, 73 aa, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000435018
MGLLVFVRNLLLALCLFLVLGFLYYSAWKLHLLQWEEDSSSPSQHPCSWMTPFASGLESGSSCRLLGSKVKTI

SEQ ID NO: 84019 - protein, 139 aa, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000435603
MGLLVFVRNLLLALCLFLVLGFLYYSAWKLHLLQWEEDSKYDRLGFLLNLDSKLPAELATKYANFSEGACKPGYASALMTAIFPRFSKPAPMFLDDSFRKWARIREFVPPFGIKGQVLDAQYPARERVSAEAGESSRHH

SEQ ID NO: 84020 - protein, 151 aa, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000435621
MGLLVFVRNLLLALCLFLVLGFLYYSAWKLHLLQWEEDSNSVVLSFDSAGQTLGSEYDRLGFLLNLDSKLPAELATKYANFSEGACKPGYASALMTAIFPRFSKPAPMFLDDSFRKWARIREFVPPFGIKGQECIGWLLEICGHSSAQGAP

SEQ ID NO: 84021 - protein, 197 aa, Homo sapiens
  Payload ID: 16722
  Gene Symbol: ST3GAL3
  Gene Name: ST3 beta-galactoside alpha-2,3-sialyltransferase 3
  ENSP ID: ENSP00000436298
  MOD_RES (1)..(1): Any amino acid
XTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKEVSTVTEYWRVVTKKAPSPGRGSKGLSKGPTDHFISPFSPGRTISSERKSFCG

SEQ ID NO: 84022 - protein, 121 aa, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000437206
MGLLVFVRNLLLALCLFLVLGFLYYSAWKLHLLQWEEDSNSVVLSFDSAGQTLGSEYDRLGFLLNLDSKLPAELATKYANFSEGACKPGYASALMTAIFPRAKRNGAWRQKHIQAYVLRQR

SEQ ID NO: 84023 - protein, 228 aa, Homo sapiens
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000437293
MGLLVFVRNLLLALCLFLVLGFLYYSAWKLHLLQWEEDSKYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRVHRMASGNLWPLECPRSPLRFESSTHISSRRPPSPSLACPSTMASWAGGTSLPLAVWQ

SEQ ID NO: 84024 - protein, 170 aa, Homo sapiens; identical to SEQ ID NO: 83998
  Payload ID: 16722
  Gene Symbol: ST3GAL3
  Gene Name: ST3 beta-galactoside alpha-2,3-sialyltransferase 3
  Uniprot ID: Q11203
  ENSP ID: ENSP00000439634

SEQ ID NO: 84025 - protein, 329 aa, Homo sapiens
  Payload ID: 16723
  Gene Symbol: ST3GAL4
  Gene Name: ST3 beta-galactoside alpha-2,3-sialyltransferase 4
  Uniprot ID: Q11206
  ENSP ID: ENSP00000227495
MVSKSRWKLLAMLALVLVVMVWYSISREDSFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 84026 - protein, 339 aa, Homo sapiens
  Payload ID: 16723
  Gene Symbol: ST3GAL4
  Gene Name: ST3 beta-galactoside alpha-2,3-sialyltransferase 4
  Uniprot ID: Q11206
  ENSP ID: ENSP00000348451
MVSKSRWKLLAMLALVLVVMVWYSISREDRYIELFYFPIPEKKEPCLQGEAESKASKLFGKLSPLCSYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 84027 - protein, 333 aa, Homo sapiens
  Payload ID: 16723
  Gene Symbol: ST3GAL4
  Gene Name: ST3 beta-galactoside alpha-2,3-sialyltransferase 4
  Uniprot ID: Q11206
  ENSP ID: ENSP00000376437
MVSKSRWKLLAMLALVLVVMVWYSISREDRYIELFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 84028 - protein, 333 aa, Homo sapiens; identical to SEQ ID NO: 84027
  Payload ID: 16723
  Gene Symbol: ST3GAL4
  Gene Name: ST3 beta-galactoside alpha-2,3-sialyltransferase 4
  Uniprot ID: Q11206
  ENSP ID: ENSP00000394354

SEQ ID NO: 84029 - protein, 322 aa, Homo sapiens
  Payload ID: 16723
  Gene Symbol: ST3GAL4
  Gene Name: ST3 beta-galactoside alpha-2,3-sialyltransferase 4
  Uniprot ID: Q11206
  ENSP ID: ENSP00000399444
MLALVLVVMVWYSISREDRYIELFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 84030 - protein, 153 aa, Homo sapiens
  Payload ID: 16723
  Gene Symbol: ST3GAL4
  Gene Name: ST3 beta-galactoside alpha-2,3-sialyltransferase 4
  ENSP ID: ENSP00000431170
MRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALA

SEQ ID NO: 84031 - protein, 209 aa, Homo sapiens
  Payload ID: 16723
  Gene Symbol: ST3GAL4
  Gene Name: ST3 beta-galactoside alpha-2,3-sialyltransferase 4
  ENSP ID: ENSP00000432424
MVSKSRWKLLAMLALVLVVMVWYSISREDRYIELFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKR

SEQ ID NO: 84032 - protein, 111 aa, Homo sapiens
  Payload ID: 16723
  Gene Symbol: ST3GAL4
  Gene Name: ST3 beta-galactoside alpha-2,3-sialyltransferase 4
  ENSP ID: ENSP00000432647
MVSKSRWKLLAMLALVLVVMVWYSISREDRYIELFYFPIPEKKEPCLQGEAESKASKLFGNYSRDQPIFLRLEDYFWVKTPSAYELPYGTKGSEDLLLRVLAITSSSIPKN

SEQ ID NO: 84033 - protein, 126 aa, Homo sapiens
  Payload ID: 16723
  Gene Symbol: ST3GAL4
  Gene Name: ST3 beta-galactoside alpha-2,3-sialyltransferase 4
  ENSP ID: ENSP00000432929
MVSKSRWKLLAMLALVLVVMVWYSISREDRYIELFYFPIPEKKEPCLQGEAESKASKLFGNYSRDQPIFLRLEDYFWVKTPSAYELPYGTKGSASGAAAVWSWGTGTGCGTAHWEMPSTSTMWSSD

SEQ ID NO: 84034 - protein, 333 aa, Homo sapiens; identical to SEQ ID NO: 84027
  Payload ID: 16723
  Gene Symbol: ST3GAL4
  Gene Name: ST3 beta-galactoside alpha-2,3-sialyltransferase 4
  Uniprot ID: Q11206
  ENSP ID: ENSP00000433318

SEQ ID NO: 84035 - protein, 47 aa, Homo sapiens
  Payload ID: 16723
  Gene Symbol: ST3GAL4
  Gene Name: ST3 beta-galactoside alpha-2,3-sialyltransferase 4
  ENSP ID: ENSP00000433495
MSVLSGPGWTTGCPWPQNHPNPCHISGREVARGSRDDSSPQESCCLL

SEQ ID NO: 84036 - protein, 329 aa, Homo sapiens; identical to SEQ ID NO: 84025
  Payload ID: 16723
  Gene Symbol: ST3GAL4
  Gene Name: ST3 beta-galactoside alpha-2,3-sialyltransferase 4
  Uniprot ID: Q11206
  ENSP ID: ENSP00000433989

SEQ ID NO: 84037 - protein, 332 aa, Homo sapiens
  Payload ID: 16723
  Gene Symbol: ST3GAL4
  Gene Name: ST3 beta-galactoside alpha-2,3-sialyltransferase 4
  Uniprot ID: Q11206
  ENSP ID: ENSP00000434349
MCPAGWKLLAMLALVLVVMVWYSISREDRYIELFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 84038 - protein, 328 aa, Homo sapiens
  Payload ID: 16723
  Gene Symbol: ST3GAL4
  Gene Name: ST3 beta-galactoside alpha-2,3-sialyltransferase 4
  Uniprot ID: Q11206
  ENSP ID: ENSP00000434668
MCPAGWKLLAMLALVLVVMVWYSISREDSFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 84039 - protein, 93 aa, Homo sapiens
  Payload ID: 16723
  Gene Symbol: ST3GAL4
  Gene Name: ST3 beta-galactoside alpha-2,3-sialyltransferase 4
  ENSP ID: ENSP00000434756
MVSKSRWKLLAMLALVLVVMVWYSISREDRYIELFYFPIPEKKEPCLQGEAESKASKLFGNYSRDQPIFLRLEDYFWVKTPSAYELPYGTKGS

SEQ ID NO: 84040 - protein, 333 aa, Homo sapiens; identical to SEQ ID NO: 84027
  Payload ID: 16723
  Gene Symbol: ST3GAL4
  Gene Name: ST3 beta-galactoside alpha-2,3-sialyltransferase 4
  Uniprot ID: Q11206
  ENSP ID: ENSP00000436047

SEQ ID NO: 84041 - protein, 112 aa, Homo sapiens
  Payload ID: 16724
  Gene Symbol: ST3GAL5
  Gene Name: ST3 beta-galactoside alpha-2,3-sialyltransferase 5
  ENSP ID: ENSP00000306247
MRTKAAGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKVVSSSF

SEQ ID NO: 84042 - protein, 418 aa, Homo sapiens
  Payload ID: 16724
  Gene Symbol: ST3GAL5
  Gene Name: ST3 beta-galactoside alpha-2,3-sialyltransferase 5
  Uniprot ID: Q9UNP4
  ENSP ID: ENSP00000366549
MRTKAAGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 84043 - protein, 390 aa, Homo sapiens
  Payload ID: 16724
  Gene Symbol: ST3GAL5
  Gene Name: ST3 beta-galactoside alpha-2,3-sialyltransferase 5
  Uniprot ID: Q9UNP4
  ENSP ID: ENSP00000377394
MPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 84044 - protein, 395 aa, Homo sapiens
  Payload ID: 16724
  Gene Symbol: ST3GAL5
  Gene Name: ST3 beta-galactoside alpha-2,3-sialyltransferase 5
  Uniprot ID: Q9UNP4
  ENSP ID: ENSP00000377397
MASVPMPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 84045 - protein, 139 aa, Homo sapiens
  Payload ID: 16724
  Gene Symbol: ST3GAL5
  Gene Name: ST3 beta-galactoside alpha-2,3-sialyltransferase 5
  ENSP ID: ENSP00000401375
MPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKF

SEQ ID NO: 84046 - protein, 47 aa, Homo sapiens
  Payload ID: 16724
  Gene Symbol: ST3GAL5
  Gene Name: ST3 beta-galactoside alpha-2,3-sialyltransferase 5
  ENSP ID: ENSP00000408635
MRTKAAGCAERRPLQPRTEAAAAPAGRGTVKTVVCKAETPACMESAF

SEQ ID NO: 84047 - protein, 213 aa, Homo sapiens
  Payload ID: 16725
  Gene Symbol: ST3GAL6
  Gene Name: ST3 beta-galactoside alpha-2,3-sialyltransferase 6
  Uniprot ID: Q9Y274
  ENSP ID: ENSP00000265261
MRTSAEYFRLALSKLQSCDLFDEFDKMNNGPVLGHEEEVGRRTTFRLFYPESVFSDPIHNDPNTTVILTAFKPHDLRWLLELLMGDKINTNGFWKKPALNLIYKPYQIRILDPFIIRTAAYELLHFPKVFPKNQKPKHPTTGIIAITLAFYICHEVHLAGFKYNFSDLKSPLHYYGNATMSLMNKNAYHNVTAEQLFLKDIIEKNLVINLTQD

SEQ ID NO: 84048 - protein, 331 aa, Homo sapiens
  Payload ID: 16725
  Gene Symbol: ST3GAL6
  Gene Name: ST3 beta-galactoside alpha-2,3-sialyltransferase 6
  Uniprot ID: Q9Y274
  ENSP ID: ENSP00000377717
MRGYLVAIFLSAVFLYYVLHCILWGTNVYWVAPVEMKRRNKIQPCLSKPAFASLLRFHQFHPFLCAADFRKIASLYGSDKFDLPYGMRTSAEYFRLALSKLQSCDLFDEFDNIPCKKCVVVGNGGVLKNKTLGEKIDSYDVIIRMNNGPVLGHEEEVGRRTTFRLFYPESVFSDPIHNDPNTTVILTAFKPHDLRWLLELLMGDKINTNGFWKKPALNLIYKPYQIRILDPFIIRTAAYELLHFPKVFPKNQKPKHPTTGIIAITLAFYICHEVHLAGFKYNFSDLKSPLHYYGNATMSLMNKNAYHNVTAEQLFLKDIIEKNLVINLTQD

SEQ ID NO: 84049 - protein, 90 aa, Homo sapiens
  Payload ID: 16725
  Gene Symbol: ST3GAL6
  Gene Name: ST3 beta-galactoside alpha-2,3-sialyltransferase 6
  ENSP ID: ENSP00000417109
MRGYLVAIFLSAVFLYYVLHCILWGTNVYWVAPVEMKRRNKIQPCLSKPAFASLLSQSSAYILRKGIEELNQTSILFTQVSSVSPFSVCG

SEQ ID NO: 84050 - protein, 262 aa, Homo sapiens
  Payload ID: 16725
  Gene Symbol: ST3GAL6
  Gene Name: ST3 beta-galactoside alpha-2,3-sialyltransferase 6
  ENSP ID: ENSP00000417201
MTACPGAEWTQVSAGPPGKGEPAMRGYLVAIFLSAVFLYYVLHCILWGTNVYWVAPVEMKRRNKIQPCLSKPAFASLLRFHQFHPFLCAADFRKIASLYGSDKFDLPYGMRTSAEYFRLALSKLQSCDLFDEFDNIPCKKCVVVGNGGVLKNKTLGEKIDSYDVIIRMNNGPVLGHEEEVGRRTTFRLFYPESVFSDPIHNDPNTTVILTAFKPHDLRWLLELLMGDKINTNGFWKKPALNLIYKPYQIRILDPFIIRTAAY

SEQ ID NO: 84051 - protein, 331 aa, Homo sapiens; identical to SEQ ID NO: 84048
  Payload ID: 16725
  Gene Symbol: ST3GAL6
  Gene Name: ST3 beta-galactoside alpha-2,3-sialyltransferase 6
  Uniprot ID: Q9Y274
  ENSP ID: ENSP00000417376

SEQ ID NO: 84052 - protein, 165 aa, Homo sapiens
  Payload ID: 16725
  Gene Symbol: ST3GAL6
  Gene Name: ST3 beta-galactoside alpha-2,3-sialyltransferase 6
  ENSP ID: ENSP00000417584
MRGYLVAIFLSAVFLYYVLHCILWGTNVYWVAPVEMKRRNKIQPCLSKPAFASLLRFHQFHPFLCAADFRKIASLYGSDKFDLPYGMRTSAEYFRLALSKLQSCDLFDEFDKMNNGPVLGHEEEVGRRTTFRLFYPESVFSDPIHNDPNTTVILTAFKPHDLRWL

SEQ ID NO: 84053 - protein, 65 aa, Homo sapiens
  Payload ID: 16725
  Gene Symbol: ST3GAL6
  Gene Name: ST3 beta-galactoside alpha-2,3-sialyltransferase 6
  ENSP ID: ENSP00000418581
MWQAPRERQQPAGAAAPQVSEPGAPLRSSLLGLGGSLLPAGFAAGLHCPAFASEEAAQPWVLDNF

SEQ ID NO: 84054 - protein, 218 aa, Homo sapiens
  Payload ID: 16725
  Gene Symbol: ST3GAL6
  Gene Name: ST3 beta-galactoside alpha-2,3-sialyltransferase 6
  ENSP ID: ENSP00000418650
MRGYLVAIFLSAVFLYYVLHCILWGTNVYWVAPVEMKRRNKIQPCLSKPAFASLLRFHQFHPFLCAADFRKIASLYGSDKFDLPYGMRTSAEYFRLALSKLQSCDLFDEFDKMNNGPVLGHEEEVGRRTTFRLFYPESVFSDPIHNDPNTTVILTAFKPHDLRWLLELLMGDKINTNGFWKKPALNLIYKPYQIRILDPFIIRTAAYELLHFPKVFPK

SEQ ID NO: 84055 - protein, 231 aa, Homo sapiens
  Payload ID: 16725
  Gene Symbol: ST3GAL6
  Gene Name: ST3 beta-galactoside alpha-2,3-sialyltransferase 6
  ENSP ID: ENSP00000418896
MRGYLVAIFLSAVFLYYVLHCILWGTNVYWVAPVEMKRRNKIQPCLSKPAFASLLRFHQFHPFLCAADFRKIASLYGSDKFDLPYGMRTSAEYFRLALSKLQSCDLFDEFDNIPCKKCVVVGNGGVLKNKTLGEKIDSYDVIIRMNNGPVLGHEEEVGRRTTFRLFYPESVFSDPIHNDPNTTVILTAFKPHDLRWLLELLMGDKINTNGFWKKPALNLIYKPYQIRILDP

SEQ ID NO: 84056 - protein, 157 aa, Homo sapiens
  Payload ID: 16725
  Gene Symbol: ST3GAL6
  Gene Name: ST3 beta-galactoside alpha-2,3-sialyltransferase 6
  ENSP ID: ENSP00000419202
MRTSAEYFRLALSKLQSCDLFDEFDNIPCKKCVVVGNGGVLKNKTLGEKIDSYDVIIRMNNGPVLGHEEEVGRRTTFRLFYPESVFSDPIHNDPNTTVILTAFKPHDLRWLLELLMGDKINTNGFWKKPALNLIYKPYQIRILDPFIIRTAAYELLH

SEQ ID NO: 84057 - protein, 101 aa, Homo sapiens
  Payload ID: 16725
  Gene Symbol: ST3GAL6
  Gene Name: ST3 beta-galactoside alpha-2,3-sialyltransferase 6
  ENSP ID: ENSP00000419209
MRGYLVAIFLSAVFLYYVLHCILWGTNVYWVAPVEMKRRNKIQPCLSKPAFASLLRFHQFHPFLCAADFRKIASLYGSDKFDLPYGMRTSAYPVKSVWWLV

SEQ ID NO: 84058 - protein, 90 aa, Homo sapiens; identical to SEQ ID NO: 84049
  Payload ID: 16725
  Gene Symbol: ST3GAL6
  Gene Name: ST3 beta-galactoside alpha-2,3-sialyltransferase 6
  ENSP ID: ENSP00000419690

SEQ ID NO: 84059 - protein, 121 aa, Homo sapiens
  Payload ID: 16725
  Gene Symbol: ST3GAL6
  Gene Name: ST3 beta-galactoside alpha-2,3-sialyltransferase 6
  ENSP ID: ENSP00000419987
MKRRNKIQPCLSKPAFASLLRFHQFHPFLCAADFRKIASLYGSDKFDLPYGMRTSAEYFRLALSKLQSCDLFDEFDNIPCKKCVVVGNGGVLKNKTLGEKIDSYDVIIRMNNGPVLGHEEE

SEQ ID NO: 84060 - protein, 90 aa, Homo sapiens; identical to SEQ ID NO: 84049
  Payload ID: 16725
  Gene Symbol: ST3GAL6
  Gene Name: ST3 beta-galactoside alpha-2,3-sialyltransferase 6
  ENSP ID: ENSP00000420047

SEQ ID NO: 84061 - protein, 146 aa, Homo sapiens
  Payload ID: 16725
  Gene Symbol: ST3GAL6
  Gene Name: ST3 beta-galactoside alpha-2,3-sialyltransferase 6
  ENSP ID: ENSP00000420474
MRGYLVAIFLSAVFLYYVLHCILWGTNVYWVAPVEMKRRNKIQPCLSKPAFASLLRFHQFHPFLCAADFRKIASLYGSDKFDLPYGMRTSAEYFRLALSKLQSCDLFDEFDKNREPRTMRLPPAGQQGLPVASQLFSQSLSEARLL

SEQ ID NO: 84062 - protein, 90 aa, Homo sapiens; identical to SEQ ID NO: 84049
  Payload ID: 16725
  Gene Symbol: ST3GAL6
  Gene Name: ST3 beta-galactoside alpha-2,3-sialyltransferase 6
  ENSP ID: ENSP00000420693

SEQ ID NO: 84063 - protein, 384 aa, Homo sapiens
  Payload ID: 16725
  Gene Symbol: ST3GAL6
  Gene Name: ST3 beta-galactoside alpha-2,3-sialyltransferase 6
  ENSP ID: ENSP00000480884
MWQAPRERQQPAGAAAPQVSEPGAPLRSSLLGLGGSLLPAGFAAGLHCPGEPAMRGYLVAIFLSAVFLYYVLHCILWGTNVYWVAPVEMKRRNKIQPCLSKPAFASLLRFHQFHPFLCAADFRKIASLYGSDKFDLPYGMRTSAEYFRLALSKLQSCDLFDEFDNIPCKKCVVVGNGGVLKNKTLGEKIDSYDVIIRMNNGPVLGHEEEVGRRTTFRLFYPESVFSDPIHNDPNTTVILTAFKPHDLRWLLELLMGDKINTNGFWKKPALNLIYKPYQIRILDPFIIRTAAYELLHFPKVFPKNQKPKHPTTGIIAITLAFYICHEVHLAGFKYNFSDLKSPLHYYGNATMSLMNKNAYHNVTAEQLFLKDIIEKNLVINLTQD

SEQ ID NO: 84064 - protein, 600 aa, Homo sapiens
  Payload ID: 16726
  Gene Symbol: ST6GALNAC1
  Gene Name: ST6 (alpha-N-acetyl-neuraminyl-2,3-beta-galactosyl-1,3)-N-acetylgalactosaminide alpha-2,6-sialyltransferase 1
  Uniprot ID: Q9NSC7
  ENSP ID: ENSP00000156626
MRSCLWRCRHLSQGVQWSLLLAVLVFFLFALPSFIKEPQTKPSRHQRTENIKERSLQSLAKPKSQAPTRARRTTIYAEPVPENNALNTQTQPKAHTTGDRGKEANQAPPEEQDKVPHTAQRAAWKSPEKEKTMVNTLSPRGQDAGMASGRTEAQSWKSQDTKTTQGNGGQTRKLTASRTVSEKHQGKAATTAKTLIPKSQHRMLAPTGAVSTRTRQKGVTTAVIPPKEKKPQATPPPAPFQSPTTQRNQRLKAANFKSEPRWDFEEKYSFEIGGLQTTCPDSVKIKASKSLWLQKLFLPNLTLFLDSRHFNQSEWDRLEHFAPPFGFMELNYSLVQKVVTRFPPVPQQQLLLASLPAGSLRCITCAVVGNGGILNNSHMGQEIDSHDYVFRLSGALIKGYEQDVGTRTSFYGFTAFSLTQSLLILGNRGFKNVPLGKDVRYLHFLEGTRDYEWLEALLMNQTVMSKNLFWFRHRPQEAFREALHMDRYLLLHPDFLRYMKNRFLRSKTLDGAHWRIYRPTTGALLLLTALQLCDQVSAYGFITEGHERFSDHYYDTSWKRLIFYINHDFKLEREVWKRLHDEGIIRLYQRPGPGTAKAKN

SEQ ID NO: 84065 - protein, 471 aa, Homo sapiens
  Payload ID: 16726
  Gene Symbol: ST6GALNAC1
  Gene Name: ST6 (alpha-N-acetyl-neuraminyl-2,3-beta-galactosyl-1,3)-N-acetylgalactosaminide alpha-2,6-sialyltransferase 1
  ENSP ID: ENSP00000351991
MRSCLWRCRHLSQGVQWSLLLAVLVFFLFALPSFIKEPQTKPSRHQRTENIKERSLQSLAKPKSQAPTRARRTTIYAEPVPENNALNTQTQPKAHTTGDRGKEANQAPPEEQDKVPHTAQRAAWKSPEKEKTMVNTLSPRGQDAGMASGRTEAQSWKSQDTKTTQGNGGQTRKLTASRTVSEKHQGKAATTAKTLIPKSQHRMLAPTGAVSTRTRQKGVTTAVIPPKEKKPQATPPPAPFQSPTTQRNQRLKAANFKSEPRWDFEEKYSFEIGGLQTTCPDSVKIKASKSLWLQKLFLPNLTLFLDSRHFNQSEWDRLEHFAPPFGFMELNYSLVQKVVTRFPPVPQQQLLLASLPAGSLRCITCAVVGNGGILNNSHMGQEIDSHDYVFRLSGALIKGYEQDVGTRTSFYGFTAFSLTQSLLILGNRGFKNVPLGKAQTPGSFSGSPAHGQVPVAAPRLSPIHEEQVSEV

SEQ ID NO: 84066 - protein, 63 aa, Homo sapiens
  Payload ID: 16726
  Gene Symbol: ST6GALNAC1
  Gene Name: ST6 (alpha-N-acetyl-neuraminyl-2,3-beta-galactosyl-1,3)-N-acetylgalactosaminide alpha-2,6-sialyltransferase 1
  ENSP ID: ENSP00000465092
MRSCLWRCRHLSQGVQWSLLLAVLVFFLFALPSFIKEPQTKPSRMVSRAPGHLMRCQGMGVGR

SEQ ID NO: 84067 - protein, 47 aa, Homo sapiens
  Payload ID: 16726
  Gene Symbol: ST6GALNAC1
  Gene Name: ST6 (alpha-N-acetyl-neuraminyl-2,3-beta-galactosyl-1,3)-N-acetylgalactosaminide alpha-2,6-sialyltransferase 1
  ENSP ID: ENSP00000465116
MRSCLWRCRHLSQGVQWSLLLAVLVFFLFALPSFIKEPQTKPSRLTL

SEQ ID NO: 84068 - protein, 59 aa, Homo sapiens
  Payload ID: 16726
  Gene Symbol: ST6GALNAC1
  Gene Name: ST6 (alpha-N-acetyl-neuraminyl-2,3-beta-galactosyl-1,3)-N-acetylgalactosaminide alpha-2,6-sialyltransferase 1
  ENSP ID: ENSP00000466230
  MOD_RES (1)..(1): Any amino acid
XVRYLHFLEGTRDYEWLEALLMNQTAQTPGSFSGSPAHGQVPVAAPRLSPIHEEQVSEV

SEQ ID NO: 84069 - protein, 152 aa, Homo sapiens
  Payload ID: 16726
  Gene Symbol: ST6GALNAC1
  Gene Name: ST6 (alpha-N-acetyl-neuraminyl-2,3-beta-galactosyl-1,3)-N-acetylgalactosaminide alpha-2,6-sialyltransferase 1
  ENSP ID: ENSP00000466436
GSLRCITCAVVGNGGILNNSHMGQEIDSHDYVFRLSGALIKGYEQDVGTRTSFYGFTAFSLTQSLLILGNRGFKNVPLGKDVRYLHFLEGTRDYEWLEALLMNQTVMSKNLFWFRHRPQEAFREALHMDRFLRSKTLDGAHWRIYRPTTGAL

SEQ ID NO: 84070 - protein, 63 aa, Homo sapiens; identical to SEQ ID NO: 84066
  Payload ID: 16726
  Gene Symbol: ST6GALNAC1
  Gene Name: ST6 (alpha-N-acetyl-neuraminyl-2,3-beta-galactosyl-1,3)-N-acetylgalactosaminide alpha-2,6-sialyltransferase 1
  ENSP ID: ENSP00000468784

SEQ ID NO: 84071 - protein, 374 aa, Homo sapiens
  Payload ID: 16727
  Gene Symbol: ST6GALNAC2
  Gene Name: ST6 (alpha-N-acetyl-neuraminyl-2,3-beta-galactosyl-1,3)-N-acetylgalactosaminide alpha-2,6-sialyltransferase 2
  Uniprot ID: Q9UJ37
  ENSP ID: ENSP00000225276
MGLPRGSFFWLLLLLTAACSGLLFALYFSAVQRYPGPAAGARDTTSFEAFFQSKASNSWTGKGQACRHLLHLAIQRHPHFRGLFNLSIPVLLWGDLFTPALWDRLSQHKAPYGWRGLSHQVIASTLSLLNGSESAKLFAPPRDTPPKCIRCAVVGNGGILNGSRQGPNIDAHDYVFRLNGAVIKGFERDVGTKTSFYGFTVNTMKNSLVSYWNLGFTSVPQGQDLQYIFIPSDIRDYVMLRSAILGVPVPEGLDKGDRPHAYFGPEASASKFKLLHPDFISYLTERFLKSKLINTHFGDLYMPSTGALMLLTALHTCDQVSAYGFITSNYWKFSDHYFERKMKPLIFYANHDLSLEAALWRDLHKAGILQLYQR

SEQ ID NO: 84072 - protein, 38 aa, Homo sapiens
  Payload ID: 16727
  Gene Symbol: ST6GALNAC2
  Gene Name: ST6 (alpha-N-acetyl-neuraminyl-2,3-beta-galactosyl-1,3)-N-acetylgalactosaminide alpha-2,6-sialyltransferase 2
  ENSP ID: ENSP00000464915
  MOD_RES (1)..(1): Any amino acid
XDYVMLRSAILGVPVPEGLDKGDSPAPTAQGTAATPAP

SEQ ID NO: 84073 - protein, 84 aa, Homo sapiens
  Payload ID: 16727
  Gene Symbol: ST6GALNAC2
  Gene Name: ST6 (alpha-N-acetyl-neuraminyl-2,3-beta-galactosyl-1,3)-N-acetylgalactosaminide alpha-2,6-sialyltransferase 2
  ENSP ID: ENSP00000465778
MGLPRGSFFWLLLLLTAACSGLLFALYFSAVQRYPGPAAGARARPADTCFTWPFSGTPTSVACSISPFQCCCGGTSSPQRSGTA

SEQ ID NO: 84074 - protein, 74 aa, Homo sapiens
  Payload ID: 16727
  Gene Symbol: ST6GALNAC2
  Gene Name: ST6 (alpha-N-acetyl-neuraminyl-2,3-beta-galactosyl-1,3)-N-acetylgalactosaminide alpha-2,6-sialyltransferase 2
  ENSP ID: ENSP00000466513
MGLPRGSFFWLLLLLTAACSGLLFALYFSAVQRYPGPAAGASCQPRVPSTCGCWGEGRGLREAWPPFERGHHII

SEQ ID NO: 84075 - protein, 212 aa, Homo sapiens
  Payload ID: 16727
  Gene Symbol: ST6GALNAC2
  Gene Name: ST6 (alpha-N-acetyl-neuraminyl-2,3-beta-galactosyl-1,3)-N-acetylgalactosaminide alpha-2,6-sialyltransferase 2
  ENSP ID: ENSP00000466560
LSLLNGSESAKLFAPPRDTPPKCIRCAVVGNGGILNGSRQGPNIDAHDYVFRLNGAVIKGFERDVGTKTSFYGFTVNTMKNSLVSYWNLGFTSVPQGQDLQYIFIPSDIRDYVMLRSAILGVPVPEGLDKGDRFLKSKLINTHFGDLYMPSTGALMLLTALHTCDQVSAYGFITSNYWKFSDHYFERKMKPLIFYANHDLSLEAALWRDLHK

SEQ ID NO: 84076 - protein, 283 aa, Homo sapiens
  Payload ID: 16727
  Gene Symbol: ST6GALNAC2
  Gene Name: ST6 (alpha-N-acetyl-neuraminyl-2,3-beta-galactosyl-1,3)-N-acetylgalactosaminide alpha-2,6-sialyltransferase 2
  ENSP ID: ENSP00000489527
MSSPSHTPNPSPTQSPSQSRSNNIVTPPGQQPAPSPSPTRGSSSRPPSHPPTPNASQPSSRTSSLNPSPQVQHVPRGAAQTPTPPTSKSPSQSGFKSLSRNPSLTPAVPPKSSFYSPATSSSYIGPIQNIPSYITPYVPRFLKEPPFFQPPTAPLPQNPCFACPSPCPARKPPPPPDSLYLPLLPPPPHHPQFNCPFPTPPGLFMPPSSLSYTPPVEVLVSGKPHVVPNVLPATFYTPFSRYYSQPRSYRSGYRGYSGALTLPSISPLQYDGSGRSVHFYHGS

SEQ ID NO: 84077 - protein, 305 aa, Homo sapiens
  Payload ID: 16728
  Gene Symbol: ST6GALNAC3
  Gene Name: ST6 (alpha-N-acetyl-neuraminyl-2,3-beta-galactosyl-1,3)-N-acetylgalactosaminide alpha-2,6-sialyltransferase 3
  Uniprot ID: Q8NDV1
  ENSP ID: ENSP00000329214
MACILKRKSVIAVSFIAAFLFLLVVRLVNEVNFPLLLNCFGQPGTKWIPFSYTYRRPLRTHYGYINVKTQEPLQLDCDLCAIVSNSGQMVGQKVGNEIDRSSCIWRMNNAPTKGYEEDVGRMTMIRVVSHTSVPLLLKNPDYFFKEANTTIYVIWGPFRNMRKDGNGIVYNMLKKTVGIYPNAQIYVTTEKRMSYCDGVFKKETGKDRVQSGSYLSTGWFTFLLAMDACYGIHVYGMINDTYCKTEGYRKVPYHYYEQGRDECDEYFLHEHAPYGGHRFITEKKVFAKWAKKHRIIFTHPNWTLS

SEQ ID NO: 84078 - protein, 139 aa, Homo sapiens [sequence omitted]

SEQ ID NO: 84079 - protein, 302 aa, Homo sapiens
  Payload ID: 16729
  Gene Symbol: ST6GALNAC4
  Gene Name: ST6 (alpha-N-acetyl-neuraminyl-2,3-beta-galactosyl-1,3)-N-acetylgalactosaminide alpha-2,6-sialyltransferase 4
  Uniprot ID: Q9H4F1
  ENSP ID: ENSP00000336733
MKAPGRLVLIILCSVVFSAVYILLCCWAGLPLCLATCLDHHFPTGSRPTVPGPLHFSGYSSVPDGKPLVREPCRSCAVVSSSGQMLGSGLGAEIDSAECVFRMNQAPTVGFEADVGQRSTLRVVSHTSVPLLLRNYSHYFQKARDTLYMVWGQGRHMDRVLGGRTYRTLLQLTRMYPGLQVYTFTERMMAYCDQIFQDETGKNRRQSGSFLSTGWFTMILALELCEEIVVYGMVSDSYCREKSHPSVPYHYFEKGRLDECQMYLAHEQAPRSAHRFITEKAVFSRWAKKRPIVFAHPSWRTE

SEQ ID NO: 84080 - protein, 200 aa, Homo sapiens
  Payload ID: 16729
  Gene Symbol: ST6GALNAC4
  Gene Name: ST6 (alpha-N-acetyl-neuraminyl-2,3-beta-galactosyl-1,3)-N-acetylgalactosaminide alpha-2,6-sialyltransferase 4
  ENSP ID: ENSP00000355130
MLGSGLGAEIDSAECVFRMNQAPTVGFEADVGQRSTLRVVSHTSVPLLLRNYSHYFQKARDTLYMVWGQGRHMDRVLGGRTYRTLLQLTRMYPGLQVYTFTERMMAYCDQIFQDETGKNRRQSGSFLSTGWFTMILALELCEEIVVYGMVSDSYCREKSHPSVPYHYFEKGRLDECQMYLAHEQAPRSAHRFITEKAVFS

SEQ ID NO: 84081 - protein, 336 aa, Homo sapiens
  Payload ID: 16730
  Gene Symbol: ST6GALNAC5
  Gene Name: ST6 (alpha-N-acetyl-neuraminyl-2,3-beta-galactosyl-1,3)-N-acetylgalactosaminide alpha-2,6-sialyltransferase 5
  Uniprot ID: Q9BVH7
  ENSP ID: ENSP00000417583
MKTLMRHGLAVCLALTTMCTSLLLVYSSLGGQKERPPQQQQQQQQQQQQASATGSSQPAAESSTQQRPGVPAGPRPLDGYLGVADHKPLKMHCRDCALVTSSGHLLHSRQGSQIDQTECVIRMNDAPTRGYGRDVGNRTSLRVIAHSSIQRILRNRHDLLNVSQGTVFIFWGPSSYMRRDGKGQVYNNLHLLSQVLPRLKAFMITRHKMLQFDELFKQETGKDRKISNTWLSTGWFTMTIALELCDRINVYGMVPPDFCRDPNHPSVPYHYYEPFGPDECTMYLSHERGRKGSHHRFITEKRVFKNWARTFNIHFFQPDWKPESLAINHPENKPVF

SEQ ID NO: 84082 - protein, 236 aa, Homo sapiens
  Payload ID: 16730
  Gene Symbol: ST6GALNAC5
  Gene Name: ST6 (alpha-N-acetyl-neuraminyl-2,3-beta-galactosyl-1,3)-N-acetylgalactosaminide alpha-2,6-sialyltransferase 5
  ENSP ID: ENSP00000436263
MKTLMRHGLAVCLALTTMCTSLLLVYSSLGGQKERPPQQQQQQQQQQQQASATGSSQPAAESSTQQRPGVPAGPRPLDGYLGVADHKPLKMHCRDCALVTSSGHLLHSRQGSQIDQTECVIRMNDAPTRGYGRDVGNRTSLRVIAHSSIQRILRNRHDLLNVSQGTVFIFWGPSSYMRRDGKGQVYNNLHLLSQVLPRLKAFMITRHKMLQFDELFKQETGKDRYPTLGSALAGLQ

SEQ ID NO: 84083 - protein, 333 aa, Homo sapiens
  Payload ID: 16731
  Gene Symbol: ST6GALNAC6
  Gene Name: ST6 (alpha-N-acetyl-neuraminyl-2,3-beta-galactosyl-1,3)-N-acetylgalactosaminide alpha-2,6-sialyltransferase 6
  Uniprot ID: Q969X2
  ENSP ID: ENSP00000291839
MACSRPPSQCEPTSLPPGPPAGRRHLPLSRRRREMSSNKEQRSAVFVILFALITILILYSSNSANEVFHYGSLRGRSRRPVNLKKWSITDGYVPILGNKTLPSRCHQCVIVSSSSHLLGTKLGPEIERAECTIRMNDAPTTGYSADVGNKTTYRVVAHSSVFRVLRRPQEFVNRTPETVFIFWGPPSKMQKPQGSLVRVIQRAGLVFPNMEAYAVSPGRMRQFDDLFRGETGKDREKSHSWLSTGWFTMVIAVELCDHVHVYGMVPPNYCSQRPRLQRMPYHYYEPKGPDECVTYIQNEHSRKGNHHRFITEKRVFSSWAQLYGITFSHPSWT

SEQ ID NO: 84084 - protein, 299 aa, Homo sapiens
  Payload ID: 16731
  Gene Symbol: ST6GALNAC6
  Gene Name: ST6 (alpha-N-acetyl-neuraminyl-2,3-beta-galactosyl-1,3)-N-acetylgalactosaminide alpha-2,6-sialyltransferase 6
  Uniprot ID: Q969X2
  ENSP ID: ENSP00000362234
MSSNKEQRSAVFVILFALITILILYSSNSANEVFHYGSLRGRSRRPVNLKKWSITDGYVPILGNKTLPSRCHQCVIVSSSSHLLGTKLGPEIERAECTIRMNDAPTTGYSADVGNKTTYRVVAHSSVFRVLRRPQEFVNRTPETVFIFWGPPSKMQKPQGSLVRVIQRAGLVFPNMEAYAVSPGRMRQFDDLFRGETGKDREKSHSWLSTGWFTMVIAVELCDHVHVYGMVPPNYCSQRPRLQRMPYHYYEPKGPDECVTYIQNEHSRKGNHHRFITEKRVFSSWAQLYGITFSHPSWT

SEQ ID NO: 84085 - protein, 374 aa, Homo sapiens
  Payload ID: 16731
  Gene Symbol: ST6GALNAC6
  Gene Name: ST6 (alpha-N-acetyl-neuraminyl-2,3-beta-galactosyl-1,3)-N-acetylgalactosaminide alpha-2,6-sialyltransferase 6
  Uniprot ID: Q969X2
  ENSP ID: ENSP00000362235
MACSRPPSQCEPTSLPPGPPAGRRHLPLSRRRREMSSNKEQRSAVFVILFALITILILYSSNSANEVFHYGSLRGRSRRPVNLKKWSITDGYVPILGNKTLPSRCHQCVIVSSSSHLLGTKLGPEIERAECTIRMNDAPTTGYSADVGNKTTYRVVAHSSVFRVLRRPQEFVNRTPETVFIFWGPPSKMQKPQGSLVRVIQRAGLVFPNMEAYAVSPGRMRQFDDLFRGETGKDREKSHSWLSTGWFTMVIAVELCDHVHVYGMVPPNYCSGPASSACPTTTTSPRGRTNVSPTSRMSTVARATTTASSPRKGSSHRGPSCMASPSPTPPGPRPPSLWDLRRVRGEAASAQPLGQGPSSGQSRLAGVSPSQSGP

SEQ ID NO: 84086 - protein, 299 aa, Homo sapiens; identical to SEQ ID NO: 84084
  Payload ID: 16731
  Gene Symbol: ST6GALNAC6
  Gene Name: ST6 (alpha-N-acetyl-neuraminyl-2,3-beta-galactosyl-1,3)-N-acetylgalactosaminide alpha-2,6-sialyltransferase 6
  Uniprot ID: Q969X2
  ENSP ID: ENSP00000362237

SEQ ID NO: 84087 - protein, 333 aa, Homo sapiens; identical to SEQ ID NO: 84083
  Payload ID: 16731
  Gene Symbol: ST6GALNAC6
  Gene Name: ST6 (alpha-N-acetyl-neuraminyl-2,3-beta-galactosyl-1,3)-N-acetylgalactosaminide alpha-2,6-sialyltransferase 6
  Uniprot ID: Q969X2
  ENSP ID: ENSP00000362239

SEQ ID NO: 84088 - protein, 200 aa, Homo sapiens
  Payload ID: 16731
  Gene Symbol: ST6GALNAC6
  Gene Name: ST6 (alpha-N-acetyl-neuraminyl-2,3-beta-galactosyl-1,3)-N-acetylgalactosaminide alpha-2,6-sialyltransferase 6
  ENSP ID: ENSP00000405326
MSSNKEQRSAVFVILFALITILILYSSNSANEVFHYGSLRGRSRRPVNLKKWSITDGYVPILGNKTLPSRCHQCVIVSSSSHLLGTKLGPEIERAECTIRMNDAPTTGYSADVGNKTTYRVVAHSSVFRVLRRPQEFVNRTPETVFIFWGPPSKMQKPQGSLVRVIQRAGLVFPNMEAYAVSPGRMRQFDDLFRGETGKD

SEQ ID NO: 84089 - protein, 86 aa, Homo sapiens
  Payload ID: 16731
  Gene Symbol: ST6GALNAC6
  Gene Name: ST6 (alpha-N-acetyl-neuraminyl-2,3-beta-galactosyl-1,3)-N-acetylgalactosaminide alpha-2,6-sialyltransferase 6
  ENSP ID: ENSP00000438109
MSSNKEQRSAVFVILFALITILILYSSNSANEVFHYGSLRGRSRRPVNLKKWSITDGYVPILGNKGEVSFVVEHRLVYHGDRGGVV

SEQ ID NO: 84090 - protein, 299 aa, Homo sapiens; identical to SEQ ID NO: 84084
  Payload ID: 16731
  Gene Symbol: ST6GALNAC6
  Gene Name: ST6 (alpha-N-acetyl-neuraminyl-2,3-beta-galactosyl-1,3)-N-acetylgalactosaminide alpha-2,6-sialyltransferase 6
  Uniprot ID: Q969X2
  ENSP ID: ENSP00000477575

SEQ ID NO: 84091 - protein, 406 aa, Homo sapiens
  Payload ID: 16732
  Gene Symbol: ST6GAL1
  Gene Name: ST6 beta-galactosamide alpha-2,6-sialyltranferase 1
  Uniprot ID: P15907
  ENSP ID: ENSP00000169298
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWNKDSSSKNLIPRLQKIWKNYLSMNKYKVSYKGPGPGIKFSAEALRCHLRDHVNVSMVEVTDFPFNTSEWEGYLPKESIRTKAGPWGRCAVVSSAGSLKSSQLGREIDDHDAVLRFNGAPTANFQQDVGTKTTIRLMNSQLVTTEKRFLKDSLYNEGILIVWDPSVYHSDIPKWYQNPDYNFFNNYKTYRKLHPNQPFYILKPQMPWELWDILQEISPEEIQPNPPSSGMLGIIIMMTLCDQVDIYEFLPSKRKTDVCYYYQKFFDSACTMGAYHPLLYEKNLVKHLNQGTDEDIYLLGKATLPGFRTIHC

SEQ ID NO: 84092 - protein, 91 aa, Homo sapiens
  Payload ID: 16732
  Gene Symbol: ST6GAL1
  Gene Name: ST6 beta-galactosamide alpha-2,6-sialyltranferase 1
  ENSP ID: ENSP00000388789
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEA

SEQ ID NO: 84093 - protein, 45 aa, Homo sapiens
  Payload ID: 16732
  Gene Symbol: ST6GAL1
  Gene Name: ST6 beta-galactosamide alpha-2,6-sialyltranferase 1
  ENSP ID: ENSP00000388928
MIHTNLKKKFSCCVLVFLLFAVICVWKEKKKGSYYDSFKLQTKEF

SEQ ID NO: 84094 - protein, 406 aa, Homo sapiens; identical to SEQ ID NO: 84091
  Payload ID: 16732
  Gene Symbol: ST6GAL1
  Gene Name: ST6 beta-galactosamide alpha-2,6-sialyltranferase 1
  Uniprot ID: P15907
  ENSP ID: ENSP00000389337

SEQ ID NO: 84095 - protein, 98 aa, Homo sapiens
  Payload ID: 16732
  Gene Symbol: ST6GAL1
  Gene Name: ST6 beta-galactosamide alpha-2,6-sialyltranferase 1
  ENSP ID: ENSP00000390793
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWNK

SEQ ID NO: 84096 - protein, 21 aa, Homo sapiens
  Payload ID: 16732
  Gene Symbol: ST6GAL1
  Gene Name: ST6 beta-galactosamide alpha-2,6-sialyltranferase 1
  ENSP ID: ENSP00000397273
MNSQLVTTEKRFLKDSLYNEG

SEQ ID NO: 84097 - protein, 42 aa, Homo sapiens
  Payload ID: 16732
  Gene Symbol: ST6GAL1
  Gene Name: ST6 beta-galactosamide alpha-2,6-sialyltranferase 1
  ENSP ID: ENSP00000399525
MIHTNLKKKFSCCVLVFLLFAVICVWKEKKKGSYYDSFKLQT

SEQ ID NO: 84098 - protein, 25 aa, Homo sapiens
  Payload ID: 16732
  Gene Symbol: ST6GAL1
  Gene Name: ST6 beta-galactosamide alpha-2,6-sialyltranferase 1
  ENSP ID: ENSP00000400547
MIHTNLKKKFSCCVLVFLLFAVICV

SEQ ID NO: 84099 - protein, 115 aa, Homo sapiens
  Payload ID: 16732
  Gene Symbol: ST6GAL1
  Gene Name: ST6 beta-galactosamide alpha-2,6-sialyltranferase 1
  ENSP ID: ENSP00000403063
MNSQLVTTEKRFLKDSLYNEGILIVWDPSVYHSDIPKWYQNPDYNFFNNYKTYRKLHPNQPFYILKPQMPWELWDILQEISPEEIQPNPPSSGMLGIIIMMTLCDQVDIYEFLPS

SEQ ID NO: 84100 - protein, 113 aa, Homo sapiens
  Payload ID: 16732
  Gene Symbol: ST6GAL1
  Gene Name: ST6 beta-galactosamide alpha-2,6-sialyltranferase 1
  ENSP ID: ENSP00000407631
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWNKDSSSKNLIPRLQKIW

SEQ ID NO: 84101 - protein, 127 aa, Homo sapiens
  Payload ID: 16732
  Gene Symbol: ST6GAL1
  Gene Name: ST6 beta-galactosamide alpha-2,6-sialyltranferase 1
  ENSP ID: ENSP00000411518
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWNKDSSSKNLIPRLQKIWKNYLSMNKYKVSYK

SEQ ID NO: 84102 - protein, 175 aa, Homo sapiens
  Payload ID: 16732
  Gene Symbol: ST6GAL1
  Gene Name: ST6 beta-galactosamide alpha-2,6-sialyltranferase 1
  Uniprot ID: P15907
  ENSP ID: ENSP00000412221
MNSQLVTTEKRFLKDSLYNEGILIVWDPSVYHSDIPKWYQNPDYNFFNNYKTYRKLHPNQPFYILKPQMPWELWDILQEISPEEIQPNPPSSGMLGIIIMMTLCDQVDIYEFLPSKRKTDVCYYYQKFFDSACTMGAYHPLLYEKNLVKHLNQGTDEDIYLLGKATLPGFRTIHC

SEQ ID NO: 84103 - protein, 52 aa, Homo sapiens
  Payload ID: 16732
  Gene Symbol: ST6GAL1
  Gene Name: ST6 beta-galactosamide alpha-2,6-sialyltranferase 1
  ENSP ID: ENSP00000412821
MNSQLVTTEKRFLKDSLYNEGILIVWDPSVYHSDIPKWYQNPDYNFFNNYKT

SEQ ID NO: 84104 - protein, 74 aa, Homo sapiens
  Payload ID: 16732
  Gene Symbol: ST6GAL1
  Gene Name: ST6 beta-galactosamide alpha-2,6-sialyltranferase 1
  ENSP ID: ENSP00000414504
MIHTNLKKKFSCCVLVFLLFAVICVWKEKKKGSYYDSFKLQTKEFQVLKSLGKLAMGSDSQSVSSSSTQDPHRG

SEQ ID NO: 84105 - protein, 178 aa, Homo sapiens
  Payload ID: 16732
  Gene Symbol: ST6GAL1
  Gene Name: ST6 beta-galactosamide alpha-2,6-sialyltranferase 1
  ENSP ID: ENSP00000415886
LIPRLQKIWKNYLSMNKYKVSYKGPGPGIKFSAEALRCHLRDHVNVSMVEVTDFPFNTSEWEGYLPKESIRTKAGPWGRCAVVSSAGSLKSSQLGREIDDHDAVLRFNGAPTANFQQDVGTKTTIRLMNSQISVHHCARAARKVAHFPGYTTHPQESLSCCFLVGYHREALPQRQFVQ

SEQ ID NO: 84106 - protein, 97 aa, Homo sapiens
  Payload ID: 16732
  Gene Symbol: ST6GAL1
  Gene Name: ST6 beta-galactosamide alpha-2,6-sialyltranferase 1
  ENSP ID: ENSP00000416163
MIHTNLKKKFSCCVLVFLLFAVICVWKEKKKGSYYDSFKLQTKEFQVLKSLGKLAMGSDSQSVSSSSTQDPHRGRQTLGSLRGLAKAKPEASFQVWN

SEQ ID NO: 84107 - protein, 529 aa, Homo sapiens
  Payload ID: 16733
  Gene Symbol: ST6GAL2
  Gene Name: ST6 beta-galactosamide alpha-2,6-sialyltranferase 2
  Uniprot ID: Q96JF0
  ENSP ID: ENSP00000355273
MKPHLKQWRQRMLFGIFAWGLLFLLIFIYFTDSNPAEPVPSSLSFLETRRLLPVQGKQRAIMGAAHEPSPPGGLDARQALPRAHPAGSFHAGPGDLQKWAQSQDGFEHKEFFSSQVGRKSQSAFYPEDDDYFFAAGQPGWHSHTQGTLGFPSPGEPGPREGAFPAAQVQRRRVKKRHRRQRRSHVLEEGDDGDRLYSSMSRAFLYRLWKGNVSSKMLNPRLQKAMKDYLTANKHGVRFRGKREAGLSRAQLLCQLRSRARVRTLDGTEAPFSALGWRRLVPAVPLSQLHPRGLRSCAVVMSAGAILNSSLGEEIDSHDAVLRFNSAPTRGYEKDVGNKTTIRIINSQILTNPSHHFIDSSLYKDVILVAWDPAPYSANLNLWYKKPDYNLFTPYIQHRQRNPNQPFYILHPKFIWQLWDIIQENTKEKIQPNPPSSGFIGILIMMSMCREVHVYEYIPSVRQTELCHYHELYYDAACTLGAYHPLLYEKLLVQRLNMGTQGDLHRKGKVVLPGFQAVHCPAPSPVIPHS

SEQ ID NO: 84108 - protein, 95 aa, Homo sapiens
  Payload ID: 16733
  Gene Symbol: ST6GAL2
  Gene Name: ST6 beta-galactosamide alpha-2,6-sialyltranferase 2
  ENSP ID: ENSP00000355386
  MOD_RES (1)..(1): Any amino acid
XSGFIGILIMMSMCREVHVYEYIPSVRQTELCHYHELYYDAACTLGAYHPLLYEKLLVQRLNMGTQGDLHRKGKVVLPGFQAVHCPAPSPVIPHS

SEQ ID NO: 84109 - protein, 529 aa, Homo sapiens; identical to SEQ ID NO: 84107
  Payload ID: 16733
  Gene Symbol: ST6GAL2
  Gene Name: ST6 beta-galactosamide alpha-2,6-sialyltranferase 2
  Uniprot ID: Q96JF0
  ENSP ID: ENSP00000386942

SEQ ID NO: 84110 - protein, 466 aa, Homo sapiens
  Payload ID: 16733
  Gene Symbol: ST6GAL2
  Gene Name: ST6 beta-galactosamide alpha-2,6-sialyltranferase 2
  Uniprot ID: Q96JF0
  ENSP ID: ENSP00000387332
MKPHLKQWRQRMLFGIFAWGLLFLLIFIYFTDSNPAEPVPSSLSFLETRRLLPVQGKQRAIMGAAHEPSPPGGLDARQALPRAHPAGSFHAGPGDLQKWAQSQDGFEHKEFFSSQVGRKSQSAFYPEDDDYFFAAGQPGWHSHTQGTLGFPSPGEPGPREGAFPAAQVQRRRVKKRHRRQRRSHVLEEGDDGDRLYSSMSRAFLYRLWKGNVSSKMLNPRLQKAMKDYLTANKHGVRFRGKREAGLSRAQLLCQLRSRARVRTLDGTEAPFSALGWRRLVPAVPLSQLHPRGLRSCAVVMSAGAILNSSLGEEIDSHDAVLRFNSAPTRGYEKDVGNKTTIRIINSQILTNPSHHFIDSSLYKDVILVAWDPAPYSANLNLWYKKPDYNLFTPYIQHRQRNPNQPFYILHPKFIWQLWDIIQENTKEKIQPNPPSSGFIGSFVKIGHIRACSEPRSRDCTPAWTTE

SEQ ID NO: 84111 - protein, 34 aa, Homo sapiens
  Payload ID: 16733
  Gene Symbol: ST6GAL2
  Gene Name: ST6 beta-galactosamide alpha-2,6-sialyltranferase 2
  ENSP ID: ENSP00000395581
MKPHLKQWRQRMLFGIFAWGLLFLLIFIYFTDSN

SEQ ID NO: 84112 - protein, 135 aa, Homo sapiens
  Payload ID: 16734
  Gene Symbol: ST8SIA1
  Gene Name: ST8 alpha-N-acetyl-neuraminide alpha-2,8-sialyltransferase 1
  Uniprot ID: Q92185
  ENSP ID: ENSP00000261197
MSPCGRARRQTSRGAMAVLAWKFPRTRLPMGASALCVVVLCWLYIFPVYRLPNEKEIVQGVLQQGTAWRRNQTAARAFRKQMEDCCDPAHLFAMTKMNSPMGKSMWYDGEFLYSFTIDNSTYSLFPQMQSPSFVK

SEQ ID NO: 84113 - protein, 83 aa, Homo sapiens
  Payload ID: 16734
  Gene Symbol: ST8SIA1
  Gene Name: ST8 alpha-N-acetyl-neuraminide alpha-2,8-sialyltransferase 1
  ENSP ID: ENSP00000370832
MSPCGRARRQTSRGAMAVLAWKFPRTRLPMGASALCVVVLCWLYIFPVYRLPNEKEIVQGVLQQGTAWRRNQTAARAFSCGIA

SEQ ID NO: 84114 - protein, 356 aa, Homo sapiens
  Payload ID: 16734
  Gene Symbol: ST8SIA1
  Gene Name: ST8 alpha-N-acetyl-neuraminide alpha-2,8-sialyltransferase 1
  Uniprot ID: Q92185
  ENSP ID: ENSP00000379353
MSPCGRARRQTSRGAMAVLAWKFPRTRLPMGASALCVVVLCWLYIFPVYRLPNEKEIVQGVLQQGTAWRRNQTAARAFRKQMEDCCDPAHLFAMTKMNSPMGKSMWYDGEFLYSFTIDNSTYSLFPQATPFQLPLKKCAVVGNGGILKKSGCGRQIDEANFVMRCNLPPLSSEYTKDVGSKSQLVTANPSIIRQRFQNLLWSRKTFVDNMKIYNHSYIYMPAFSMKTGTEPSLRVYYTLSDVGANQTVLFANPNFLRSIGKFWKSRGIHAKRLSTGLFLVSAALGLCEEVAIYGFWPFSVNMHEQPISHHYYDNVLPFSGFHAMPEEFLQLWYLHKIGALRMQLDPCEDTSLQPTS

SEQ ID NO: 84115 - protein, 120 aa, Homo sapiens
  Payload ID: 16734
  Gene Symbol: ST8SIA1
  Gene Name: ST8 alpha-N-acetyl-neuraminide alpha-2,8-sialyltransferase 1
  ENSP ID: ENSP00000384467
MSPCGRARRQTSRGAMAVLAWKFPRTRLPMGASALCVVVLCWLYIFPVYRLPNEKEIVQGVLQQGTAWRRNQTAARAFSVSTLLTLAAHESLNIHLGGGITVLVFKEHRFYFTSGPKMQD

SEQ ID NO: 84116 - protein, 172 aa, Homo sapiens
  Payload ID: 16734
  Gene Symbol: ST8SIA1
  Gene Name: ST8 alpha-N-acetyl-neuraminide alpha-2,8-sialyltransferase 1
  ENSP ID: ENSP00000440292
PRTRLPMGASALCVVVLCWLYIFPVYRLPNEKEIVQGVLQQGTAWRRNQTAARAFRKQMEDCCDPAHLFAMTKMNSPMGKSMWYDGEFLYSFTIDNSTYSLFPQATPFQLPLKKCAVVGNGGILKKSGCGRQIDEANFVMRCNLPPLSSEYTKDVGSKSQLVTANPSIIRQR

SEQ ID NO: 84117 - protein, 190 aa, Homo sapiens
  Payload ID: 16734
  Gene Symbol: ST8SIA1
  Gene Name: ST8 alpha-N-acetyl-neuraminide alpha-2,8-sialyltransferase 1
  ENSP ID: ENSP00000441707
LFQDRRELAGYFAGLKMIFILKNLYQPPLWKQMEDCCDPAHLFAMTKMNSPMGKSMWYDGEFLYSFTIDNSTYSLFPQATPFQLPLKKCAVVGNGGILKKSGCGRQIDEANFVMRCNLPPLSSEYTKDVGSKSQLVTANPSIIRQRFQNLLWSRKTFVDNMKIYNHSYIYMPAFSMKTGTEPSLRVYYTL

SEQ ID NO: 84118 - protein, 24 aa, Homo sapiens
  Payload ID: 16734
  Gene Symbol: ST8SIA1
  Gene Name: ST8 alpha-N-acetyl-neuraminide alpha-2,8-sialyltransferase 1
  ENSP ID: ENSP00000444999
SQLVTANPSIIRQRDFTAVERVKK

SEQ ID NO: 84119 - protein, 375 aa, Homo sapiens
  Payload ID: 16735
  Gene Symbol: ST8SIA2
  Gene Name: ST8 alpha-N-acetyl-neuraminide alpha-2,8-sialyltransferase 2
  Uniprot ID: Q92186
  ENSP ID: ENSP00000268164
MQLQFRSWMLAALTLLVVFLIFADISEIEEEIGNSGGRGTIRSAVNSLHSKSNRAEVVINGSSSPAVVDRSNESIKHNIQPASSKWRHNQTLSLRIRKQILKFLDAEKDISVLKGTLKPGDIIHYIFDRDSTMNVSQNLYELLPRTSPLKNKHFGTCAIVGNSGVLLNSGCGQEIDAHSFVIRCNLAPVQEYARDVGLKTDLVTMNPSVIQRAFEDLVNATWREKLLQRLHSLNGSILWIPAFMARGGKERVEWVNELILKHHVNVRTAYPSLRLLHAVRGYWLTNKVHIKRPTTGLLMYTLATRFCKQIYLYGFWPFPLDQNQNPVKYHYYDSLKYGYTSQASPHTMPLEFKALKSLHEQGALKLTVGQCDGAT

SEQ ID NO: 84120 - protein, 354 aa, Homo sapiens
  Payload ID: 16735
  Gene Symbol: ST8SIA2
  Gene Name: ST8 alpha-N-acetyl-neuraminide alpha-2,8-sialyltransferase 2
  ENSP ID: ENSP00000437382
MQLQFRSWMLAALTLLVVFLIFADISEIEEEIGAEVVINGSSSPAVVDRSNESIKHNIQPASSKWRHNQTLSLRIRKQILKFLDAEKDISVLKGTLKPGDIIHYIFDRDSTMNVSQNLYELLPRTSPLKNKHFGTCAIVGNSGVLLNSGCGQEIDAHSFVIRCNLAPVQEYARDVGLKTDLVTMNPSVIQRAFEDLVNATWREKLLQRLHSLNGSILWIPAFMARGGKERVEWVNELILKHHVNVRTAYPSLRLLHAVRGYWLTNKVHIKRPTTGLLMYTLATRFCKQIYLYGFWPFPLDQNQNPVKYHYYDSLKYGYTSQASPHTMPLEFKALKSLHEQGALKLTVGQCDGAT

SEQ ID NO: 84121 - protein, 332 aa, Homo sapiens
  Payload ID: 16735
  Gene Symbol: ST8SIA2
  Gene Name: ST8 alpha-N-acetyl-neuraminide alpha-2,8-sialyltransferase 2
  ENSP ID: ENSP00000450851
MQLQFRSWMLAALTLLVVFLIFADISEIEEEIGNSGGRGTIRSAVNSLHSKSNRKQILKFLDAEKDISVLKGTLKPGDIIHYIFDRDSTMNVSQNLYELLPRTSPLKNKHFGTCAIVGNSGVLLNSGCGQEIDAHSFVIRCNLAPVQEYARDVGLKTDLVTMNPSVIQRAFEDLVNATWREKLLQRLHSLNGSILWIPAFMARGGKERVEWVNELILKHHVNVRTAYPSLRLLHAVRGYWLTNKVHIKRPTTGLLMYTLATRFCKQIYLYGFWPFPLDQNQNPVKYHYYDSLKYGYTSQASPHTMPLEFKALKSLHEQGALKLTVGQCDGAT

SEQ ID NO: 84122 - protein, 380 aa, Homo sapiens
  Payload ID: 16736
  Gene Symbol: ST8SIA3
  Gene Name: ST8 alpha-N-acetyl-neuraminide alpha-2,8-sialyltransferase 3
  Uniprot ID: O43173
  ENSP ID: ENSP00000320431
MRNCKMARVASVLGLVMLSVALLILSLISYVSLKKENIFTTPKYASPGAPRMYMFHAGFRSQFALKFLDPSFVPITNSLTQELQEKPSKWKFNRTAFLHQRQEILQHVDVIKNFSLTKNSVRIGQLMHYDYSSHKYVFSISNNFRSLLPDVSPIMNKHYNICAVVGNSGILTGSQCGQEIDKSDFVFRCNFAPTEAFQRDVGRKTNLTTFNPSILEKYYNNLLTIQDRNNFFLSLKKLDGAILWIPAFFFHTSATVTRTLVDFFVEHRGQLKVQLAWPGNIMQHVNRYWKNKHLSPKRLSTGILMYTLASAICEEIHLYGFWPFGFDPNTREDLPYHYYDKKGTKFTTKWQESHQLPAEFQLLYRMHGEGLTKLTLSHCA

SEQ ID NO: 84123 - protein, 125 aa, Homo sapiens
  Payload ID: 16736
  Gene Symbol: ST8SIA3
  Gene Name: ST8 alpha-N-acetyl-neuraminide alpha-2,8-sialyltransferase 3
  ENSP ID: ENSP00000467752
  MOD_RES (1)..(1): Any amino acid
XKSDFVFRCNFAPTEAFQRDVGRKTNLTTFNPSILEKYYNNLLTIQDRNNFFLSLKKLDGAILWIPAFFFHTSATVTRTLVDFFVEHRGQLKVQLAWPGNIMQHVNRFFATLHCCKQCSDEHLWN

SEQ ID NO: 84124 - protein, 359 aa, Homo sapiens
  Payload ID: 16737
  Gene Symbol: ST8SIA4
  Gene Name: ST8 alpha-N-acetyl-neuraminide alpha-2,8-sialyltransferase 4
  Uniprot ID: Q92187
  ENSP ID: ENSP00000231461
MRSIRKRWTICTISLLLIFYKTKEIARTEEHQETQLIGDGELSLSRSLVNSSDKIIRKAGSSIFQHNVEGWKINSSLVLEIRKNILRFLDAERDVSVVKSSFKPGDVIHYVLDRRRTLNISHDLHSLLPEVSPMKNRRFKTCAVVGNSGILLDSECGKEIDSHNFVIRCNLAPVVEFAADVGTKSDFITMNPSVVQRAFGGFRNESDREKFVHRLSMLNDSVLWIPAFMVKGGEKHVEWVNALILKNKLKVRTAYPSLRLIHAVRGYWLTNKVPIKRPSTGLLMYTLATRFCDEIHLYGFWPFPKDLNGKAVKYHYYDDLKYRYFSNASPHRMPLEFKTLNVLHNRGALKLTTGKCVKQ

SEQ ID NO: 84125 - protein, 46 aa, Homo sapiens
  Payload ID: 16737
  Gene Symbol: ST8SIA4
  Gene Name: ST8 alpha-N-acetyl-neuraminide alpha-2,8-sialyltransferase 4
  ENSP ID: ENSP00000428826
MRSIRKRWTICTISLLLIFYKTKEIARTEEHQETQLIGASGGGVDS

SEQ ID NO: 84126 - protein, 168 aa, Homo sapiens
  Payload ID: 16737
  Gene Symbol: ST8SIA4
  Gene Name: ST8 alpha-N-acetyl-neuraminide alpha-2,8-sialyltransferase 4
  Uniprot ID: Q92187
  ENSP ID: ENSP00000428914
MRSIRKRWTICTISLLLIFYKTKEIARTEEHQETQLIGDGELSLSRSLVNSSDKIIRKAGSSIFQHNVEGWKINSSLVLEIRKNILRFLDAERDVSVVKSSFKPGDVIHYVLDRRRTLNISHDLHSLLPEVSPMKNRRFKTCAVVGNSGILLDSECGKEIDSHNFVIR

SEQ ID NO: 84127 - protein, 376 aa, Homo sapiens
  Payload ID: 16738
  Gene Symbol: ST8SIA5
  Gene Name: ST8 alpha-N-acetyl-neuraminide alpha-2,8-sialyltransferase 5
  Uniprot ID: O15466
  ENSP ID: ENSP00000321343
MRYADPSANRDLLGSRTLLFIFICAFALVTLLQQILYGRNYIKRYFEFYEGPFEYNSTRCLELRHEILEVKVLSMVKQSELFDRWKSLQMCKWAMNISEANQFKSTLSRCCNAPAFLFTTQKNTPLGTKLKYEVDTSGIYHINQEIFRMFPKDMPYYRSQFKKCAVVGNGGILKNSRCGREINSADFVFRCNLPPISEKYTMDVGVKTDVVTVNPSIITERFHKLEKWRRPFYRVLQVYENASVLLPAFYNTRNTDVSIRVKYVLDDFESPQAVYYFHPQYLVNVSRYWLSLGVRAKRISTGLILVTAALELCEEVHLFGFWAFPMNPSGLYITHHYYDNVKPRPGFHAMPSEIFNFLHLHSRGILRVHTGTCSCC

SEQ ID NO: 84128 - protein, 345 aa, Homo sapiens
  Payload ID: 16738
  Gene Symbol: ST8SIA5
  Gene Name: ST8 alpha-N-acetyl-neuraminide alpha-2,8-sialyltransferase 5
  ENSP ID: ENSP00000443683
MRYADPSANRDLLGSRTLLFIFICAFALVTLLQQILYGRNYIKRVKQSELFDRWKSLQMCKWAMNISEANQFKSTLSRCCNAPAFLFTTQKNTPLGTKLKYEVDTSGIYHINQEIFRMFPKDMPYYRSQFKKCAVVGNGGILKNSRCGREINSADFVFRCNLPPISEKYTMDVGVKTDVVTVNPSIITERFHKLEKWRRPFYRVLQVYENASVLLPAFYNTRNTDVSIRVKYVLDDFESPQAVYYFHPQYLVNVSRYWLSLGVRAKRISTGLILVTAALELCEEVHLFGFWAFPMNPSGLYITHHYYDNVKPRPGFHAMPSEIFNFLHLHSRGILRVHTGTCSCC

SEQ ID NO: 84129 - protein, 412 aa, Homo sapiens
  Payload ID: 16738
  Gene Symbol: ST8SIA5
  Gene Name: ST8 alpha-N-acetyl-neuraminide alpha-2,8-sialyltransferase 5
  Uniprot ID: O15466
  ENSP ID: ENSP00000445492
MRYADPSANRDLLGSRTLLFIFICAFALVTLLQQILYGRNYIKRGLQFGWQSGDQLTNWTGLFNVTDDPAVQSGSDSSSRYFEFYEGPFEYNSTRCLELRHEILEVKVLSMVKQSELFDRWKSLQMCKWAMNISEANQFKSTLSRCCNAPAFLFTTQKNTPLGTKLKYEVDTSGIYHINQEIFRMFPKDMPYYRSQFKKCAVVGNGGILKNSRCGREINSADFVFRCNLPPISEKYTMDVGVKTDVVTVNPSIITERFHKLEKWRRPFYRVLQVYENASVLLPAFYNTRNTDVSIRVKYVLDDFESPQAVYYFHPQYLVNVSRYWLSLGVRAKRISTGLILVTAALELCEEVHLFGFWAFPMNPSGLYITHHYYDNVKPRPGFHAMPSEIFNFLHLHSRGILRVHTGTCSCC

SEQ ID NO: 84130 - protein, 40 aa, Homo sapiens
  Payload ID: 16738
  Gene Symbol: ST8SIA5
  Gene Name: ST8 alpha-N-acetyl-neuraminide alpha-2,8-sialyltransferase 5
  ENSP ID: ENSP00000466787
MVVVGTNEQVPLPRSQPACVCGRKNLISESQDLLLGCVML

SEQ ID NO: 84131 - protein, 54 aa, Homo sapiens
  Payload ID: 16738
  Gene Symbol: ST8SIA5
  Gene Name: ST8 alpha-N-acetyl-neuraminide alpha-2,8-sialyltransferase 5
  ENSP ID: ENSP00000468112
MVVVGTNEQVPLPRSQPACVCGRKNLISESQDLLLGTLNFMRGLLNITPQDAWS

SEQ ID NO: 84132 - protein, 398 aa, Homo sapiens
  Payload ID: 16739
  Gene Symbol: ST8SIA6
  Gene Name: ST8 alpha-N-acetyl-neuraminide alpha-2,8-sialyltransferase 6
  Uniprot ID: P61647
  ENSP ID: ENSP00000366827
MRPGGALLALLASLLLLLLLRLLWCPADAPGRARILVEESREATHGTPAALRTLRSPATAVPRATNSTYLNEKSLQLTEKCKNLQYGIESFSNKTKGYSENDYLQIITDIQSCPWKRQAEEYANFRAKLASCCDAVQNFVVSQNNTPVGTNMSYEVESKKEIPIKKNIFHMFPVSQPFVDYPYNQCAVVGNGGILNKSLCGTEIDKSDFVFRCNLPPTTGDVSKDVGSKTNLVTINPSIITLKYGNLKEKKALFLEDIATYGDAFFLLPAFSFRANTGTSFKVYYTLEESKARQKVLFFHPKYLKDLALFWRTKGVTAYRLSTGLMITSVAVELCKNVKLYGFWPFSKTVEDIPVSHHYYDNKLPKHGFHQMPKEYSQILQLHMKGILKLQFSKCEVA

SEQ ID NO: 84133 - protein, 128 aa, Homo sapiens
  Payload ID: 16739
  Gene Symbol: ST8SIA6
  Gene Name: ST8 alpha-N-acetyl-neuraminide alpha-2,8-sialyltransferase 6
  ENSP ID: ENSP00000388343
  MOD_RES (1)..(1): Any amino acid
XYPYNQCAVVGNGGILNKSLCGTEIDKSDFVFRCNLPPTTGDVSKDVGSKTNLVTINPSIITLKYGNLKEKKALFLEDIATYGDAFFLLPAFSFRANTGTSFKVYYTLEESKARQKCKTKRKTINSIL

SEQ ID NO: 84134 - protein, 2570 aa, Homo sapiens
  Payload ID: 16740
  Gene Symbol: STAB1
  Gene Name: stabilin 1
  Uniprot ID: Q9NY15
  ENSP ID: ENSP00000312946
MAGPRGLLPLCLLAFCLAGFSFVRGQVLFKGCDVKTTFVTHVPCTSCAAIKKQTCPSGWLRELPDQITQDCRYEVQLGGSMVSMSGCRRKCRKQVVQKACCPGYWGSRCHECPGGAETPCNGHGTCLDGMDRNGTCVCQENFRGSACQECQDPNRFGPDCQSVCSCVHGVCNHGPRGDGSCLCFAGYTGPHCDQELPVCQELRCPQNTQCSAEAPSCRCLPGYTQQGSECRAPNPCWPSPCSLLAQCSVSPKGQAQCHCPENYHGDGMVCLPKDPCTDNLGGCPSNSTLCVYQKPGQAFCTCRPGLVSINSNASAGCFAFCSPFSCDRSATCQVTADGKTSCVCRESEVGDGRACYGHLLHEVQKATQTGRVFLQLRVAVAMMDQGCREILTTAGPFTVLVPSVSSFSSRTMNASLAQQLCRQHIIAGQHILEDTRTQQTRRWWTLAGQEITVTFNQFTKYSYKYKDQPQQTFNIYKANNIAANGVFHVVTGLRWQAPSGTPGDPKRTIGQILASTEAFSRFETILENCGLPSILDGPGPFTVFAPSNEAVDSLRDGRLIYLFTAGLSKLQELVRYHIYNHGQLTVEKLISKGRILTMANQVLAVNISEEGRILLGPEGVPLQRVDVMAANGVIHMLDGILLPPTILPILPKHCSEEQHKIVAGSCVDCQALNTSTCPPNSVKLDIFPKECVYIHDPTGLNVLKKGCASYCNQTIMEQGCCKGFFGPDCTQCPGGFSNPCYGKGNCSDGIQGNGACLCFPDYKGIACHICSNPNKHGEQCQEDCGCVHGLCDNRPGSGGVCQQGTCAPGFSGRFCNESMGDCGPTGLAQHCHLHARCVSQEGVARCRCLDGFEGDGFSCTPSNPCSHPDRGGCSENAECVPGSLGTHHCTCHKGWSGDGRVCVAIDECELDMRGGCHTDALCSYVGPGQSRCTCKLGFAGDGYQCSPIDPCRAGNGGCHGLATCRAVGGGQRVCTCPPGFGGDGFSCYGDIFRELEANAHFSIFYQWLKSAGITLPADRRVTALVPSEAAVRQLSPEDRAFWLQPRTLPNLVRAHFLQGALFEEELARLGGQEVATLNPTTRWEIRNISGRVWVQNASVDVADLLATNGVLHILSQVLLPPRGDVPGGQGLLQQLDLVPAFSLFRELLQHHGLVPQIEAATAYTIFVPTNRSLEAQGNSSHLDADTVRHHVVLGEALSMETLRKGGHRNSLLGPAHWIVFYNHSGQPEVNHVPLEGPMLEAPGRSLIGLSGVLTVGSSRCLHSHAEALREKCVNCTRRFRCTQGFQLQDTPRKSCVYRSGFSFSRGCSYTCAKKIQVPDCCPGFFGTLCEPCPGGLGGVCSGHGQCQDRFLGSGECHCHEGFHGTACEVCELGRYGPNCTGVCDCAHGLCQEGLQGDGSCVCNVGWQGLRCDQKITSPQCPRKCDPNANCVQDSAGASTCACAAGYSGNGIFCSEVDPCAHGHGGCSPHANCTKVAPGQRTCTCQDGYMGDGELCQEINSCLIHHGGCHIHAECIPTGPQQVSCSCREGYSGDGIRTCELLDPCSKNNGGCSPYATCKSTGDGQRTCTCDTAHTVGDGLTCRARVGLELLRDKHASFFSLRLLEYKELKGDGPFTIFVPHADLMSNLSQDELARIRAHRQLVFRYHVVGCRRLRSEDLLEQGYATALSGHPLRFSEREGSIYLNDFARVVSSDHEAVNGILHFIDRVLLPPEALHWEPDDAPIPRRNVTAAAQGFGYKIFSGLLKVAGLLPLLREASHRPFTMLWPTDAAFRALPPDRQAWLYHEDHRDKLAAILRGHMIRNVEALASDLPNLGPLRTMHGTPISFSCSRTRAGELMVGEDDARIVQRHLPFEGGLAYGIDQLLEPPGLGARCDHFETRPLRLNTCSICGLEPPCPEGSQEQGSPEACWRFYPKFWTSPPLHSLGLRSVWVHPSLWGRPQGLGRGCHRNCVTTTWKPSCCPGHYGSECQACPGGPSSPCSDRGVCMDGMSGSGQCLCRSGFAGTACELCAPGAFGPHCQACRCTVHGRCDEGLGGSGSCFCDEGWTGPRCEVQLELQPVCTPPCAPEAVCRAGNSCECSLGYEGDGRVCTVADLCQDGHGGCSEHANCSQVGTMVTCTCLPDYEGDGWSCRARNPCTDGHRGGCSEHANCLSTGLNTRRCECHAGYVGDGLQCLEESEPPVDRCLGQPPPCHSDAMCTDLHFQEKRAGVFHLQATSGPYGLNFSEAEAACEAQGAVLASFPQLSAAQQLGFHLCLMGWLANGSTAHPVVFPVADCGNGRVGIVSLGARKNLSERWDAYCFRVQDVACRCRNGFVGDGISTCNGKLLDVLAATANFSTFYGMLLGYANATQRGLDFLDFLDDELTYKTLFVPVNEGFVDNMTLSGPDLELHASNATLLSANASQGKLLPAHSGLSLIISDAGPDNSSWAPVAPGTVVVSRIIVWDIMAFNGIIHALASPLLAPPQPQAVLAPEAPPVAAGVGAVLAAGALLGLVAGALYLRARGKPMGFGFSAFQAEDDADDDFSPWQEGTNPTLVSVPNPVFGSDTFCEPFDDSLLEEDFPDTQRILTVK

SEQ ID NO: 84135 - protein, 177 aa, Homo sapiens
  Payload ID: 16740
  Gene Symbol: STAB1
  Gene Name: stabilin 1
  ENSP ID: ENSP00000418426
  MOD_RES (1)..(1): Any amino acid
XDDELTYKTLFVPVNEGFVDNMTLSGPDLELHASNATLLSANASQGKLLPAHSGLSLIISDAGPDNSSWAPVQAVLAPEAPPVAAGVGAVLAAGALLGLVAGALYLRARGKPMGFGFSAFQAEDDADDDFSPWQEGTNPTLVSVPNPVFGSDTFCEPFDDSLLEEDFPDTQRILTVK

SEQ ID NO: 84136 - protein, 2551 aa, Homo sapiens
  Payload ID: 16741
  Gene Symbol: STAB2
  Gene Name: stabilin 2
  Uniprot ID: Q8WWQ8
  ENSP ID: ENSP00000373539
MMLQHLVIFCLGLVVQNFCSPAETTGQARRCDRKSLLTIRTECRSCALNLGVKCPDGYTMITSGSVGVRDCRYTFEVRTYSLSLPGCRHICRKDYLQPRCCPGRWGPDCIECPGGAGSPCNGRGSCAEGMEGNGTCSCQEGFGGTACETCADDNLFGPSCSSVCNCVHGVCNSGLDGDGTCECYSAYTGPKCDKPIPECAALLCPENSRCSPSTEDENKLECKCLPNYRGDGKYCDPINPCLRKICHPHAHCTYLGPNRHSCTCQEGYRGDGQVCLPVDPCQINFGNCPTKSTVCKYDGPGQSHCECKEHYQNFVPGVGCSMTDICKSDNPCHRNANCTTVAPGRTECICQKGYVGDGLTCYGNIMERLRELNTEPRGKWQGRLTSFISLLDKAYAWPLSKLGPFTVLLPTDKGLKGFNVNELLVDNKAAQYFVKLHIIAGQMNIEYMNNTDMFYTLTGKSGEIFNSDKDNQIKLKLHGGKKKVKIIQGDIIASNGLLHILDRAMDKLEPTFESNNEQTIMTMLQPRYSKFRSLLEETNLGHALDEDGVGGPYTIFVPNNEALNNMKDGTLDYLLSPEGSRKLLELVRYHIVPFTQLEVATLISTPHIRSMANQLIQFNTTDNGQILANDVAMEEIEITAKNGRIYTLTGVLIPPSIVPILPHRCDETKREMKLGTCVSCSLVYWSRCPANSEPTALFTHRCVYSGRFGSLKSGCARYCNATVKIPKCCKGFYGPDCNQCPGGFSNPCSGNGQCADSLGGNGTCICEEGFQGSQCQFCSDPNKYGPRCNKKCLCVHGTCNNRIDSDGACLTGTCRDGSAGRLCDKQTSACGPYVQFCHIHATCEYSNGTASCICKAGYEGDGTLCSEMDPCTGLTPGGCSRNAECIKTGTGTHTCVCQQGWTGNGRDCSEINNCLLPSAGGCHDNASCLYVGPGQNECECKKGFRGNGIDCEPITSCLEQTGKCHPLASCQSTSSGVWSCVCQEGYEGDGFLCYGNAAVELSFLSEAAIFNRWINNASLQPTLSATSNLTVLVPSQQATEDMDQDEKSFWLSQSNIPALIKYHMLLGTYRVADLQTLSSSDMLATSLQGNFLHLAKVDGNITIEGASIVDGDNAATNGVIHIINKVLVPQRRLTGSLPNLLMRLEQMPDYSIFRGYIIQYNLANAIEAADAYTVFAPNNNAIENYIREKKVLSLEEDVLRYHVVLEEKLLKNDLHNGMHRETMLGFSYFLSFFLHNDQLYVNEAPINYTNVATDKGVIHGLGKVLEIQKNRCDNNDTTIIRGRCRTCSSELTCPFGTKSLGNEKRRCIYTSYFMGRRTLFIGCQPKCVRTVITRECCAGFFGPQCQPCPGNAQNVCFGNGICLDGVNGTGVCECGEGFSGTACETCTEGKYGIHCDQACSCVHGRCNQGPLGDGSCDCDVGWRGVHCDNATTEDNCNGTCHTSANCLTNSDGTASCKCAAGFQGNGTICTAINACEISNGGCSAKADCKRTTPGRRVCTCKAGYTGDGIVCLEINPCLENHGGCDKNAECTQTGPNQAACNCLPAYTGDGKVCTLINVCLTKNGGCSEFAICNHTGQVERTCTCKPNYIGDGFTCRGSIYQELPKNPKTSQYFFQLQEHFVKDLVGPGPFTVFAPLSAAFDEEARVKDWDKYGLMPQVLRYHVVACHQLLLENLKLISNATSLQGEPIVISVSQSTVYINNKAKIISSDIISTNGIVHIIDKLLSPKNLLITPKDNSGRILQNLTTLATNNGYIKFSNLIQDSGLLSVITDPIHTPVTLFWPTDQALHALPAEQQDFLFNQDNKDKLKEYLKFHVIRDAKVLAVDLPTSTAWKTLQGSELSVKCGAGRDIGDLFLNGQTCRIVQRELLFDLGVAYGIDCLLIDPTLGGRCDTFTTFDASGECGSCVNTPSCPRWSKPKGVKQKCLYNLPFKRNLEGCRERCSLVIQIPRCCKGYFGRDCQACPGGPDAPCNNRGVCLDQYSATGECKCNTGFNGTACEMCWPGRFGPDCLPCGCSDHGQCDDGITGSGQCLCETGWTGPSCDTQAVLPAVCTPPCSAHATCKENNTCECNLDYEGDGITCTVVDFCKQDNGGCAKVARCSQKGTKVSCSCQKGYKGDGHSCTEIDPCADGLNGGCHEHATCKMTGPGKHKCECKSHYVGDGLNCEPEQLPIDRCLQDNGQCHADAKCVDLHFQDTTVGVFHLRSPLGQYKLTFDKAREACANEAATMATYNQLSYAQKAKYHLCSAGWLETGRVAYPTAFASQNCGSGVVGIVDYGPRPNKSEMWDVFCYRMKDVNCTCKVGYVGDGFSCSGNLLQVLMSFPSLTNFLTEVLAYSNSSARGRAFLEHLTDLSIRGTLFVPQNSGLGENETLSGRDIEHHLANVSMFFYNDLVNGTTLQTRLGSKLLITASQDPLQPTETRFVDGRAILQWDIFASNGIIHVISRPLKAPPAPVTLTHTGLGAGIFFAIILVTGAVALAAYSYFRINRRTIGFQHFESEEDINVAALGKQQPENISNPLYESTTSAPPEPSYDPFTDSEERQLEGNDPLRTL

SEQ ID NO: 84137 - protein, 135 aa, Homo sapiens
  Payload ID: 16741
  Gene Symbol: STAB2
  Gene Name: stabilin 2
  ENSP ID: ENSP00000446629
EDINVAALGKQQPENISNPLYESTTSAPPEPSYDPFTMKKLQPSWDDLSWATQLQAGETKTGGPTPSPSCLPTQGSSTNKHAQHIRVHSAQGESCLRPVATRKIQLGLNTQNALPPYNPLFSRTLKNGSLRAMTP

SEQ ID NO: 84138 - protein, 33 aa, Homo sapiens
  Payload ID: 16741
  Gene Symbol: STAB2
  Gene Name: stabilin 2
  ENSP ID: ENSP00000449282
QKNRCDNNDTTIIRGRCRTCSSELTCPFGTKSL

SEQ ID NO: 84139 - protein, 73 aa, Homo sapiens
  Payload ID: 16742
  Gene Symbol: SAXO1
  Gene Name: stabilizer of axonemal microtubules 1
  ENSP ID: ENSP00000369902
MKTKCICELCSCGRHHCPHLPTKIYDKTEKPCLLSEYTENYPFYHSYLPRESFKPRREYQKGPIPMEGLTTSS

SEQ ID NO: 84140 - protein, 474 aa, Homo sapiens
  Payload ID: 16742
  Gene Symbol: SAXO1
  Gene Name: stabilizer of axonemal microtubules 1
  Uniprot ID: Q8IYX7
  ENSP ID: ENSP00000369907
MKTKCICELCSCGRHHCPHLPTKIYDKTEKPCLLSEYTENYPFYHSYLPRESFKPRREYQKGPIPMEGLTTSRRDFGPHKVAPVKVHQYDQFVPSEENMDLLTTYKKDYNPYPVCRVDPIKPRDSKYPCSDKMECLPTYKADYLPWNQPRREPLRLEHKYQPASVRFDNRTTHQDDYPIKGLVKTISCKPLAMPKLCNIPLEDVTNYKMSYVAHPVEKRFVHEAEKFRPCEIPFESLTTQKQSYRGLMGEPAKSLKPLARPPGLDMPFCNTTEFRDKYQAWPMPRMFSKAPITYVPPEDRMDLLTTVQAHYTCPKGAPAQSCRPALQIKKCGRFEGSSTTKDDYKQWSSMRTEPVKPVPQLDLPTEPLDCLTTTRAHYVPHLPINTKSCKPHWSGPRGNVPVESQTTYTISFTPKEMGRCLASYPEPPGYTFEEVDALGHRIYKPVSQAGSQQSSHLSVDDSENPNQRELEVLA

SEQ ID NO: 84141 - protein, 409 aa, Homo sapiens
  Payload ID: 16742
  Gene Symbol: SAXO1
  Gene Name: stabilizer of axonemal microtubules 1
  ENSP ID: ENSP00000438823
MEGLTTSRRDFGPHKVAPVKVHQYDQFVPSEENMDLLTTYKKDYNPYPVCRVDPIKPRDSKYPCSDKMECLPTYKADYLPWNQPRREPLRLEHKYQPASVRFDNRTTHQDDYPIKGLVKTISCKPLAMPKLCNIPLEDVTNYKMSYVAHPVEKRFVHEAEKFRPCEIPFESLTTQKQSYRGLMGEPAKSLKPLARPPGLDMPFCNTTEFRDKYQAWPMPRMFSKAPITYVPPEDRMDLLTTVQAHYTCPKGAPAQSCRPALQIKKCGRFEGSSTTKDDYKQWSSMRTEPVKPVPQLDLPTEPLDCLTTTRAHYVPHLPINTKSCKPHWSGPRGNVPVESQTTYTISFTPKEMGRCLASYPEPPGYTFEEVDALGHRIYKPVSQAGSQQSSHLSVDDSENPNQRELEVLA

SEQ ID NO: 84142 - protein, 398 aa, Homo sapiens
  Payload ID: 16743
  Gene Symbol: SAXO2
  Gene Name: stabilizer of axonemal microtubules 2
  Uniprot ID: Q658L1
  ENSP ID: ENSP00000340445
MGAKSMRSWCLCQICSCGSDYCPYEIVKQPRHVPEEYKPKQGKIDLGTTYKRDLNSYKVQPVAIVRPLERQVKKGKLDTVPTYKDDYRAWDLHKSELYKPEQTYHPPTVKFGNSTTFQDDFVPQEIKPRQSFKPSSVVKRSTAPFNGITSHRLDYIPHQLELKFERPKEVYKPTDQRFEDLTTHRCDFQGLIGETAKLCRPVHTRVTQNALFEGSTEFRESFQPWEIPPPEVKKVPEYVPPTGSMLLNSTSHLDYVPYQANHVVPIRPVSQKRSNNFPFQGKSIMKEDFPAWESCRQGLIKKQQQIPNPSGKFDGLSTFRSHYVPHELIPTESCKPLNIAFKSSVPFDDVTMYSVEYTPKRQEICPASYPSPPGYIFDNTNSQGHKFFRKIIPAVKAF

SEQ ID NO: 84143 - protein, 29 aa, Homo sapiens
  Payload ID: 16743
  Gene Symbol: SAXO2
  Gene Name: stabilizer of axonemal microtubules 2
  ENSP ID: ENSP00000454320
MGAKSMRSWCLCQICSCGPGLTREPLPLP

SEQ ID NO: 84144 - protein, 30 aa, Homo sapiens
  Payload ID: 16743
  Gene Symbol: SAXO2
  Gene Name: stabilizer of axonemal microtubules 2
  ENSP ID: ENSP00000455158
MYDNVLPPQSLKAKQEIRACHGKMEGITTF

SEQ ID NO: 84145 - protein, 41 aa, Homo sapiens
  Payload ID: 16743
  Gene Symbol: SAXO2
  Gene Name: stabilizer of axonemal microtubules 2
  ENSP ID: ENSP00000455957
MGAKSMRSWCLCQICSCGFLSSQPDHIPIPVQAAVLWDPPD

SEQ ID NO: 84146 - protein, 104 aa, Homo sapiens
  Payload ID: 16743
  Gene Symbol: SAXO2
  Gene Name: stabilizer of axonemal microtubules 2
  ENSP ID: ENSP00000458067
MYDNVLPPQSLKAKQEIRACHGKMEGITTFKSDYCPYEIVKQPRHVPEEYKPKQGKIDLGTTYKRDLNSYKVQPVAIVRPLERQVKKGKLDTVPTYKGNLLFHT

SEQ ID NO: 84147 - protein, 424 aa, Homo sapiens
  Payload ID: 16744
  Gene Symbol: STAMBP
  Gene Name: STAM binding protein
  Uniprot ID: O95630
  ENSP ID: ENSP00000344742
MSDHGDVSLPPEDRVRALSQLGSAVEVNEDIPPRRYFRSGVEIIRMASIYSEEGNIEHAFILYNKYITLFIEKLPKHRDYKSAVIPEKKDTVKKLKEIAFPKAEELKAELLKRYTKEYTEYNEEKKKEAEELARNMAIQQELEKEKQRVAQQKQQQLEQEQFHAFEEMIRNQELEKERLKIVQEFGKVDPGLGGPLVPDLEKPSLDVFPTLTVSSIQPSDCHTTVRPAKPPVVDRSLKPGALSNSESIPTIDGLRHVVVPGRLCPQFLQLASANTARGVETCGILCGKLMRNEFTITHVLIPKQSAGSDYCNTENEEELFLIQDQQGLITLGWIHTHPTQTAFLSSVDLHTHCSYQMMLPESVAIVCSPKFQETGFFKLTDHGLEEISSCRQKGFHPHSKDPPLFCSCSHVTVVDRAVTITDLR

SEQ ID NO: 84148 - protein, 424 aa, Homo sapiens; identical to SEQ ID NO: 84147
  Payload ID: 16744
  Gene Symbol: STAMBP
  Gene Name: STAM binding protein
  Uniprot ID: O95630
  ENSP ID: ENSP00000377633

SEQ ID NO: 84149 - protein, 424 aa, Homo sapiens; identical to SEQ ID NO: 84147
  Payload ID: 16744
  Gene Symbol: STAMBP
  Gene Name: STAM binding protein
  Uniprot ID: O95630
  ENSP ID: ENSP00000377636

SEQ ID NO: 84150 - protein, 424 aa, Homo sapiens; identical to SEQ ID NO: 84147
  Payload ID: 16744
  Gene Symbol: STAMBP
  Gene Name: STAM binding protein
  Uniprot ID: O95630
  ENSP ID: ENSP00000386548

SEQ ID NO: 84151 - protein, 163 aa, Homo sapiens
  Payload ID: 16744
  Gene Symbol: STAMBP
  Gene Name: STAM binding protein
  ENSP ID: ENSP00000390921
MSDHGDVSLPPEDRVRALSQLGSAVEVNEDIPPRRYFRSGVEIIRMASIYSEEGNIEHAFILYNKYITLFIEKLPKHRDYKSAVIPEKKDTVKKLKEIAFPKAEELKAELLKRYTKEYTEYNEEKKKEAEELARNMAIQQELEKEKQRVAQQKQQQLEQEQFH

SEQ ID NO: 84152 - protein, 137 aa, Homo sapiens
  Payload ID: 16744
  Gene Symbol: STAMBP
  Gene Name: STAM binding protein
  ENSP ID: ENSP00000413291
MSDHGDVSLPPEDRVRALSQLGSAVEVNEDIPPRRYFRSGVEIIRMASIYSEEGNIEHAFILYNKYITLFIEKLPKHRDYKSAVIPEKKDTVKKLKEIAFPKAEELKAELLKRYTKEYTEYNEEKKKEAEELARNMA

SEQ ID NO: 84153 - protein, 318 aa, Homo sapiens
  Payload ID: 16744
  Gene Symbol: STAMBP
  Gene Name: STAM binding protein
  ENSP ID: ENSP00000413874
MSDHGDVSLPPEDRVRALSQLGSAVEVNEDIPPRRYFRSGVEIIRMASIYSEEGNIEHAFILYNKYITLFIEKLPKHRDYKSAVIPEKKDTVKKLKEIAFPKAEELKAELLKRYTKEYTEYNEEKKKEAEELARNMAIQQELEKEKQRVAQQKQQQLEQEQFHAFEEMIRNQELEKERLKIVQEFGKVDPGLGGPLVPDLEKPSLDVFPTLTVSSIQPSDCHTTVRPAKPPVVDRSLKPGALSNSESIPTIDGLRHVVVPGRLCPQFLQLASANTARGVETCGILCGKLMRNEFTITHVLIPKQSAGSDYCNTENEEE

SEQ ID NO: 84154 - protein, 209 aa, Homo sapiens
  Payload ID: 16744
  Gene Symbol: STAMBP
  Gene Name: STAM binding protein
  ENSP ID: ENSP00000443502
MSDHGDVSLPPEDRVRALSQLGSAVEVNEDIPPRRYFRSGVEIIRMASIYSEEGNIEHAFILYNKYITLFIEKLPKHRDYKSAVIPEKKDTVKKLKEIAFPKAEELKAELLKRYTKEYTEYNEEKKKEAEELARNMAIQQELEKEKQRVAQQKQQQLEQEQFHAFEEMIRNQELEKERLKIVQEFGKFPQSMDCAMWWCLGGCAHSFSS

SEQ ID NO: 84155 - protein, 270 aa, Homo sapiens
  Payload ID: 16745
  Gene Symbol: STAMBPL1
  Gene Name: STAM binding protein-like 1
  ENSP ID: ENSP00000360990
MRQQQLESEQFLFFEDQLKKQELARGQMRSQQTSGLSEQIDGSALSCFSTHQNNSLLNVFADQPNKSDATNYASHSPPVNRALTPAATLSAVQNLVVEGLRCVVLPEDLCHKFLQLAESNTVRGIETCGILCGKLTHNEFTITHVIVPKQSAGPDYCDMENVEELFNVQDQHDLLTLGWIHTHPTQTAFLSSVDLHTHCSYQLMLPEAIAIVCSPKHKDTGIFRLTNAGMLEVSACKKKGFHPHTKEPRLFSICKHVLVKDIKIIVLDLR

SEQ ID NO: 84156 - protein, 436 aa, Homo sapiens
  Payload ID: 16745
  Gene Symbol: STAMBPL1
  Gene Name: STAM binding protein-like 1
  Uniprot ID: Q96FJ0
  ENSP ID: ENSP00000360992
MDQPFTVNSLKKLAAMPDHTDVSLSPEERVRALSKLGCNITISEDITPRRYFRSGVEMERMASVYLEEGNLENAFVLYNKFITLFVEKLPNHRDYQQCAVPEKQDIMKKLKEIAFPRTDELKNDLLKKYNVEYQEYLQSKNKYKAEILKKLEHQRLIEAERKRIAQMRQQQLESEQFLFFEDQLKKQELARGQMRSQQTSGLSEQIDGSALSCFSTHQNNSLLNVFADQPNKSDATNYASHSPPVNRALTPAATLSAVQNLVVEGLRCVVLPEDLCHKFLQLAESNTVRGIETCGILCGKLTHNEFTITHVIVPKQSAGPDYCDMENVEELFNVQDQHDLLTLGWIHTHPTQTAFLSSVDLHTHCSYQLMLPEAIAIVCSPKHKDTGIFRLTNAGMLEVSACKKKGFHPHTKEPRLFSICKHVLVKDIKIIVLDLR

SEQ ID NO: 84157 - protein, 436 aa, Homo sapiens; identical to SEQ ID NO: 84156
  Payload ID: 16745
  Gene Symbol: STAMBPL1
  Gene Name: STAM binding protein-like 1
  Uniprot ID: Q96FJ0
  ENSP ID: ENSP00000360994

SEQ ID NO: 84158 - protein, 461 aa, Homo sapiens
  Payload ID: 16745
  Gene Symbol: STAMBPL1
  Gene Name: STAM binding protein-like 1
  Uniprot ID: Q96FJ0
  ENSP ID: ENSP00000360995
MDQPFTVNSLKKLAAMPDHTDVSLSPEERVRALSKLGCNITISEDITPRRYFRSGVEMERMASVYLEEGNLENAFVLYNKFITLFVEKLPNHRDYQQCAVPEKQDIMKKLKEIAFPRTDELKNDLLKKYNVEYQEYLQSKNKYKAEILKKLEHQRLIEAERKRIAQMRQQQLESEQFLFFEDQLKKQELARGQMRSQQTSGLSEQIDGSALSCFSTHQNNSLLNVFADQPNKSDATNYASHSPPVNRALTPAATLSAVQNLVVEGLRCVVLPEDLCHKFLQLAESNTVRGIETCGILCGKLTHNEFTITHVIVPKQSAGPDYCDMENVEELFNVQDQHDLLTLGWIHTHPTQTAFLSSVDLHTHCSYQLMLPEAIAIVCSPKHKDTGIFRLTNAGMLEVSACKKKGFHPHTKEPRLFSIQKFLSGIISGTALEMEPLKIGYGPNGFPLLGISRSSSPSEQL

SEQ ID NO: 84159 - protein, 88 aa, Homo sapiens
  Payload ID: 16746
  Gene Symbol: SNN
  Gene Name: stannin
  Uniprot ID: O75324
  ENSP ID: ENSP00000329287
MSIMDHSPTTGVVTVIVILIAIAALGALILGCWCYLRLQRISQSEDEESIVGDGETKEPFLLVQYSAKGPCVERKAKLMTPNGPEVHG

SEQ ID NO: 84160 - protein, 247 aa, Homo sapiens
  Payload ID: 16747
  Gene Symbol: STC1
  Gene Name: stanniocalcin 1
  Uniprot ID: P52823
  ENSP ID: ENSP00000290271
MLQNSAVLLVLVISASATHEAEQNDSVSPRKSRVAAQNSAEVVRCLNSALQVGCGAFACLENSTCDTDGMYDICKSFLYSAAKFDTQGKAFVKESLKCIANGVTSKVFLAIRRCSTFQRMIAEVQEECYSKLNVCSIAKRNPEAITEVVQLPNHFSNRYYNRLVRSLLECDEDTVSTIRDSLMEKIGPNMASLFHILQTDHCAQTHPRADFNRRRTNEPQKLKVLLRNLRGEEDSPSHIKRTSHESA

SEQ ID NO: 84161 - protein, 178 aa, Homo sapiens
  Payload ID: 16747
  Gene Symbol: STC1
  Gene Name: stanniocalcin 1
  Uniprot ID: P52823
  ENSP ID: ENSP00000427932
MYDICKSFLYSAAKFDTQGKAFVKESLKCIANGVTSKVFLAIRRCSTFQRMIAEVQEECYSKLNVCSIAKRNPEAITEVVQLPNHFSNRYYNRLVRSLLECDEDTVSTIRDSLMEKIGPNMASLFHILQTDHCAQTHPRADFNRRRTNEPQKLKVLLRNLRGEEDSPSHIKRTSHESA

SEQ ID NO: 84162 - protein, 302 aa, Homo sapiens
  Payload ID: 16748
  Gene Symbol: STC2
  Gene Name: stanniocalcin 2
  Uniprot ID: O76061
  ENSP ID: ENSP00000265087
MCAERLGQFMTLALVLATFDPARGTDATNPPEGPQDRSSQQKGRLSLQNTAEIQHCLVNAGDVGCGVFECFENNSCEIRGLHGICMTFLHNAGKFDAQGKSFIKDALKCKAHALRHRFGCISRKCPAIREMVSQLQRECYLKHDLCAAAQENTRVIVEMIHFKDLLLHEPYVDLVNLLLTCGEEVKEAITHSVQVQCEQNWGSLCSILSFCTSAIQKPPTAPPERQPQVDRTKLSRAHHGEAGHHLPEPSSRETGRGAKGERGSKSHPNAHARGRVGGLGAQGPSGSSEWEDEQSEYSDIRR

SEQ ID NO: 84163 - protein, 53 aa, Homo sapiens
  Payload ID: 16748
  Gene Symbol: STC2
  Gene Name: stanniocalcin 2
  ENSP ID: ENSP00000427816
MTFLHNAGKFDAQGKSFIKDALKCKAHALRHRFGCISRKCPAIREMVSQLQRE

SEQ ID NO: 84164 - protein, 123 aa, Homo sapiens
  Payload ID: 16748
  Gene Symbol: STC2
  Gene Name: stanniocalcin 2
  ENSP ID: ENSP00000428470
  MOD_RES (1)..(1): Any amino acid
XQNTAEIQHCLVNAGDVGCGVFECFENNSCEIRGLHGICMTFLHNAGKFDAQGKSFIKDALKCKAHALRHRFGCISRKCPAIREMVSQLQRECYLKHDLCAAAQENTRVIVEMIHFKDLLLHE

SEQ ID NO: 84165 - protein, 910 aa, Homo sapiens
  Payload ID: 16749
  Gene Symbol: SND1
  Gene Name: staphylococcal nuclease and tudor domain containing 1
  Uniprot ID: Q7KZF4
  ENSP ID: ENSP00000346762
MASSAQSGGSSGGPAVPTVQRGIIKMVLSGCAIIVRGQPRGGPPPERQINLSNIRAGNLARRAAATQPDAKDTPDEPWAFPAREFLRKKLIGKEVCFTIENKTPQGREYGMIYLGKDTNGENIAESLVAEGLATRREGMRANNPEQNRLSECEEQAKAAKKGMWSEGNGSHTIRDLKYTIENPRHFVDSHHQKPVNAIIEHVRDGSVVRALLLPDYYLVTVMLSGIKCPTFRREADGSETPEPFAAEAKFFTESRLLQRDVQIILESCHNQNILGTILHPNGNITELLLKEGFARCVDWSIAVYTRGAEKLRAAERFAKERRLRIWRDYVAPTANLDQKDKQFVAKVMQVLNADAIVVKLNSGDYKTIHLSSIRPPRLEGENTQDKNKKLRPLYDIPYMFEAREFLRKKLIGKKVNVTVDYIRPASPATETVPAFSERTCATVTIGGINIAEALVSKGLATVIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVEVEVESMDKAGNFIGWLHIDGANLSVLLVEHALSKVHFTAERSSYYKSLLSAEEAAKQKKEKVWAHYEEQPVEEVMPVLEEKERSASYKPVFVTEITDDLHFYVQDVETGTQLEKLMENMRNDIASHPPVEGSYAPRRGEFCIAKFVDGEWYRARVEKVESPAKIHVFYIDYGNREVLPSTRLGTLSPAFSTRVLPAQATEYAFAFIQVPQDDDARTDAVDSVVRDIQNTQCLLNVEHLSAGCPHVTLQFADSKGDVGLGLVKEGLVMVEVRKEKQFQKVITEYLNAQESAKSARLNLWRYGDFRADDADEFGYSR

SEQ ID NO: 84166 - protein, 231 aa, Homo sapiens
  Payload ID: 16749
  Gene Symbol: SND1
  Gene Name: staphylococcal nuclease and tudor domain containing 1
  ENSP ID: ENSP00000419327
EALVSKGLATVIRYRQDDDQRSSHYDELLAAEARAIKNGKGLHSKKEVPIHRVADISGDTQKAKQFLPFLQRAGRSEAVVEYVFSGSRLKLYLPKETCLITFLLAGIECPRGARNLPGLVQEGEPFSEEATLFTKELVLQREVWAHYEEQPVEEVMPVLEEKERSASYKPVFVTEITDDLHFYVQDVETGTQLEKLMENMRNDIASHPPVEGSYAPRRGEFCIAKFVDGEW

SEQ ID NO: 84167 - protein, 358 aa, Homo sapiens
  Payload ID: 16750
  Gene Symbol: STBD1
  Gene Name: starch binding domain 1
  Uniprot ID: O95210
  ENSP ID: ENSP00000237642
MGAVWSALLVGGGLAGALFVWLLRGGPGDTGKDGDAEQEKDAPLGGAAIPGGHQSGSSGLSPGPSGQELVTKPEHLQESNGHLISKTKDLGKLQAASWRLQNPSREVCDNSREHVPSGQFPDTEAPATSETSNSRSYSEVSRNESLESPMGEWGFQKGQEISAKAATCFAEKLPSSNLLKNRAKEEMSLSDLNSQDRVDHEEWEMVPRHSSWGDVGVGGSLKAPVLNLNQGMDNGRSTLVEARGQQVHGKMERVAVMPAGSQQVSVRFQVHYVTSTDVQFIAVTGDHECLGRWNTYIPLHYNKDGFWSHSIFLPADTVVEWKFVLVENGGVTRWEECSNRFLETGHEDKVVHAWWGIH

SEQ ID NO: 84168 - protein, 234 aa, Homo sapiens
  Payload ID: 16751
  Gene Symbol: STARD3NL
  Gene Name: STARD3 N-terminal like
  Uniprot ID: O95772
  ENSP ID: ENSP00000009041
MNHLPEDMENALTGSQSSHASLRNIHSINPTQLMARIESYEGREKKGISDVRRTFCLFVTFDLLFVTLLWIIELNVNGGIENTLEKEVMQYDYYSSYFDIFLLAVFRFKVLILAYAVCRLRHWWAIALTTAVTSAFLLAKVILSKLFSQGAFGYVLPIISFILAWIETWFLDFKVLPQEAEEENRLLIVQDASERAALIPGGLSDGQFYSPPESEAGSEEAEEKQDSEKPLLEL

SEQ ID NO: 84169 - protein, 234 aa, Homo sapiens; identical to SEQ ID NO: 84168
  Payload ID: 16751
  Gene Symbol: STARD3NL
  Gene Name: STARD3 N-terminal like
  Uniprot ID: O95772
  ENSP ID: ENSP00000379334

SEQ ID NO: 84170 - protein, 216 aa, Homo sapiens
  Payload ID: 16751
  Gene Symbol: STARD3NL
  Gene Name: STARD3 N-terminal like
  ENSP ID: ENSP00000394000
MNHLPEDMENALTGSQSSHASLRNIHSINPTQLMARIESYEGREKKGISDVRRTFCLFVTFDLLFVTLLWIIELNVNGGIENTLEKEVMQYDYYSSYFDIFLLAVFRFKVLILAYAVCRLRHWWAIALFSQGAFGYVLPIISFILAWIETWFLDFKVLPQEAEEENRLLIVQDASERAALIPGGLSDGQFYSPPESEAGSEEAEEKQDSEKPLLEL

SEQ ID NO: 84171 - protein, 172 aa, Homo sapiens
  Payload ID: 16751
  Gene Symbol: STARD3NL
  Gene Name: STARD3 N-terminal like
  ENSP ID: ENSP00000395455
MNHLPEDMENALTGSQSSHASLRNIHSINPTQLMARIESYEGREKKGISDVRRTFCLFVTFDLLFVTLLWIIELNVNGGIENTLEKEVMQYDYYSSYFDIFLLAVFRFKVLILAYAVCRLRHWWAIALTTAVTSAFLLAKVILSKLFSQGAFGYVLPIISFILAWIETWFLD

SEQ ID NO: 84172 - protein, 206 aa, Homo sapiens
  Payload ID: 16751
  Gene Symbol: STARD3NL
  Gene Name: STARD3 N-terminal like
  ENSP ID: ENSP00000402028
MNHLPEDMENALTGSQSSHASLRNIHSINPTQLMARIESYEGREKKGISDVRRTFCLFVTFDLLFVTLLWIIELNVNGGIENTLEKEVMQYDYYSSYFDIFLLAVFRFKVLILAYAVCRLRHWWAIALTTAVTSAFLLAKVILSKLFSQGAFGYVLPIISFILAWIETWFLDFKVLPQEAEEENRLLIVQDASERAALIPGGLSDG

SEQ ID NO: 84173 - protein, 184 aa, Homo sapiens
  Payload ID: 16751
  Gene Symbol: STARD3NL
  Gene Name: STARD3 N-terminal like
  ENSP ID: ENSP00000411933
MNHLPEDMENALTGSQSSHASLRNIHSINPTQLMARIESYEGREKKGISDVRRTFCLFVTFDLLFVTLLWIIELNVNGGIENTLEKEVMQYDYYSSYFDIFLLAVFRFKVLILAYAVCRLRHWWAIALTTAVTSAFLLAKVILSKLFSQGAFGYVLPIISFILAWIETWFLDFKVLPQEAEEEN

SEQ ID NO: 84174 - protein, 291 aa, Homo sapiens
  Payload ID: 16752
  Gene Symbol: STARD10
  Gene Name: StAR-related lipid transfer (START) domain containing 10
  Uniprot ID: Q9Y365
  ENSP ID: ENSP00000335247
MEKLAASTEPQGPRPVLGRESVQVPDDQDFRSFRSECEAEVGWNLTYSRAGVSVWVQAVEMDRTLHKIKCRMECCDVPAETLYDVLHDIEYRKKWDSNVIETFDIARLTVNADVGYYSWRCPKPLKNRDVITLRSWLPMGADYIIMNYSVKHPKYPPRKDLVRAVSIQTGYLIQSTGPKSCVITYLAQVDPKGSLPKWVVNKSSQFLAPKAMKKMYKACLKYPEWKQKHLPHFKPWLHPEQSPLPSLALSELSVQHADSLENIDESAVAESREERMGGAGGEGSDDDTSLT

SEQ ID NO: 84175 - protein, 169 aa, Homo sapiens
  Payload ID: 16752
  Gene Symbol: STARD10
  Gene Name: StAR-related lipid transfer (START) domain containing 10
  ENSP ID: ENSP00000438357
CRMECCDVPAETLYDVLHDIEYRKKWDSNVIETFDIARLTVNADVGYYSWRCPKPLKNRDVITLRSWLPMGADYIIMNYSVKHPKYPPRKDLVRAVSIQTGYLIQSTGPKSCVITYLAQVDPKGSLPKWVVNKSSQFLAPKPWLHPEQSPLPSLALSELSVQHADSLEN

SEQ ID NO: 84176 - protein, 291 aa, Homo sapiens; identical to SEQ ID NO: 84174
  Payload ID: 16752
  Gene Symbol: STARD10
  Gene Name: StAR-related lipid transfer (START) domain containing 10
  Uniprot ID: Q9Y365
  ENSP ID: ENSP00000438792

SEQ ID NO: 84177 - protein, 131 aa, Homo sapiens
  Payload ID: 16752
  Gene Symbol: STARD10
  Gene Name: StAR-related lipid transfer (START) domain containing 10
  ENSP ID: ENSP00000438924
MEKLAASTEPQGPRPVLGRESVQVPDDQDFRSFRSECEAEVGWNLTYSRAGVSVWVQAVEMDRTLHKIKPPAGTQDCGWQILKAGLQYPCLAQSQATGQAWGLGPWERISPRGPDGAGAREDSGLRASIAA

SEQ ID NO: 84178 - protein, 245 aa, Homo sapiens
  Payload ID: 16752
  Gene Symbol: STARD10
  Gene Name: StAR-related lipid transfer (START) domain containing 10
  ENSP ID: ENSP00000440016
MEKLAASTEPQGPRPVLGRESVQCRMECCDVPAETLYDVLHDIEYRKKWDSNVIETFDIARLTVNADVGYYSWRCPKPLKNRDVITLRSWLPMGADYIIMNYSVKHPKYPPRKDLVRAVSIQTGYLIQSTGPKSCVITYLAQVDPKGSLPKWVVNKSSQFLAPKAMKKMYKACLKYPEWKQKHLPHFKPWLHPEQSPLPSLALSELSVQHADSLENIDESAVAESREERMGGAGGEGSDDDTSLT

SEQ ID NO: 84179 - protein, 11 aa, Homo sapiens
  Payload ID: 16752
  Gene Symbol: STARD10
  Gene Name: StAR-related lipid transfer (START) domain containing 10
  ENSP ID: ENSP00000440302
MEKLAASTEPQ

SEQ ID NO: 84180 - protein, 58 aa, Homo sapiens
  Payload ID: 16752
  Gene Symbol: STARD10
  Gene Name: StAR-related lipid transfer (START) domain containing 10
  ENSP ID: ENSP00000440924
MEKLAASTEPQGPRPVLGRESVQCRMECCDVPAETLYDVLHDIEYRKKWDSNVIETFD

SEQ ID NO: 84181 - protein, 82 aa, Homo sapiens
  Payload ID: 16752
  Gene Symbol: STARD10
  Gene Name: StAR-related lipid transfer (START) domain containing 10
  ENSP ID: ENSP00000441589
MEKLAASTEPQGPRPVLGRESVQVPDDQDFRSFRSECEAECRMECCDVPAETLYDVLHDIEYRKKWDSNVIETFDIARLTVN

SEQ ID NO: 84182 - protein, 150 aa, Homo sapiens
  Payload ID: 16752
  Gene Symbol: STARD10
  Gene Name: StAR-related lipid transfer (START) domain containing 10
  ENSP ID: ENSP00000442414
CRMECCDVPAETLYDVLHDIEYRKKWDSNVIETFDIARLTVNADVGYYSWRCPKPLKNRDVITLRSWLPMGADYIIMNYSVKHPKYPPRKDLVRAVSIQTGYLIQSTGPKSCVITYLAQVDPKGHEEDVQGVPQVPRVETEAPASLQAVA

SEQ ID NO: 84183 - protein, 89 aa, Homo sapiens
  Payload ID: 16752
  Gene Symbol: STARD10
  Gene Name: StAR-related lipid transfer (START) domain containing 10
  ENSP ID: ENSP00000443523
MEKLAASTEPQGPRPVLGRESVQVPDDQDFRSFRSECEAEVGWNLTYSRAGVSVWVQAVEMDRTLHKIKCRMECCDVPAETLYDVLHDI

SEQ ID NO: 84184 - protein, 262 aa, Homo sapiens
  Payload ID: 16752
  Gene Symbol: STARD10
  Gene Name: StAR-related lipid transfer (START) domain containing 10
  ENSP ID: ENSP00000443548
MEKLAASTEPQGPRPVLGRESVQVPDDQDFRSFRSECEAECRMECCDVPAETLYDVLHDIEYRKKWDSNVIETFDIARLTVNADVGYYSWRCPKPLKNRDVITLRSWLPMGADYIIMNYSVKHPKYPPRKDLVRAVSIQTGYLIQSTGPKSCVITYLAQVDPKGSLPKWVVNKSSQFLAPKAMKKMYKACLKYPEWKQKHLPHFKPWLHPEQSPLPSLALSELSVQHADSLENIDESAVAESREERMGGAGGEGSDDDTSLT

SEQ ID NO: 84185 - protein, 191 aa, Homo sapiens
  Payload ID: 16752
  Gene Symbol: STARD10
  Gene Name: StAR-related lipid transfer (START) domain containing 10
  ENSP ID: ENSP00000443597
MEKLAASTEPQGPRPVLGRESVQVPDDQDFRSFRSECEAEVGWNLTYSRAGVSVWVQAVEMDRTLHKIKCRMECCDVPAETLYDVLHDIEYRKKWDSNVIETFDIARLTVNADVGYYSWRCPKPLKNRDVITLRSWLPMGADYIIMNYSVKHPKYPPRKDLVRAVSIQTGYLIQSTGPKSCVITYLAQVDP

SEQ ID NO: 84186 - protein, 121 aa, Homo sapiens
  Payload ID: 16752
  Gene Symbol: STARD10
  Gene Name: StAR-related lipid transfer (START) domain containing 10
  ENSP ID: ENSP00000444027
  MOD_RES (1)..(1): Any amino acid
XYPPRKDLVRAVSIQTGYLIQSTGPKSCVITYLAQVDPKGSLPKWVVNKSSQFLAPKVSGLGILGRGVEDWKEDYGMRWVESSLEPEGQAWWLMPVIPALWEALAGGLPEVGSSRPAWPTW

SEQ ID NO: 84187 - protein, 252 aa, Homo sapiens
  Payload ID: 16752
  Gene Symbol: STARD10
  Gene Name: StAR-related lipid transfer (START) domain containing 10
  ENSP ID: ENSP00000445657
MEKLAASTEPQGPRPVLGRESVQVPDDQDFRSFRSECEAEVGWNLTYSRAGVSVWVQAVEMDRTLHKIKCRMECCDVPAETLYDVLHDIEYRKKWDSNVIETFDIARLTVNADVGYYSWRCPKPLKNRDVITLRSWLPMGADYIIMNYSVKHPKYPPRKDLVRAVSIQTGYLIQSTGPKSCVITYLAQVDPKGSLPKWVVNKSSQFLAPKAMKKMYKACLKYPEWKQKHLPHFKPWLHPEQSPLPSLALSEL

SEQ ID NO: 84188 - protein, 142 aa, Homo sapiens
  Payload ID: 16752
  Gene Symbol: STARD10
  Gene Name: StAR-related lipid transfer (START) domain containing 10
  ENSP ID: ENSP00000445708
KWDSNVIETFDIARLTVNADVGYYSWRCPKPLKNRDVITLRSWLPMGADYIIMNYSVKHPKYPPRKDLVRAVSIQTGYLIQSTGPKSCVITYLAQVDPKGSLPKWVVNKSSQFLAPKAMKKMYKAGAAAWLDRAPINDPTAS

SEQ ID NO: 84189 - protein, 137 aa, Homo sapiens
  Payload ID: 16752
  Gene Symbol: STARD10
  Gene Name: StAR-related lipid transfer (START) domain containing 10
  ENSP ID: ENSP00000445886
MEKLAASTEPQGPRPVLGRESVQVPDDQDFRSFRSECEAEVGWNLTYSRAGVSVWVQAVEMDRTLHKIKCRMECCDVPAETLYDVLHDIEYRKKWDSNVIETFDIARLTVNADVGYYSWRCPKPLKNRDVITLRSWL

SEQ ID NO: 84190 - protein, 359 aa, Homo sapiens
  Payload ID: 16752
  Gene Symbol: STARD10
  Gene Name: StAR-related lipid transfer (START) domain containing 10
  ENSP ID: ENSP00000481224
MSTRAKKLRRIWRILEEEESVAGAVQTLLLRSQEGGVASAAASTLSEPPRRTQESRTRTRALGLPTLPMEKLAASTEPQGPRPVLGRESVQVPDDQDFRSFRSECEAEVGWNLTYSRAGVSVWVQAVEMDRTLHKIKCRMECCDVPAETLYDVLHDIEYRKKWDSNVIETFDIARLTVNADVGYYSWRCPKPLKNRDVITLRSWLPMGADYIIMNYSVKHPKYPPRKDLVRAVSIQTGYLIQSTGPKSCVITYLAQVDPKGSLPKWVVNKSSQFLAPKAMKKMYKACLKYPEWKQKHLPHFKPWLHPEQSPLPSLALSELSVQHADSLENIDESAVAESREERMGGAGGEGSDDDTSLT

SEQ ID NO: 84191 - protein, 1105 aa, Homo sapiens
  Payload ID: 16753
  Gene Symbol: STARD13
  Gene Name: StAR-related lipid transfer (START) domain containing 13
  Uniprot ID: Q9Y3M8
  ENSP ID: ENSP00000255486
MLEPSSVLHANVNQAPLWCLVLRWCRECKDTVCGGKQKSRVNHTFQRREIEAKEACDWLRAAGFPQYAQLYEDSQFPINIVAVKNDHDFLEKDLVEPLCRRLNTLNKCASMKLDVNFQRKKGDDSDEEDLCISNKWTFQRTSRRWSRVDDLYTLLPRGDRNGSPGGTGMRNTTSSESVLTDLSEPEVCSIHSESSGGSDSRSQPGQCCTDNPVMLDAPLVSSSLPQPPRDVLNHPFHPKNEKPTRARAKSFLKRMETLRGKGAHGRHKGSGRTGGLVISGPMLQQEPESFKAMQCIQIPNGDLQNSPPPACRKGLPCSGKSSGESSPSEHSSSGVSTPCLKERKCHEANKRGGMYLEDLDVLAGTALPDAGDQSRMHEFHSQENLVVHIPKDHKPGTFPKALSIESLSPTDSSNGVNWRTGSISLGREQVPGAREPRLMASCHRASRVSIYDNVPGSHLYASTGDLLDLEKDDLFPHLDDILQHVNGLQEVVDDWSKDVLPELQTHDTLVGEPGLSTFPSPNQITLDFEGNSVSEGRTTPSDVERDVTSLNESEPPGVRDRRDSGVGASLTRPNRRLRWNSFQLSHQPRPAPASPHISSQTASQLSLLQRFSLLRLTAIMEKHSMSNKHGWTWSVPKFMKRMKVPDYKDKAVFGVPLIVHVQRTGQPLPQSIQQALRYLRSNCLDQVGLFRKSGVKSRIHALRQMNENFPENVNYEDQSAYDVADMVKQFFRDLPEPLFTNKLSETFLHIYQYVSKEQRLQAVQAAILLLADENREVLQTLLCFLNDVVNLVEENQMTPMNLAVCLAPSLFHLNLLKKESSPRVIQKKYATGKPDQKDLNENLAAAQGLAHMIMECDRLFEVPHELVAQSRNSYVEAEIHVPTLEELGTQLEESGATFHTYLNHLIQGLQKEAKEKFKGWVTCSSTDNTDLAFKKVGDGNPLKLWKASVEVEAPPSVVLNRVLRERHLWDEDFVQWKVVETLDRQTEIYQYVLNSMAPHPSRDFVVLRTWKTDLPKGMCTLVSLSVEHEEAQLLGGVRAVVMDSQYLIEPCGSGKSRLTHICRIDLKGHSPEWYSKGFGHLCAAEVARIRNSFQPLIAEGPETKI

SEQ ID NO: 84192 - protein, 1113 aa, Homo sapiens
  Payload ID: 16753
  Gene Symbol: STARD13
  Gene Name: StAR-related lipid transfer (START) domain containing 13
  Uniprot ID: Q9Y3M8
  ENSP ID: ENSP00000338785
MFSQVPRTPASGCYYLNSMTPEGQEMYLRFDQTTRRSPYRMSRILARHQLVTKIQQEIEAKEACDWLRAAGFPQYAQLYEDSQFPINIVAVKNDHDFLEKDLVEPLCRRLNTLNKCASMKLDVNFQRKKGDDSDEEDLCISNKWTFQRTSRRWSRVDDLYTLLPRGDRNGSPGGTGMRNTTSSESVLTDLSEPEVCSIHSESSGGSDSRSQPGQCCTDNPVMLDAPLVSSSLPQPPRDVLNHPFHPKNEKPTRARAKSFLKRMETLRGKGAHGRHKGSGRTGGLVISGPMLQQEPESFKAMQCIQIPNGDLQNSPPPACRKGLPCSGKSSGESSPSEHSSSGVSTPCLKERKCHEANKRGGMYLEDLDVLAGTALPDAGDQSRMHEFHSQENLVVHIPKDHKPGTFPKALSIESLSPTDSSNGVNWRTGSISLGREQVPGAREPRLMASCHRASRVSIYDNVPGSHLYASTGDLLDLEKDDLFPHLDDILQHVNGLQEVVDDWSKDVLPELQTHDTLVGEPGLSTFPSPNQITLDFEGNSVSEGRTTPSDVERDVTSLNESEPPGVRDRRDSGVGASLTRPNRRLRWNSFQLSHQPRPAPASPHISSQTASQLSLLQRFSLLRLTAIMEKHSMSNKHGWTWSVPKFMKRMKVPDYKDKAVFGVPLIVHVQRTGQPLPQSIQQALRYLRSNCLDQVGLFRKSGVKSRIHALRQMNENFPENVNYEDQSAYDVADMVKQFFRDLPEPLFTNKLSETFLHIYQYVSKEQRLQAVQAAILLLADENREVLQTLLCFLNDVVNLVEENQMTPMNLAVCLAPSLFHLNLLKKESSPRVIQKKYATGKPDQKDLNENLAAAQGLAHMIMECDRLFEVPHELVAQSRNSYVEAEIHVPTLEELGTQLEESGATFHTYLNHLIQGLQKEAKEKFKGWVTCSSTDNTDLAFKKVGDGNPLKLWKASVEVEAPPSVVLNRVLRERHLWDEDFVQWKVVETLDRQTEIYQYVLNSMAPHPSRDFVVLRTWKTDLPKGMCTLVSLSVEHEEAQLLGGVRAVVMDSQYLIEPCGSGKSRLTHICRIDLKGHSPEWYSKGFGHLCAAEVARIRNSFQPLIAEGPETKI

SEQ ID NO: 84193 - protein, 995 aa, Homo sapiens
  Payload ID: 16753
  Gene Symbol: STARD13
  Gene Name: StAR-related lipid transfer (START) domain containing 13
  Uniprot ID: Q9Y3M8
  ENSP ID: ENSP00000382300
MKLDVNFQRKKGDDSDEEDLCISNKWTFQRTSRRWSRVDDLYTLLPRGDRNGSPGGTGMRNTTSSESVLTDLSEPEVCSIHSESSGGSDSRSQPGQCCTDNPVMLDAPLVSSSLPQPPRDVLNHPFHPKNEKPTRARAKSFLKRMETLRGKGAHGRHKGSGRTGGLVISGPMLQQEPESFKAMQCIQIPNGDLQNSPPPACRKGLPCSGKSSGESSPSEHSSSGVSTPCLKERKCHEANKRGGMYLEDLDVLAGTALPDAGDQSRMHEFHSQENLVVHIPKDHKPGTFPKALSIESLSPTDSSNGVNWRTGSISLGREQVPGAREPRLMASCHRASRVSIYDNVPGSHLYASTGDLLDLEKDDLFPHLDDILQHVNGLQEVVDDWSKDVLPELQTHDTLVGEPGLSTFPSPNQITLDFEGNSVSEGRTTPSDVERDVTSLNESEPPGVRDRRDSGVGASLTRPNRRLRWNSFQLSHQPRPAPASPHISSQTASQLSLLQRFSLLRLTAIMEKHSMSNKHGWTWSVPKFMKRMKVPDYKDKAVFGVPLIVHVQRTGQPLPQSIQQALRYLRSNCLDQVGLFRKSGVKSRIHALRQMNENFPENVNYEDQSAYDVADMVKQFFRDLPEPLFTNKLSETFLHIYQYVSKEQRLQAVQAAILLLADENREVLQTLLCFLNDVVNLVEENQMTPMNLAVCLAPSLFHLNLLKKESSPRVIQKKYATGKPDQKDLNENLAAAQGLAHMIMECDRLFEVPHELVAQSRNSYVEAEIHVPTLEELGTQLEESGATFHTYLNHLIQGLQKEAKEKFKGWVTCSSTDNTDLAFKKVGDGNPLKLWKASVEVEAPPSVVLNRVLRERHLWDEDFVQWKVVETLDRQTEIYQYVLNSMAPHPSRDFVVLRTWKTDLPKGMCTLVSLSVEHEEAQLLGGVRAVVMDSQYLIEPCGSGKSRLTHICRIDLKGHSPEWYSKGFGHLCAAEVARIRNSFQPLIAEGPETKI

SEQ ID NO: 84194 - protein, 606 aa, Homo sapiens
  Payload ID: 16753
  Gene Symbol: STARD13
  Gene Name: StAR-related lipid transfer (START) domain containing 13
  ENSP ID: ENSP00000456233
MTSKRKPCQTQLRRSISEQLRDSTARAWDLLWKNVRERRLAEIEAKEACDWLRAAGFPQYAQLYEDSQFPINIVAVKNDHDFLEKDLVEPLCRRLNTLNKCASMKLDVNFQRKKGDDSDEEDLCISNKWTFQRTSRRWSRVDDLYTLLPRGDRNGSPGGTGMRNTTSSESVLTDLSEPEVCSIHSESSGGSDSRSQPGQCCTDNPVMLDAPLVSSSLPQPPRDVLNHPFHPKNEKPTRARAKSFLKRMETLRGKGAHGRHKGSGRTGGLVISGPMLQQEPESFKAMQCIQIPNGDLQNSPPPACRKGLPCSGKSSGESSPSEHSSSGVSTPCLKERKCHEANKRGGMYLEDLDVLAGTALPDAGDQSRMHEFHSQENLVVHIPKDHKPGTFPKALSIESLSPTDSSNGVNWRTGSISLGREQVPGAREPRLMASCHRASRVSIYDNVPGSHLYASTGDLLDLEKDDLFPHLDDILQHVNGLQEVVDDWSKDVLPELQTHDTLVGEPGLSTFPSPNQITLDFEGNSVSEGRTTPSDVERDVTSLNESEPPGVRDRRDSGVGASLTRPNRRLRWNSFQLSHQPRPAPASPHISSQTASQLSLLQRFSL

SEQ ID NO: 84195 - protein, 63 aa, Homo sapiens
  Payload ID: 16753
  Gene Symbol: STARD13
  Gene Name: StAR-related lipid transfer (START) domain containing 13
  ENSP ID: ENSP00000457840
MTSKRKPCQTQLRRSISEQLRDSTARAWDLLWKNVRERRLAGLSLELGSDHHMGQKKVLEKKV

SEQ ID NO: 84196 - protein, 445 aa, Homo sapiens
  Payload ID: 16754
  Gene Symbol: STARD3
  Gene Name: StAR-related lipid transfer (START) domain containing 3
  Uniprot ID: Q14849
  ENSP ID: ENSP00000337446
MSKLPRELTRDLERSLPAVASLGSSLSHSQSLSSHLLPPPEKRRAISDVRRTFCLFVTFDLLFISLLWIIELNTNTGIRKNLEQEIIQYNFKTSFFDIFVLAFFRFSGLLLGYAVLRLRHWWVIAVTTLVSSAFLIVKVILSELLSKGAFGYLLPIVSFVLAWLETWFLDFKVLPQEAEEERWYLAAQVAVARGPLLFSGALSEGQFYSPPESFAGSDNESDEEVAGKKSFSAQEREYIRQGKEATAVVDQILAQEENWKFEKNNEYGDTVYTIEVPFHGKTFILKTFLPCPAELVYQEVILQPERMVLWNKTVTACQILQRVEDNTLISYDVSAGAAGGVVSPRDFVNVRRIERRRDRYLSSGIATSHSAKPPTHKYVRGENGPGGFIVLKSASNPRVCTFVWILNTDLKGRLPRYLIHQSLAATMFEFAFHLRQRISELGARA

SEQ ID NO: 84197 - protein, 427 aa, Homo sapiens
  Payload ID: 16754
  Gene Symbol: STARD3
  Gene Name: StAR-related lipid transfer (START) domain containing 3
  Uniprot ID: Q14849
  ENSP ID: ENSP00000377794
MSKLPRELTRDLERSLPAVASLGSSLSHSQSLSSHLLPPPEKRRAISDVRRTFCLFVTFDLLFISLLWIIELNTNTGIRKNLEQEIIQYNFKTSFFDIFVLAFFRFSGLLLGYAVLRLRHWWVIALLSKGAFGYLLPIVSFVLAWLETWFLDFKVLPQEAEEERWYLAAQVAVARGPLLFSGALSEGQFYSPPESFAGSDNESDEEVAGKKSFSAQEREYIRQGKEATAVVDQILAQEENWKFEKNNEYGDTVYTIEVPFHGKTFILKTFLPCPAELVYQEVILQPERMVLWNKTVTACQILQRVEDNTLISYDVSAGAAGGVVSPRDFVNVRRIERRRDRYLSSGIATSHSAKPPTHKYVRGENGPGGFIVLKSASNPRVCTFVWILNTDLKGRLPRYLIHQSLAATMFEFAFHLRQRISELGARA

SEQ ID NO: 84198 - protein, 196 aa, Homo sapiens
  Payload ID: 16754
  Gene Symbol: STARD3
  Gene Name: StAR-related lipid transfer (START) domain containing 3
  ENSP ID: ENSP00000411710
MSKLPRELTRDLERSLPAVASLGSSLSHSQSLSSHLLPPPEKRRAISDVRRTFCLFVTFDLLFISLLWIIELNTNTGIRKNLEQEIIQYNFKTSFFDIFVLAFFRFSGLLLGYAVLRLRHWWVIAVTTLVSSAFLIVKVILSELLSKGAFGYLLPIVSFVLAWLETWFLDFKVLPQEAEEERWYLAAQVAVARGPL

SEQ ID NO: 84199 - protein, 445 aa, Homo sapiens
  Payload ID: 16754
  Gene Symbol: STARD3
  Gene Name: StAR-related lipid transfer (START) domain containing 3
  Uniprot ID: Q14849
  ENSP ID: ENSP00000439869
MSKLPRELTRDLERSLPAVASLGSSLSHSQSLSSHLLPPPEKRRAISDVRRTFCLFVTFDLLFISLLWIIELNTNTGIRKNLEQEIIQYNFKTSFFDIFVLAFFRFSGLLLGYAVLRLRHWSRRWCPVHSSLSRSSSLSCSAKGHLATCSPSSLLSSPGWRPGSLTSKSYPRKLKRSDSAPPGYLAAQVAVARGPLLFSGALSEGQFYSPPESFAGSDNESDEEVAGKKSFSAQEREYIRQGKEATAVVDQILAQEENWKFEKNNEYGDTVYTIEVPFHGKTFILKTFLPCPAELVYQEVILQPERMVLWNKTVTACQILQRVEDNTLISYDVSAGAAGGVVSPRDFVNVRRIERRRDRYLSSGIATSHSAKPPTHKYVRGENGPGGFIVLKSASNPRVCTFVWILNTDLKGRLPRYLIHQSLAATMFEFAFHLRQRISELGARA

SEQ ID NO: 84200 - protein, 111 aa, Homo sapiens
  Payload ID: 16754
  Gene Symbol: STARD3
  Gene Name: StAR-related lipid transfer (START) domain containing 3
  ENSP ID: ENSP00000462483
MSKLPRELTRDLERSLPAVASLGSSLSHSQSLSSHLLPPPEKRRAISDVRRTFCLFVTFDLLFISLLWIIELNTNTGIRKNLEQEIIQYNFKTSFFDIFVLAFFRFSGLLL

SEQ ID NO: 84201 - protein, 88 aa, Homo sapiens
  Payload ID: 16754
  Gene Symbol: STARD3
  Gene Name: StAR-related lipid transfer (START) domain containing 3
  ENSP ID: ENSP00000462541
MSKLPRELTRDLERSLPAVASLGSSLSHSQSLSSHLLPPPEKRRAISDVRRTFCLFVTFDLLFISLLWIIELNTNTGIRKNLEQEIIQ

SEQ ID NO: 84202 - protein, 118 aa, Homo sapiens
  Payload ID: 16754
  Gene Symbol: STARD3
  Gene Name: StAR-related lipid transfer (START) domain containing 3
  ENSP ID: ENSP00000462859
MSKLPRELTRDLERSLPAVASLGSSLSHSQSLSSHLLPPPEKRRAISDVRRTFCLFVTFDLLFISLLWIIELNTNTGIRKNLEQEIIQYNFKTSFFDIFVLAFFRFSGLLLGYAVLRL

SEQ ID NO: 84203 - protein, 156 aa, Homo sapiens
  Payload ID: 16754
  Gene Symbol: STARD3
  Gene Name: StAR-related lipid transfer (START) domain containing 3
  ENSP ID: ENSP00000463460
MSKLPRELTRDLERSLPAVASLGSSLSHSQSLSSHLLPPPEKRRAISDVRRTFCLFVTFDLLFISLLWIIELNTNTGIRKNLEQEIIQYNFKTSFFDIFVLAFFRFSGLLLGYAVLRLRHWSRRWCPVHSSLSRSSSLSCSAKGHLATCSPSSLLS

SEQ ID NO: 84204 - protein, 475 aa, Homo sapiens
  Payload ID: 16754
  Gene Symbol: STARD3
  Gene Name: StAR-related lipid transfer (START) domain containing 3
  ENSP ID: ENSP00000463613
MSKLPRELTRDLERSLPAVASLGSSLSHSQSLSSHLLPPPEKRRAISDVRRTFCLFVTFDLLFISLLWIIELNVLAFFRFSGLLLGYAVLRLRHWWVIAVTTLVSSAFLIVKVILSELLSKGAFGYLLPIVSFVLAWLETWFLDFKVLPQEAEEERWYLAAQVAVARGPLLFSGALSEGQFYSPPESFAGSDNESDEEVAGKKSFSAQEREYIRQGKEATAVVDQILAQEENWKFEKNNEYGDTVYTIEVPFHGKTFILKTFLPCPAELVYQEVILQPERMVLWNKTVTACQILQRVEDNTLISYDVSAGAAGGVVSPRDFVNVRRIERRRDRYLSSGIATSHSAKPPTHKYVRGENGPGGFIVLKSASNPRVCTFVWILNTDLKVGCWGAARAACPGTSSTRASRPPCLNLPFTCDSASASWGPGRDCAPSHPAGQGPVATTSRARKGASWARTAHMGPGPRLSPSTEPRSAWS

SEQ ID NO: 84205 - protein, 161 aa, Homo sapiens
  Payload ID: 16754
  Gene Symbol: STARD3
  Gene Name: StAR-related lipid transfer (START) domain containing 3
  ENSP ID: ENSP00000463681
MSKLPRELTRDLERSLPAVASLGSSLSHSQSLSSHLLPPPEKRRAISDVRRTFCLFVTFDLLFISLLWIIELNTNTGIRKNLEQEIIQYNFKTSFFDIFVLAFFRFSGLLLGYAVLRLRHWWVIAVTTLVSSAFLIVKVILSELLSKGAFGYLLPIVSFVL

SEQ ID NO: 84206 - protein, 117 aa, Homo sapiens
  Payload ID: 16754
  Gene Symbol: STARD3
  Gene Name: StAR-related lipid transfer (START) domain containing 3
  ENSP ID: ENSP00000464204
MSKLPRELTRDLERSLPAVASLGSSLSHSQSLSSHLLPPPEKRRAISDVRRTFCLFVTFDLLFISLLWIIELNTNTGIRKNLEQEIIQYNFKTSFFDIFVLAFFRFSGLLLGYAVLR

SEQ ID NO: 84207 - protein, 62 aa, Homo sapiens
  Payload ID: 16754
  Gene Symbol: STARD3
  Gene Name: StAR-related lipid transfer (START) domain containing 3
  ENSP ID: ENSP00000464288
  MOD_RES (1)..(1): Any amino acid
XSDEEVAGKKSFSAQEREYIRQGKEATAVVDQILAQEENWKFEKNNPTPCLHSPPCHLLSLP

SEQ ID NO: 84208 - protein, 262 aa, Homo sapiens
  Payload ID: 16754
  Gene Symbol: STARD3
  Gene Name: StAR-related lipid transfer (START) domain containing 3
  ENSP ID: ENSP00000464472
MSKLPRELTRDLERSLPAVASLGSSLSHSQSLSSHLLPPPEKRRAISDVRRTFCLFVTFDLLFISLLWIIELNTNTGIRKNLEQEIIQYNFKTSFFDIFVLAFFRFSGLLLGYAVLRLRHCCSAKGHLATCSPSSLLSSPGWRPGSLTSKSYPRKLKRSDGILPPRLLLPVDPCCSPVLCPRDSSIHPQNPLQGLTMNQMKKLLGRKVSLLRSGSTSARGRRPRQWWTRSWPRKRTGSLRRIMNMGTPCTPLKFPFTARRLS

SEQ ID NO: 84209 - protein, 205 aa, Homo sapiens
  Payload ID: 16755
  Gene Symbol: STARD4
  Gene Name: StAR-related lipid transfer (START) domain containing 4
  Uniprot ID: Q96DR4
  ENSP ID: ENSP00000296632
MEGLSDVASFATKLKNTLIQYHSIEEDKWRVAKKTKDVTVWRKPSEEFNGYLYKAQGVIDDLVYSIIDHIRPGPCRLDWDSLMTSLDILENFEENCCVMRYTTAGQLWNIISPREFVDFSYTVGYKEGLLSCGISLDWDEKRPEFVRGYNHPCGWFCVPLKDNPNQSLLTGYIQTDLRGMIPQSAVDTAMASTLTNFYGDLRKAL

SEQ ID NO: 84210 - protein, 68 aa, Homo sapiens
  Payload ID: 16755
  Gene Symbol: STARD4
  Gene Name: StAR-related lipid transfer (START) domain containing 4
  ENSP ID: ENSP00000407063
MEGLSDVASFATKLKNTLIQYHSIEEDKWRVAKKTKDVTVWRKPSEEFNGYLVLKGYVIKRATKPKVL

SEQ ID NO: 84211 - protein, 55 aa, Homo sapiens
  Payload ID: 16755
  Gene Symbol: STARD4
  Gene Name: StAR-related lipid transfer (START) domain containing 4
  ENSP ID: ENSP00000425014
MEGLSDVASFATKLKNTLIQYHSIEEDKWRVAKKTKDVTVWRKPSEEFNGYLIAV

SEQ ID NO: 84212 - protein, 55 aa, Homo sapiens; identical to SEQ ID NO: 84211
  Payload ID: 16755
  Gene Symbol: STARD4
  Gene Name: StAR-related lipid transfer (START) domain containing 4
  ENSP ID: ENSP00000425308

SEQ ID NO: 84213 - protein, 55 aa, Homo sapiens; identical to SEQ ID NO: 84211
  Payload ID: 16755
  Gene Symbol: STARD4
  Gene Name: StAR-related lipid transfer (START) domain containing 4
  ENSP ID: ENSP00000426148

SEQ ID NO: 84214 - protein, 205 aa, Homo sapiens; identical to SEQ ID NO: 84209
  Payload ID: 16755
  Gene Symbol: STARD4
  Gene Name: StAR-related lipid transfer (START) domain containing 4
  Uniprot ID: Q96DR4
  ENSP ID: ENSP00000427478

SEQ ID NO: 84215 - protein, 159 aa, Homo sapiens
  Payload ID: 16755
  Gene Symbol: STARD4
  Gene Name: StAR-related lipid transfer (START) domain containing 4
  Uniprot ID: Q96DR4
  ENSP ID: ENSP00000427639
MEGLSDVASFATKLKNTLIQYHSIEEDKWRVAKKTKDVTVWRKPSEEFNGYLYKAQGVIDDLVYSIIDHIRPGPCRLDWDSLMTSLDILENFEENCCVMRYTTAGQLWNIISPREFVDFSYTVGYKEGLLSCGNNLNMLCFFSVWFKYLCFLGWMSLSL

SEQ ID NO: 84216 - protein, 213 aa, Homo sapiens
  Payload ID: 16756
  Gene Symbol: STARD5
  Gene Name: StAR-related lipid transfer (START) domain containing 5
  Uniprot ID: Q9NSY2
  ENSP ID: ENSP00000304032
MDPALAAQMSEAVAEKMLQYRRDTAGWKICREGNGVSVSWRPSVEFPGNLYRGEGIVYGTLEEVWDCVKPAVGGLRVKWDENVTGFEIIQSITDTLCVSRTSTPSAAMKLISPRDFVDLVLVKRYEDGTISSNATHVEHPLCPPKPGFVRGFNHPCGCFCEPLPGEPTKTNLVTFFHTDLSGYLPQNVVDSFFPRSMTRFYANLQKAVKQFHE

SEQ ID NO: 84217 - protein, 63 aa, Homo sapiens
  Payload ID: 16756
  Gene Symbol: STARD5
  Gene Name: StAR-related lipid transfer (START) domain containing 5
  Uniprot ID: Q9NSY2
  ENSP ID: ENSP00000317519
MDPALAAQMSEAVAEKMLQYRRDTAGWKICREGVPRRRHCIWDTRGGVGLCEASCWRPTSEVG

SEQ ID NO: 84218 - protein, 110 aa, Homo sapiens
  Payload ID: 16756
  Gene Symbol: STARD5
  Gene Name: StAR-related lipid transfer (START) domain containing 5
  ENSP ID: ENSP00000453368
MDPALAAQMSEAVAEKMLQYRRDTAGWKICREGVSEELGGKGSRRRLRGARVPRSPQAPPLPVVFCSPIPWTRLRGIPMGIVFFFKKKIGPVMLTMTSGGTEEKALYMGH

SEQ ID NO: 84219 - protein, 220 aa, Homo sapiens
  Payload ID: 16757
  Gene Symbol: STARD6
  Gene Name: StAR-related lipid transfer (START) domain containing 6
  Uniprot ID: P59095
  ENSP ID: ENSP00000310814
MDFKAIAQQTAQEVLGYNRDTSGWKVVKTSKKITVSSKASRKFHGNLYRVEGIIPESPAKLSDFLYQTGDRITWDKSLQVYNMVHRIDSDTFICHTITQSFAVGSISPRDFIDLVYIKRYEGNMNIISSKSVDFPEYPPSSNYIRGYNHPCGFVCSPMEENPAYSKLVMFVQTEMRGKLSPSIIEKTMPSNLVNFILNAKDGIKAHRTPSRRGFHHNSHS

SEQ ID NO: 84220 - protein, 220 aa, Homo sapiens; identical to SEQ ID NO: 84219
  Payload ID: 16757
  Gene Symbol: STARD6
  Gene Name: StAR-related lipid transfer (START) domain containing 6
  Uniprot ID: P59095
  ENSP ID: ENSP00000462349

SEQ ID NO: 84221 - protein, 75 aa, Homo sapiens
  Payload ID: 16757
  Gene Symbol: STARD6
  Gene Name: StAR-related lipid transfer (START) domain containing 6
  ENSP ID: ENSP00000464377
MDFKAIAQQTAQEVLGYNRDTSGWKVVKTSVQWCAPIVPATQEANTGGLLEHRSLRLSCTMIVPVNSQYTTDWAT

SEQ ID NO: 84222 - protein, 75 aa, Homo sapiens; identical to SEQ ID NO: 84221
  Payload ID: 16757
  Gene Symbol: STARD6
  Gene Name: StAR-related lipid transfer (START) domain containing 6
  ENSP ID: ENSP00000464406

SEQ ID NO: 84223 - protein, 370 aa, Homo sapiens
  Payload ID: 16758
  Gene Symbol: STARD7
  Gene Name: StAR-related lipid transfer (START) domain containing 7
  Uniprot ID: Q9NQZ5
  ENSP ID: ENSP00000338030
MLPRRLLAAWLAGTRGGGLLALLANQCRFVTGLRVRRAQQIAQLYGRLYSESSRRVLLGRLWRRLHGRPGHASALMAALAGVFVWDEERIQEEELQRSINEMKRLEEMSNMFQSSGVQHHPPEPKAQTEGNEDSEGKEQRWEMVMDKKHFKLWRRPITGTHLYQYRVFGTYTDVTPRQFFNVQLDTEYRKKWDALVIKLEVIERDVVSGSEVLHWVTHFPYPMYSRDYVYVRRYSVDQENNMMVLVSRAVEHPSVPESPEFVRVRSYESQMVIRPHKSFDENGFDYLLTYSDNPQTVFPRYCVSWMVSSGMPDFLEKLHMATLKAKNMEIKVKDYISAKPLEMSSEAKATSQSSERKNEGSCGPARIEYA

SEQ ID NO: 84224 - protein, 147 aa, Homo sapiens
  Payload ID: 16758
  Gene Symbol: STARD7
  Gene Name: StAR-related lipid transfer (START) domain containing 7
  ENSP ID: ENSP00000409410
MKRLEEMSNMFQSSGVQHHPPEPKAQTEGNEDSEGKEQRWEMVMDKKHFKLWRRPITGTHLYQYRVFGTYTDVTPRQFFNVQLDTEYRKKWDALVIKLEVIERDVVSGSEVLHWVTHFPYPMYSRDYVYVRRYSVDQENNMMVLVSR

SEQ ID NO: 84225 - protein, 1023 aa, Homo sapiens
  Payload ID: 16759
  Gene Symbol: STARD8
  Gene Name: StAR-related lipid transfer (START) domain containing 8
  Uniprot ID: Q92502
  ENSP ID: ENSP00000252336
MTLNNCASMKLEVHFQSKQNEDSEEEEQCTISSHWAFQQESKCWSPMGSSDLLAPPSPGLPATSSCESVLTELSATSLPVITVSLPPEPADLPLPGRAPSSSDRPLLSPTQGQEGPQDKAKKRHRNRSFLKHLESLRRKEKSGSQQAEPKHSPATSEKVSKASSFRSCRGFLSAGFYRAKNWAATSAGGSGANTRKAWEAWPVASFRHPQWTHRGDCLVHVPGDHKPGTFPRSLSIESLCPEDGHRLADWQPGRRWGCEGRRGSCGSTGSHASTYDNLPELYPAEPVMVGAEAEDEDDEESGGSYAHLDDILQHVWGLQQRVELWSRAMYPDLGPGDEEEEEATSSVEIATVEVKCQAEALSQMEVPAHGESPAWAQAEVQPAVLAPAQAPAEAEPVAQEEAEAPAPAPAPAPAQDSEQEAHSGGEPTFASSLSVEEGHSISDTVASSSELDSSGNSMNEAEAAGPLAGLQASMPRERRDSGVGASLTRPCRKLRWHSFQNSHRPSLNSESLEINRQFAGQINLLHKGSLLRLTAFMEKYTVPHKQGWVWSMPKFMRRNKTPDYRGQHVFGVPPLIHVQRTGQPLPQSIQQAMRYLRSQCLDQVGIFRKSGVKSRIQNLRQMNETSPDNVCYEGQSAYDVADLLKQYFRDLPEPIFTSKLTTTFLQIYQLLPKDQWLAAAQAATLLLPDENREVLQTLLYFLSDIASAEENQMTAGNLAVCLAPSIFHLNVSKKDSPSPRIKSKRSLIGRPGPRDLSDNMAATQGLSHMISDCKKLFQVPQDMVLQLCSSYSAAELSPPGPALAELRQAQAAGVSLSLYMEENIQDLLRDAAERFKGWMSVPGPQHTELACRKAPDGHPLRLWKASTEVAAPPAVVLHRVLRERALWDEDLLRAQVLEALMPGVELYHYVTDSMAPHPCRDFVVLRMWRSDLPRGGCLLVSQSLDPEQPVPESGVRALMLTSQYLMEPCGLGRSRLTHICRADLRGRSPDWYNKVFGHLCAMEVAKIRDSFPTLQAAGPETKL

SEQ ID NO: 84226 - protein, 1023 aa, Homo sapiens; identical to SEQ ID NO: 84225
  Payload ID: 16759
  Gene Symbol: STARD8
  Gene Name: StAR-related lipid transfer (START) domain containing 8
  Uniprot ID: Q92502
  ENSP ID: ENSP00000363725

SEQ ID NO: 84227 - protein, 1103 aa, Homo sapiens
  Payload ID: 16759
  Gene Symbol: STARD8
  Gene Name: StAR-related lipid transfer (START) domain containing 8
  Uniprot ID: Q92502
  ENSP ID: ENSP00000363727
MPLLDVFWSCFRKVKCFPLLQVKKNAEAEAKRACEWLQATGFPQYVQLFEEGSFPLDIGSVKKNHGFLDEDSLGALCRRLMTLNNCASMKLEVHFQSKQNEDSEEEEQCTISSHWAFQQESKCWSPMGSSDLLAPPSPGLPATSSCESVLTELSATSLPVITVSLPPEPADLPLPGRAPSSSDRPLLSPTQGQEGPQDKAKKRHRNRSFLKHLESLRRKEKSGSQQAEPKHSPATSEKVSKASSFRSCRGFLSAGFYRAKNWAATSAGGSGANTRKAWEAWPVASFRHPQWTHRGDCLVHVPGDHKPGTFPRSLSIESLCPEDGHRLADWQPGRRWGCEGRRGSCGSTGSHASTYDNLPELYPAEPVMVGAEAEDEDDEESGGSYAHLDDILQHVWGLQQRVELWSRAMYPDLGPGDEEEEEATSSVEIATVEVKCQAEALSQMEVPAHGESPAWAQAEVQPAVLAPAQAPAEAEPVAQEEAEAPAPAPAPAPAQDSEQEAHSGGEPTFASSLSVEEGHSISDTVASSSELDSSGNSMNEAEAAGPLAGLQASMPRERRDSGVGASLTRPCRKLRWHSFQNSHRPSLNSESLEINRQFAGQINLLHKGSLLRLTAFMEKYTVPHKQGWVWSMPKFMRRNKTPDYRGQHVFGVPPLIHVQRTGQPLPQSIQQAMRYLRSQCLDQVGIFRKSGVKSRIQNLRQMNETSPDNVCYEGQSAYDVADLLKQYFRDLPEPIFTSKLTTTFLQIYQLLPKDQWLAAAQAATLLLPDENREVLQTLLYFLSDIASAEENQMTAGNLAVCLAPSIFHLNVSKKDSPSPRIKSKRSLIGRPGPRDLSDNMAATQGLSHMISDCKKLFQVPQDMVLQLCSSYSAAELSPPGPALAELRQAQAAGVSLSLYMEENIQDLLRDAAERFKGWMSVPGPQHTELACRKAPDGHPLRLWKASTEVAAPPAVVLHRVLRERALWDEDLLRAQVLEALMPGVELYHYVTDSMAPHPCRDFVVLRMWRSDLPRGGCLLVSQSLDPEQPVPESGVRALMLTSQYLMEPCGLGRSRLTHICRADLRGRSPDWYNKVFGHLCAMEVAKIRDSFPTLQAAGPETKL

SEQ ID NO: 84228 - protein, 52 aa, Homo sapiens
  Payload ID: 16759
  Gene Symbol: STARD8
  Gene Name: StAR-related lipid transfer (START) domain containing 8
  ENSP ID: ENSP00000428031
MPLLDVFWSCFRKVKCFPLLQVKKNAEAEAKRACEWLQATGFPQYVQLFEGG

SEQ ID NO: 84229 - protein, 4700 aa, Homo sapiens
  Payload ID: 16760
  Gene Symbol: STARD9
  Gene Name: StAR-related lipid transfer (START) domain containing 9
  Uniprot ID: Q9P2P6
  ENSP ID: ENSP00000290607
MANVQVAVRVRPLSKRETKEGGRIIVEVDGKVAKIRNLKVDNRPDGFGDSREKVMAFGFDYCYWSVNPEDPQYASQDVVFQDLGMEVLSGVAKGYNICLFAYGQTGSGKTYTMLGTPASVGLTPRICEGLFVREKDCASLPSSCRIKVSFLEIYNERVRDLLKQSGQKKSYTLRVREHPEMGPYVQGLSQHVVTNYKQVIQLLEEGIANRITAATHVHEASSRSHAIFTIHYTQAILENNLPSEMASKINLVDLAGSERADPSYCKDRIAEGANINKSLVTLGIVISTLAQNSQVFSSCQSLNSSVSNGGDSGILSSPSGTSSGGAPSRRQSYIPYRDSVLTWLLKDSLGGNSKTIMVATVSPAHTSYSETMSTLRYASSAKNIINKPRVNEDANLKLIRELREEIERLKALLLSFELRNFSSLSDENLKELVLQNELKIDQLTKDWTQKWNDWQALMEHYSVDINRRRAGVVIDSSLPHLMALEDDVLSTGVVLYHLKEGTTKIGRIDSDQEQDIVLQGQWIERDHCTITSACGVVVLRPARGARCTVNGREVTASCRLTQGAVITLGKAQKFRFNHPAEAAVLRQRRQVGEAAAGRGSLEWLDLDGDLAASRLGLSPLLWKERRALEEQCDEDHQTPRDGETSHRAQIQQQQSYVEDLRHQILAEEIRAAKELEFDQAWISQQIKENQQCLLREETWLASLQQQQQEDQVAEKELEASVALDAWLQTDPEIQPSPFVQSQKRVVHLQLLRRHTLRAAERNVRRKKVSFQLERIIKKQRLLEAQKRLEKLTTLCWLQDDSTQEPPYQVLSPDATVPRPPCRSKLTSCSSLSPQRLCSKHMPQLHSIFLSWDPSTTLPPRPDPTHQTSEKTSSEEHLPQAASYPARTGCLRKNGLHSSGHGQPCTARAALARKGASAPDACLTMSPNSVGIQEMEMGVKQPHQMVSQGLASLRKSANKLKPRHEPKIFTSTTQTRGAKGLADPSHTQAGWRKEGNLGTHKAAKGASCNSLYPHGPRQTAGHGKAVKTFWTEYKPPSPSRASKRHQRVLATRVRNITKKSSHLPLGSPLKRQQNTRDPDTMVPLTDFSPVMDHSREKDNDLSDTDSNYSLDSLSCVYAKALIEPLKPEERKWDFPEPENSESDDSQLSEDSLAEKRYQSPKNRLGGNRPTNNRGQPRTRTRASVRGFTAASDSDLLAQTHRSFSLDSLIDAEEELGEDQQEEPFPGSADEIPTETFWHLEDSSLPVMDQEAICRLGPINYRTAARLDAVLPMSSSFYLDPQFQPHCELQPHCELQPHCELQPHCEQAESQVEPSYSEQADSLQGMQLSRESPLMSMDSWFSCDSKINPSSPPGIVGSLCPSPDMQEFHSCKGERPGYWPNTEELKPSDAETVLPYSSKLHQGSTELLCSARDEHTASAADTSRLSLWGIQRLIQPGADGTFQGRCIPDMTQQGSSEASHNSSVSNVLAASATTLTHVGSTHERDWSALQQKYLLELSCPVLEAIGAPKPAYPYLEEDSGSLAQASSKGGDTLLPVGPRVSSNLNLNNFPVHLSRIRRLRAEKEQDSLNAKLEGVSDFFSTSEKEASYDETYSADLESLSASRSTNAQVFATENAIPDSMTEACEVKQNNLEECLQSCRKPGLMTSSDEDFFQKNACHSNVTTATKADHWSQGWAPLRKNSAVQPGQLSPDSHYPLEEEKTDCQESSKEAVRRHINVSFALPSGPELYLHSAPWNPLSSSLQPPLLETFYVTKSRDALTETALEIPACREVRVPSPPPREAWGFGHNHQALQGAYLKNNLPVLLQNQNSKIASSQQVTAEIPVDLNTREVIRESGKCPGNITEESHDSVYSSVTQNRHFLPSTSTKVCEFENQVVILNKKHSFPALEGGEVTAQSCCGASSDSTESGKSLLFRESEAREEEELDQNTVLRQTINVSLEKDMPGESAVSLKSRSVDRRVSSPVMVAQGGGPTPKWEGKNETGLLEKGLRPKDSSEEFKLPGTKPAYERFQLVACPQERNPSECKSQEMLNPNREPSGKKQNKRVNNTDEMARLIRSVMQLENGILEIESKQNKQVHASHTPGTDKELVFQDQKEQEKTDHAFRPDSSGNPLPSKDQPSSPRQTDDTVFRDSEAGAMEVNSIGNHPQVQKITPNPFRSREGVRESEPVREHTHPAGSDRPARDICDSLGKHTTCREFTNTSLHPQRMKALARALPLQPRLERSSKNNGQFVKASASLKGQPWGLGSLEELETVKGFQESQVAEHVSSSNQEEPKAQGKVEEMPMQRGGSLQEENKVTQKFPSLSQLCRDTFFRQETVSPLLSRTEFCTAPLHQDLSNTLPLNSPRWPRRCLHVPVALGISSLDCVLDLTMLKIHNSPLVTGVEHQDQSTETRSHSPEGNVRGRSSEAHTAWCGSVRSMAMGSHSQSGVPESIPLGTEDRISASTSPQDHGKDLRITLLGFSTSEDFASEAEVAVQKEIRVSSLNKVSSQPEKRVSFSLEEDSDQASKPRQKAEKETEDVGLTSGVSLAPVSLPRVPSPEPRLLEPSDHASMCLAILEEIRQAKAQRKQLHDFVARGTVLSYCETLLEPECSSRVAGRPQCKQIDQSSSDQTRNEGEAPGFHVASLSAEAGQIDLLPDERKVQATSLSADSFESLPNTETDREPWDPVQAFSHAAPAQDRKRRTGELRQFAGASEPFICHSSSSEIIEKKKDATRTPSSADPLAPDSPRSSAPVEEVRRVVSKKVVAALPSQAPYDDPRVTLHELSQSVPQETAEGIPPGSQDSSPEHQEPRTLDTTYGEVSDNLLVTAQGEKTAHFESQSVTCDVQNSTSASGPKQDHVQCPEASTGFEEGRASPKQDTILPGALTRVALEAPTQQCVQCKESVGSGLTEVCRAGSKHSRPIPLPDQRPSANPGGIGEEAPCRHPREALDGPVFSRNPEGSRTLSPSRGKESRTLPCRQPCSSQPVATHAYSSHSSTLLCFRDGDLGKEPFKAAPHTIHPPCVVPSRAYEMDETGEISRGPDVHLTHGLEPKDVNREFRLTESSTCEPSTVAAVLSRAQGCRSPSAPDVRTGSFSHSATDGSVGLIGVPEKKVAEKQASTELEAASFPAGMYSEPLRQFRDSSVGDQNAQVCQTNPEPPATTQGPHTLDLSEGSAESKLVVEPQHECLENTTRCFLEKPQFSTELRDHNRLDSQAKFVARLKHTCSPQEDSPWQEEEQHRDQASGGGEGFAQGVNPLPDEDGLDGCQILDAGREEVAVAKPPVSKILSQGFKDPATVSLRQNETPQPAAQRSGHLYTGREQPAPNHRGSLPVTTIFSGPKHSRSSPTPQFSVVGSSRSLQELNLSVEPPSPTDEDTQGPNRLWNPHLRGYSSGKSVARTSLQAEDSNQKASSRLDDGTTDHRHLKPATPPYPMPSTLSHMPTPDFTTSWMSGTLEQAQQGKREKLGVQVRPENWCSQMDKGMLHFGSSDISPYALPWRPEEPARISWKQYMSGSAVDVSCSQKPQGLTLSNVARCSSMDNGLEDQNSPFHSHLSTYANICDLSTTHSSTENAQGSNEAWEVFRGSSSIALGDPHIPTSPEGVAPTSGHDRRPQFRGPSGEADCLRSKPPLAKGSAAGPVDEIMLLYPSEAGCPVGQTRTNTFEQGTQTLGSRRHWSSTDISFAQPEASAVSAFDLASWTSMHNLSLHLSQLLHSTSELLGSLSQPDVARREQNTKRDIPDKAPQALMMDGSTQTTVDEGSQTDLTLPTLCLQTSEAEPQGANVILEGLGSDTSTVSQEEGDVPGVPQKREAEETAQKMAQLLYLQEESTPYKPQSPSIPSSHLRFQKAPVGQHLPSVSPSVSDAFLPPSSQPEESYCLVVSSPSPSSPHSPGLFPSTSEYPGDSRVQKKLGPTSALFVDRASSPILTLSASTQEPGLSPGSLTLSAPSTHPVEGHQKLDSSPDPVDAPRTPMDNYSQTTDELGGSQRGRSSLQRSNGRSFLELHSPHSPQQSPKLQFSFLGQHPQQLQPRTTIGVQSRLLPPPLRHRSQRLGNSFVPEKVASPEHCPLSGREPSQWQSRTENGGESSASPGEPQRTLDRPSSWGGLQHLSPCPVSELTDTAGLRGSALGLPQACQPEELLCFSCQMCMAPEHQHHSLRDLPVHNKFSNWCGVQKGSPGGLDMTEEELGASGDLSSEKQEQSPPQPPNDHSQDSEWSKREQIPLQVGAQNLSLSVELTEAKLHHGFGEADALLQVLQSGTGEALAADEPVTSTWKELYARQKKAIETLRRERAERLGNFCRTRSLSPQKQLSLLPNKDLFIWDLDLPSRRREYLQQLRKDVVETTRSPESVSRSAHTPSDIELMLQDYQQAHEEAKVEIARARDQLRERTEQEKLRIHQKIISQLLKEEDKLHTLANSSSLCTSSNGSLSSGMTSGYNSSPALSGQLQFPENMGHTNLPDSRDVWIGDERGGHSAVRKNSAYSHRASLGSCCCSPSSLSSLGTCFSSSYQDLAKHVVDTSMADVMAACSDNLHNLFSCQATAGWNYQGEEQAVQLYYKVFSPTRHGFLGAGVVSQPLSRVWAAVSDPTVWPLYYKPIQTARLHQRVTNSISLVYLVCNTTLCALKQPRDFCCVCVEAKEGHLSVMAAQSVYDTSMPRPSRKMVRGEILPSAWILQPITVEGKEVTRVIYLAQVELGAPGFPPQLLSSFIKRQPLVIARLASFLGR

SEQ ID NO: 84230 - protein, 222 aa, Homo sapiens
  Payload ID: 16760
  Gene Symbol: STARD9
  Gene Name: StAR-related lipid transfer (START) domain containing 9
  ENSP ID: ENSP00000454594
DENLKELVLQNELKIDQLTKDWTQKWNDWQALMEHYSVDINRRRAGVVIDSSLPHLMALEDDVLSTGVVLYHLKNLVSVKLHLRTKKEGTTKIGRIDSDQEQDIGAVITLGKAQKFRFNHPAEAAVLRQRRQVGEAAAGRGSLEWLDLDGDLAASRLGLSPLLWKERRALEEQCDEDHQTPRDGETSHRAQIQQQQSYVEDLRHQILAEEIRAAKELEFDQA

SEQ ID NO: 84231 - protein, 1586 aa, Homo sapiens
  Payload ID: 16760
  Gene Symbol: STARD9
  Gene Name: StAR-related lipid transfer (START) domain containing 9
  ENSP ID: ENSP00000454648
QDRKRRTGELRQFAGASEPFICHSSSSEIIEKKKDATRTPSSADPLAPDSPRSSAPVEEVRRVVSKKVVAALPSQAPYDDPRVTLHELSQSVPQETAEGIPPGSQDSSPEHQEPRTLDTTYGEVSDNLLVTAQGEKTAHFESQSVTCDVQNSTSASGPKQDHVQCPEASTGFEEGRASPKQDTILPGALTRVALEAPTQQCVQCKESVGSGLTEVCRAGSKHSRPIPLPDQRPSANPGGIGEEAPCRHPREALDGPVFSRNPEGSRTLSPSRGKESRTLPCRQPCSSQPVATHAYSSHSSTLLCFRDGDLGKEPFKAAPHTIHPPCVVPSRAYEMDETGEISRGPDVHLTHGLEPKDVNREFRLTESSTCEPSTVAAVLSRAQGCRSPSAPDVRTGSFSHSATDGSVGLIGVPEKKVAEKQASTELEAASFPAGMYSEPLRQFRDSSVGDQNAQVCQTNPEPPATTQGPHTLDLSEGSAESKLVVEPQHECLENTTRCFLEKPQFSTELRDHNRLDSQAKFVARLKHTCSPQEDSPWQEEEQHRDQASGGGEGFAQGVNPLPDEDGLDGCQILDAGREEVAVAKPPVSKILSQGFKDPATVSLRQNETPQPAAQRSGHLYTGREQPAPNHRGSLPVTTIFSGPKHSRSSPTPQFSVVGSSRSLQELNLSVEPPSPTDEDTQGPNRLWNPHLRGYSSGKSVARTSLQAEDSNQKASSRLDDGTTDHRHLKPATPPYPMPSTLSHMPTPDFTTSWMSGTLEQAQQGKREKLGVQVRPENWCSQMDKGMLHFGSSDISPYALPWRPEEPARISWKQYMSGSAVDVSCSQKPQGLTLSNVARCSSMDNGLEDQNSPFHSHLSTYANICDLSTTHSSTENAQGSNEAWEVFRGSSSIALGDPHIPTSPEGVAPTSGHDRRPQFRGPSGEADCLRSKPPLAKGSAAGPVDEIMLLYPSEAGCPVGQTRTNTFEQGTQTLGSRRHWSSTDISFAQPEASAVSAFDLASWTSMHNLSLHLSQLLHSTSELLGSLSQPDVARREQNTKRDIPDKAPQALMMDGSTQTTVDEGSQTDLTLPTLCLQTSEAEPQGANVILEGLGSDTSTVSQEEGDVPGVPQKREAEETAQKMAQLLYLQEESTPYKPQSPSIPSSHLRFQKAPVGQHLPSVSPSVSDAFLPPSSQPEESYCLVVSSPSPSSPHSPGLFPSTSEYPGDSRVQKKLGPTSALFVDRASSPILTLSASTQEPGLSPGSLTLSAPSTHPVEGHQKLDSSPDPVDAPRTPMDNYSQTTDELGGSQRGRSSLQRSNGRSFLELHSPHSPQQSPKLQFSFLGQHPQQLQPRTTIGVQSRLLPPPLRHRSQRLGNSFVPEKVASPEHCPLSGREPSQWQSRTENGGESSASPGEPQRTLDRPSSWGGLQHLSPCPVSELTDTAGLRGSALGLPQACQPEELLCFSCQMCMAPEHQHHSLRDLPVHNKFSNWCGVQKGSPGGLDMTEEELGASGDLSSEKQEQSPPQPPNDHSQDSEWSKREQIPLQVGAQNLSLSVELTEAKLHHGFGEADALLQVLQSGTGEALAADEPVTSTWKELYARGQR

SEQ ID NO: 84232 - protein, 62 aa, Homo sapiens
  Payload ID: 16761
  Gene Symbol: STATH
  Gene Name: statherin
  Uniprot ID: P02808
  ENSP ID: ENSP00000246895
MKFLVFAFILALMVSMIGADSSEEKFLRRIGRFGYGYGPYQPVPEQPLYPQPYQPQYQQYTF

SEQ ID NO: 84233 - protein, 52 aa, Homo sapiens
  Payload ID: 16761
  Gene Symbol: STATH
  Gene Name: statherin
  Uniprot ID: P02808
  ENSP ID: ENSP00000370448
MKFLVFAFILALMVSMIGADSSEEYGYGPYQPVPEQPLYPQPYQPQYQQYTF

SEQ ID NO: 84234 - protein, 62 aa, Homo sapiens; identical to SEQ ID NO: 84232
  Payload ID: 16761
  Gene Symbol: STATH
  Gene Name: statherin
  Uniprot ID: P02808
  ENSP ID: ENSP00000484341

SEQ ID NO: 84235 - protein, 52 aa, Homo sapiens; identical to SEQ ID NO: 84233
  Payload ID: 16761
  Gene Symbol: STATH
  Gene Name: statherin
  ENSP ID: ENSP00000489107

SEQ ID NO: 84236 - protein, 62 aa, Homo sapiens; identical to SEQ ID NO: 84232
  Payload ID: 16761
  Gene Symbol: STATH
  Gene Name: statherin
  ENSP ID: ENSP00000489243

SEQ ID NO: 84237 - protein, 62 aa, Homo sapiens; identical to SEQ ID NO: 84232
  Payload ID: 16761
  Gene Symbol: STATH
  Gene Name: statherin
  ENSP ID: ENSP00000489569

SEQ ID NO: 84238 - protein, 149 aa, Homo sapiens
  Payload ID: 16762
  Gene Symbol: STMN1
  Gene Name: stathmin 1
  Uniprot ID: P16949
  ENSP ID: ENSP00000350531
MASSDIQVKELEKRASGQAFELILSPRSKESVPEFPLSPPKKKDLSLEEIQKKLEAAEERRKSHEAEVLKQLAEKREHEKEVLQKAIEENNNFSKMAEEKLTHKMEANKENREAQMAAKLERLREKDKHIEEVRKNKESKDPADETEAD

SEQ ID NO: 84239 - protein, 149 aa, Homo sapiens; identical to SEQ ID NO: 84238
  Payload ID: 16762
  Gene Symbol: STMN1
  Gene Name: stathmin 1
  Uniprot ID: P16949
  ENSP ID: ENSP00000363409

SEQ ID NO: 84240 - protein, 149 aa, Homo sapiens; identical to SEQ ID NO: 84238
  Payload ID: 16762
  Gene Symbol: STMN1
  Gene Name: stathmin 1
  Uniprot ID: P16949
  ENSP ID: ENSP00000382633

SEQ ID NO: 84241 - protein, 149 aa, Homo sapiens; identical to SEQ ID NO: 84238
  Payload ID: 16762
  Gene Symbol: STMN1
  Gene Name: stathmin 1
  Uniprot ID: P16949
  ENSP ID: ENSP00000387858

SEQ ID NO: 84242 - protein, 85 aa, Homo sapiens
  Payload ID: 16762
  Gene Symbol: STMN1
  Gene Name: stathmin 1
  ENSP ID: ENSP00000407567
MASSDIQVKELEKRASGQAFELILSPRSKESVPEFPLSPPKKKDLSLEEIQKKLEAAEERRKSHEAEVLKQLAEKREHEKEVLQK

SEQ ID NO: 84243 - protein, 174 aa, Homo sapiens
  Payload ID: 16762
  Gene Symbol: STMN1
  Gene Name: stathmin 1
  Uniprot ID: P16949
  ENSP ID: ENSP00000410452
MASSDIQVKELEKRASGQAFELILSPRSKESVPEFPLSPPKKKDLSLEEIQKKLEAAEERRKSHEAEVLKQLAEKREHEKEVLQKAIEENNNFSKMAEEKLTHKMEANKENREAQMAAKLERLREKMYFWTHGPGAHPAQISAEQSCLHSVPALCPALGLQSALITWSDLSHHH

SEQ ID NO: 84244 - protein, 179 aa, Homo sapiens
  Payload ID: 16763
  Gene Symbol: STMN2
  Gene Name: stathmin 2
  Uniprot ID: Q93045
  ENSP ID: ENSP00000220876
MAKTAMAYKEKMKELSMLSLICSCFYPEPRNINIYTYDDMEVKQINKRASGQAFELILKPPSPISEAPRTLASPKKKDLSLEEIQKKLEAAEERRKSQEAQVLKQLAEKREHEREVLQKALEENNNFSKMAEEKLILKMEQIKENREANLAAIIERLQEKERHAAEVRRNKELQVELSG

SEQ ID NO: 84245 - protein, 187 aa, Homo sapiens
  Payload ID: 16763
  Gene Symbol: STMN2
  Gene Name: stathmin 2
  Uniprot ID: Q93045
  ENSP ID: ENSP00000429243
MAKTAMAYKEKMKELSMLSLICSCFYPEPRNINIYTYDDMEVKQINKRASGQAFELILKPPSPISEAPRTLASPKKKDLSLEEIQKKLEAAEERRKSQEAQVLKQLAEKREHEREVLQKALEENNNFSKMAEEKLILKMEQIKENREANLAAIIERLQEKLVKFISSELKESIESQFLELQREGEKQ

SEQ ID NO: 84246 - protein, 168 aa, Homo sapiens
  Payload ID: 16763
  Gene Symbol: STMN2
  Gene Name: stathmin 2
  ENSP ID: ENSP00000430102
MKELSMLSLICSCFYPEPRNINIYTYDDMEVKQINKRASGQAFELILKPPSPISEAPRTLASPKKKDLSLEEIQKKLEAAEERRKSQEAQVLKQLAEKREHEREVLQKALEENNNFSKMAEEKLILKMEQIKENREANLAAIIERLQEKERHAAEVRRNKELQVELSG

SEQ ID NO: 84247 - protein, 200 aa, Homo sapiens
  Payload ID: 16764
  Gene Symbol: STMND1
  Gene Name: stathmin domain containing 1
  ENSP ID: ENSP00000454363
MHVFFVFLSLLETLRRLPVADVSVPHTGENCSPRMEAALTKNTVDIAEGLEQVQMGSLPGTISENSPSPSERNRRVNSDLVTNGLINKPQSLESRERQKSSDILEELIVQGIIQSHSKVFRNGESYDVTLTTTEKPLRKPPSRLKKLKIKKQVKDFTMKDIEEKMEAAEERRKTKEEEIRKRLRSDRLLPSANHSDSAEL

SEQ ID NO: 84248 - protein, 276 aa, Homo sapiens
  Payload ID: 16764
  Gene Symbol: STMND1
  Gene Name: stathmin domain containing 1
  Uniprot ID: H3BQB6
  ENSP ID: ENSP00000455698
MGCGPSQPAEDRRRVRAPKKGWKEEFKADVSVPHTGENCSPRMEAALTKNTVDIAEGLEQVQMGSLPGTISENSPSPSERNRRVNSDLVTNGLINKPQSLESRERQKSSDILEELIVQGIIQSHSKVFRNGESYDVTLTTTEKPLRKPPSRLKKLKIKKQVKDFTMKDIEEKMEAAEERRKTKEEEIRKRLRSDRLLPSANHSDSAELDGAEVAFAKGLQRVRSAGFEPSDLQGGKPLKRKKSKCDATLIDRNESDESFGVVESDMSYNQADDIVY

SEQ ID NO: 84249 - protein, 180 aa, Homo sapiens
  Payload ID: 16765
  Gene Symbol: STMN3
  Gene Name: stathmin-like 3
  Uniprot ID: Q9NZ72
  ENSP ID: ENSP00000359070
MASTISAYKEKMKELSVLSLICSCFYTQPHPNTVYQYGDMEVKQLDKRASGQSFEVILKSPSDLSPESPMLSSPPKKKDTSLEELQKRLEAAEERRKTQEAQVLKQLAERREHEREVLHKALEENNNFSRQAEEKLNYKMELSKEIREAHLAALRERLREKELHAAEVRRNKEQREEMSG

SEQ ID NO: 84250 - protein, 169 aa, Homo sapiens
  Payload ID: 16765
  Gene Symbol: STMN3
  Gene Name: stathmin-like 3
  Uniprot ID: Q9NZ72
  ENSP ID: ENSP00000439840
MKELSVLSLICSCFYTQPHPNTVYQYGDMEVKQLDKRASGQSFEVILKSPSDLSPESPMLSSPPKKKDTSLEELQKRLEAAEERRKTQEAQVLKQLAERREHEREVLHKALEENNNFSRQAEEKLNYKMELSKEIREAHLAALRERLREKELHAAEVRRNKEQREEMSG

SEQ ID NO: 84251 - protein, 86 aa, Homo sapiens
  Payload ID: 16765
  Gene Symbol: STMN3
  Gene Name: stathmin-like 3
  ENSP ID: ENSP00000487639
MKELSVLSLICSCFYTQPHPNTVYQYGDMEVKQLDKRASGQSFEVILKSPSDLSPESPMLSSPPKKKDTSLEELQKRLEAAEERRK

SEQ ID NO: 84252 - protein, 239 aa, Homo sapiens
  Payload ID: 16765
  Gene Symbol: STMN3
  Gene Name: stathmin-like 3
  ENSP ID: ENSP00000487795
  MOD_RES (1)..(1): Any amino acid
XHRCGLGDHPLRRPRHLLWPEKPLPFAPRGLDGGGATAIPKPSGDQRAPPLPPLHLPRGGPTAFEAYKEKMKELSVLSLICSCFYTQPHPNTVYQYGDMEVKQLDKRASGQSFEVILKSPSDLSPESPMLSSPPKKKDTSLEELQKRLEAAEERRKTQEAQVLKQLAERREHEREVLHKALEENNNFSRQAEEKLNYKMELSKEIREAHLAALRERLREKELHAAEVRRNKEQREEMSG

SEQ ID NO: 84253 - protein, 86 aa, Homo sapiens; identical to SEQ ID NO: 84251
  Payload ID: 16765
  Gene Symbol: STMN3
  Gene Name: stathmin-like 3
  ENSP ID: ENSP00000488604

SEQ ID NO: 84254 - protein, 189 aa, Homo sapiens
  Payload ID: 16766
  Gene Symbol: STMN4
  Gene Name: stathmin-like 4
  Uniprot ID: Q9H169
  ENSP ID: ENSP00000265770
MTLAAYKEKMKELPLVSLFCSCFLADPLNKSSYKYEADTVDLNWCVISDMEVIELNKCTSGQSFEVILKPPSFDGVPEFNASLPRRRDPSLEEIQKKLEAAEERRKYQEAELLKHLAEKREHEREVIQKAIEENNNFIKMAKEKLAQKMESNKENREAHLAAMLERLQEKDKHAEEVRKNKELKEEASR

SEQ ID NO: 84255 - protein, 216 aa, Homo sapiens
  Payload ID: 16766
  Gene Symbol: STMN4
  Gene Name: stathmin-like 4
  Uniprot ID: Q9H169
  ENSP ID: ENSP00000342538
MTLAAYKEKMKELPLVSLFCSCFLADPLNKSSYKYEGWCGRQCRRKDESQRKDSADWRERRAQADTVDLNWCVISDMEVIELNKCTSGQSFEVILKPPSFDGVPEFNASLPRRRDPSLEEIQKKLEAAEERRKYQEAELLKHLAEKREHEREVIQKAIEENNNFIKMAKEKLAQKMESNKENREAHLAAMLERLQEKDKHAEEVRKNKELKEEASR

SEQ ID NO: 84256 - protein, 203 aa, Homo sapiens
  Payload ID: 16766
  Gene Symbol: STMN4
  Gene Name: stathmin-like 4
  Uniprot ID: Q9H169
  ENSP ID: ENSP00000428428
MTLAAYKEKMKELPLVSLFCSCFLADPLNKSSYKYEGWCGRQCRRKDESQRKDSADWRERRAQADTVDLNWCVISDMEVIELNKCTSGQSFEVILKPPSFDGVPEFNASLPRRRDPSLEEIQKKLEAAEERRKYQEAELLKHLAEKREHEREVIQKAIEENNNFIKMAKEKLAQKMESNKENREAHLAAMLERLQEKEPPAAR

SEQ ID NO: 84257 - protein, 167 aa, Homo sapiens
  Payload ID: 16766
  Gene Symbol: STMN4
  Gene Name: stathmin-like 4
  Uniprot ID: Q9H169
  ENSP ID: ENSP00000428474
MKELPLVSLFCSCFLADPLNKSSYKYEADTVDLNWCVISDMEVIELNKCTSGQSFEVILKPPSFDGVPEFNASLPRRRDPSLEEIQKKLEAAEERRKYQEAELLKHLAEKREHEREVIQKAIEENNNFIKMAKEKLAQKMESNKENREAHLAAMLERLQEKEPPAAR

SEQ ID NO: 84258 - protein, 258 aa, Homo sapiens
  Payload ID: 16766
  Gene Symbol: STMN4
  Gene Name: stathmin-like 4
  ENSP ID: ENSP00000430389
MTLAAYKEKMKELPLVSLFCSCFLADPLNKSSYKYEGWCGRQCRRKDESQRKDSADWRERRAQADTVDLNWCVISDMEVIELNKCTSGQSFEVILKPPSFDGVPEFNASLPRRRDPSLEEIQKKLEAAEERRKYQEAELLKHLAEKREHEREVIQKAIEENNNFIKMAKEKLAQKMESNKENREAHLAAMLERLQEKVRGPWLERSFLGHAVFLLQQVCGDLLIISGRKQPQAKIRIFFLGRIFREFRRMIREVRGKK

SEQ ID NO: 84259 - protein, 231 aa, Homo sapiens
  Payload ID: 16766
  Gene Symbol: STMN4
  Gene Name: stathmin-like 4
  ENSP ID: ENSP00000430699
MTLAAYKEKMKELPLVSLFCSCFLADPLNKSSYKYEADTVDLNWCVISDMEVIELNKCTSGQSFEVILKPPSFDGVPEFNASLPRRRDPSLEEIQKKLEAAEERRKYQEAELLKHLAEKREHEREVIQKAIEENNNFIKMAKEKLAQKMESNKENREAHLAAMLERLQEKVRGPWLERSFLGHAVFLLQQVCGDLLIISGRKQPQAKIRIFFLGRIFREFRRMIREVRGKK

SEQ ID NO: 84260 - protein, 496 aa, Homo sapiens
  Payload ID: 16767
  Gene Symbol: STAU1
  Gene Name: staufen double-stranded RNA binding protein 1
  Uniprot ID: O95793
  ENSP ID: ENSP00000323443
MKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFEVARESGPPHMKNFVTKVSVGEFVGEGEGKSKKISKKNAAIAVLEELKKLPPLPAVERVKPRIKKKTKPIVKPQTSPEYGQGINPISRLAQIQQAKKEKEPEYTLLTERGLPRRREFVMQVKVGNHTAEGTGTNKKVAKRNAAENMLEILGFKVPQAQPTKPALKSEEKTPIKKPGDGRKVTFFEPGSGDENGTSNKEDEFRMPYLSHQQLPAGILPMVPEVAQAVGVSQGHHTKDFTRAAPNPAKATVTAMIARELLYGGTSPTAETILKNNISSGHVPHGPLTRPSEQLDYLSRVQGFQVEYKDFPKNNKNEFVSLINCSSQPPLISHGIGKDVESCHDMAALNILKLLSELDQQSTEMPRTGNGPMSVCGRC

SEQ ID NO: 84261 - protein, 496 aa, Homo sapiens; identical to SEQ ID NO: 84260
  Payload ID: 16767
  Gene Symbol: STAU1
  Gene Name: staufen double-stranded RNA binding protein 1
  Uniprot ID: O95793
  ENSP ID: ENSP00000345425

SEQ ID NO: 84262 - protein, 496 aa, Homo sapiens; identical to SEQ ID NO: 84260
  Payload ID: 16767
  Gene Symbol: STAU1
  Gene Name: staufen double-stranded RNA binding protein 1
  Uniprot ID: O95793
  ENSP ID: ENSP00000353604

SEQ ID NO: 84263 - protein, 494 aa, Homo sapiens
  Payload ID: 16767
  Gene Symbol: STAU1
  Gene Name: staufen double-stranded RNA binding protein 1
  ENSP ID: ENSP00000360857
MKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFEVARESGPPHMKNFVTKVSVGEFVGEGEGKSKKISKKNAAIAVLEELKKLPPLPAVERVKPRIKKKTKPIVKTSPEYGQGINPISRLAQIQQAKKEKEPEYTLLTERGLPRRREFVMQVKVGNHTAEGTGTNKKVAKRNAAENMLEILGFKVPQAQPTKPALKSEEKTPIKKPGDGRKVTFFEPGSGDENGTSNKEDEFRMPYLSHQQLPAGILPMVPEVAQAVGVSQGHHTKDFTRAAPNPAKATVTAMIARELLYGGTSPTAETILKNNISSGHVPHGPLTRPSEQLDYLSRVQGFQVEYKDFPKNNKNEFVSLINCSSQPPLISHGIGKDVESCHDMAALNILKLLSELDQQSTEMPRTGNGPMSVCGRC

SEQ ID NO: 84264 - protein, 502 aa, Homo sapiens
  Payload ID: 16767
  Gene Symbol: STAU1
  Gene Name: staufen double-stranded RNA binding protein 1
  Uniprot ID: O95793
  ENSP ID: ENSP00000360867
MKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFESFPLKQVARESGPPHMKNFVTKVSVGEFVGEGEGKSKKISKKNAAIAVLEELKKLPPLPAVERVKPRIKKKTKPIVKPQTSPEYGQGINPISRLAQIQQAKKEKEPEYTLLTERGLPRRREFVMQVKVGNHTAEGTGTNKKVAKRNAAENMLEILGFKVPQAQPTKPALKSEEKTPIKKPGDGRKVTFFEPGSGDENGTSNKEDEFRMPYLSHQQLPAGILPMVPEVAQAVGVSQGHHTKDFTRAAPNPAKATVTAMIARELLYGGTSPTAETILKNNISSGHVPHGPLTRPSEQLDYLSRVQGFQVEYKDFPKNNKNEFVSLINCSSQPPLISHGIGKDVESCHDMAALNILKLLSELDQQSTEMPRTGNGPMSVCGRC

SEQ ID NO: 84265 - protein, 502 aa, Homo sapiens; identical to SEQ ID NO: 84264
  Payload ID: 16767
  Gene Symbol: STAU1
  Gene Name: staufen double-stranded RNA binding protein 1
  Uniprot ID: O95793
  ENSP ID: ENSP00000360893

SEQ ID NO: 84266 - protein, 577 aa, Homo sapiens
  Payload ID: 16767
  Gene Symbol: STAU1
  Gene Name: staufen double-stranded RNA binding protein 1
  Uniprot ID: O95793
  ENSP ID: ENSP00000360922
MSQVQVQVQNPSAALSGSQILNKNQSLLSQPLMSIPSTTSSLPSENAGRPIQNSALPSASITSTSAAAESITPTVELNALCMKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFEVARESGPPHMKNFVTKVSVGEFVGEGEGKSKKISKKNAAIAVLEELKKLPPLPAVERVKPRIKKKTKPIVKPQTSPEYGQGINPISRLAQIQQAKKEKEPEYTLLTERGLPRRREFVMQVKVGNHTAEGTGTNKKVAKRNAAENMLEILGFKVPQAQPTKPALKSEEKTPIKKPGDGRKVTFFEPGSGDENGTSNKEDEFRMPYLSHQQLPAGILPMVPEVAQAVGVSQGHHTKDFTRAAPNPAKATVTAMIARELLYGGTSPTAETILKNNISSGHVPHGPLTRPSEQLDYLSRVQGFQVEYKDFPKNNKNEFVSLINCSSQPPLISHGIGKDVESCHDMAALNILKLLSELDQQSTEMPRTGNGPMSVCGRC

SEQ ID NO: 84267 - protein, 129 aa, Homo sapiens
  Payload ID: 16767
  Gene Symbol: STAU1
  Gene Name: staufen double-stranded RNA binding protein 1
  ENSP ID: ENSP00000398785
MCEVSRGWKPCTEGILKVRPTRKISYEESITPTVELNALCMKLGKKPMYKPVDPYSRMQSTYNYNMRGGAYPPRYFYPFPVPPLLYQVELSVGGQQFNGKGKTRQAAKHDAAAKALRILQNEPLPERLE

SEQ ID NO: 84268 - protein, 199 aa, Homo sapiens
  Payload ID: 16767
  Gene Symbol: STAU1
  Gene Name: staufen double-stranded RNA binding protein 1
  ENSP ID: ENSP00000416779
MKLGKKPMYKPVDPYSRMQSTYNYNMRGGAYPPRYFYPFPVPPLLYQVELSVGGQQFNGKGKTRQAAKHDAAAKALRILQNEPLPERLEVNGRESEEENLNKSEISQVFEIALKRNLPVNFESFPLKQVARESGPPHMKNFVTKVSVGEFVGEGEGKSKKISKKNAAIAVLEELKKLPPLPAVERVKPRIKKKTKPIVK

SEQ ID NO: 84269 - protein, 493 aa, Homo sapiens [sequence omitted]

SEQ ID NO: 84270 - protein, 479 aa, Homo sapiens
  Payload ID: 16768
  Gene Symbol: STAU2
  Gene Name: staufen double-stranded RNA binding protein 2
  ENSP ID: ENSP00000348026
MLQINQMFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQRYHCPVPKIFYVQLTVGNNEFFGEGKTRQAARHNAAMKALQALQNEPIPERSPQNGESGKDVDDDKDANKSEISLVFEIALKRNMPVSFEVIKESGPPHMKSFVTRVSVGEFSAEGEGNSKKLSKKRAATTVLQELKKLPPLPVVEKPKLFFKKRPKTIVKAGPEYGQGMNPISRLAQIQQAKKEKEPDYVLLSERGMPRRREFVMQVKVGNEVATGTGPNKKIAKKNAAEAMLLQLGYKASTNLQDQLEKTGENKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQV

SEQ ID NO: 84271 - protein, 479 aa, Homo sapiens; identical to SEQ ID NO: 84270
  Payload ID: 16768
  Gene Symbol: STAU2
  Gene Name: staufen double-stranded RNA binding protein 2
  ENSP ID: ENSP00000427977

SEQ ID NO: 84272 - protein, 135 aa, Homo sapiens
  Payload ID: 16768
  Gene Symbol: STAU2
  Gene Name: staufen double-stranded RNA binding protein 2
  ENSP ID: ENSP00000428284
MLQINQVKVGNEVATGTGPNKKIAKKNAAEAMLLQLGYKASTNLQDQLEKTGENKGWSGPKPGFPEPTNNTPKGILHLSPDVYQEMEASRHKVISGTTLGYLSPKDMNQPSSSFFSISPTSNSSATIARELLMNG

SEQ ID NO: 84273 - protein, 538 aa, Homo sapiens
  Payload ID: 16768
  Gene Symbol: STAU2
  Gene Name: staufen double-stranded RNA binding protein 2
  ENSP ID: ENSP00000428456
MLQINQMFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQRYHCPVPKIFYVQLTVGNNEFFGEGKTRQAARHNAAMKALQALQNEPIPERSPQNGESGKDVDDDKDANKSEISLVFEIALKRNMPVSFEVIKESGPPHMKSFVTRVSVGEFSAEGEGNSKKLSKKRAATTVLQELKKLPPLPVVEKPKLFFKKRPKTIVKAGPEYGQGMNPISRLAQIQQAKKEKEPDYVLLSERGMPRRREFVMQVKVGNEVATGTGPNKKIAKKNAAEAMLLQLGYKASTNLQDQLEKTGENKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQAALSALKQFSEQGLDPIDGAMNIEKGSLEKQAKHLREKADNNQAPPGSIAQDCKKSNSAV

SEQ ID NO: 84274 - protein, 291 aa, Homo sapiens
  Payload ID: 16768
  Gene Symbol: STAU2
  Gene Name: staufen double-stranded RNA binding protein 2
  ENSP ID: ENSP00000428476
MPVSFEVIKESGPPHMKSFVTRVSVGEFSAEGEGNSKKLSKKRAATTVLQELKKLPPLPVVEKPKLFFKKRPKTIVKAGPEYGQGMNPISRLAQIQQAKKEKEPDYVLLSERGMPRRREFVMQVKVGNEVATGTGPNKKIAKKNAAEAMLLQLGYKASTNLQDQLEKTGENKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQV

SEQ ID NO: 84275 - protein, 390 aa, Homo sapiens
  Payload ID: 16768
  Gene Symbol: STAU2
  Gene Name: staufen double-stranded RNA binding protein 2
  ENSP ID: ENSP00000428664
MVARPLHSTEGQPESLGKMFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQRYHCPVPKIFYVQLTVGNNEFFGEGKTRQAARHNAAMKALQALQNEPIPERSPQNGESGKDVDDDKDANKSEISLVFEIALKRNMPVSFEVIKESGPPHMKSFVTRVSVGEFSAEGEGNSKKLSKKRAATTVLQELKKLPPLPVVEKPKLFFKKRPKTIVKAGPEYGQGMNPISRLAQIQQAKKEKEPDYVLLSERGMPRRREFVMQVKVGNEVATGTGPNKKIAKKNAAEAMLLQLGYKASTNLQDQLEKTGENKGWSGPKPGFPEPTNNRKS

SEQ ID NO: 84276 - protein, 125 aa, Homo sapiens
  Payload ID: 16768
  Gene Symbol: STAU2
  Gene Name: staufen double-stranded RNA binding protein 2
  ENSP ID: ENSP00000428681
MFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQRWQHLNGLQGLWSQRSKEMSFPCQNPD

SEQ ID NO: 84277 - protein, 63 aa, Homo sapiens
  Payload ID: 16768
  Gene Symbol: STAU2
  Gene Name: staufen double-stranded RNA binding protein 2
  ENSP ID: ENSP00000428737
MLQINQMFSVQLSLGEQTWESEGSSIKKAQQAVANKALTESTLPKPVQKPPKSNVNNNPGSIT

SEQ ID NO: 84278 - protein, 398 aa, Homo sapiens
  Payload ID: 16768
  Gene Symbol: STAU2
  Gene Name: staufen double-stranded RNA binding protein 2
  ENSP ID: ENSP00000428741
MKALQALQNEPIPERSPQNGESGKDVDDDKDANKSEISLVFEIALKRNMPVSFEVIKESGPPHMKSFVTRVSVGEFSAEGEGNSKKLSKKRAATTVLQELKKLPPLPVVEKPKLFFKKRPKTIVKAGPEYGQGMNPISRLAQIQQAKKEKEPDYVLLSERGMPRRREFVMQVKVGNEVATGTGPNKKIAKKNAAEAMLLQLGYKASTNLQDQLEKTGENKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQAALSALKQFSEQGLDPIDGAMNIEKGSLEKQAKHLREKADNNQAPPGSIAQDCKKSNSAV

SEQ ID NO: 84279 - protein, 570 aa, Homo sapiens
  Payload ID: 16768
  Gene Symbol: STAU2
  Gene Name: staufen double-stranded RNA binding protein 2
  ENSP ID: ENSP00000428756
MANPKEKTAMCLVNELARFNRVQPQYKLLNERGPAHSKMFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQRYHCPVPKIFYVQLTVGNNEFFGEGKTRQAARHNAAMKALQALQNEPIPERSPQNGESGKDVDDDKDANKSEISLVFEIALKRNMPVSFEVIKESGPPHMKSFVTRVSVGEFSAEGEGNSKKLSKKRAATTVLQELKKLPPLPVVEKPKLFFKKRPKTIVKAGPEYGQGMNPISRLAQIQQAKKEKEPDYVLLSERGMPRRREFVMQVKVGNEVATGTGPNKKIAKKNAAEAMLLQLGYKASTNLQDQLEKTGENKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQAALSALKQFSEQGLDPIDGAMNIEKGSLEKQAKHLREKADNNQAPPGSIAQDCKKSNSAV

SEQ ID NO: 84280 - protein, 204 aa, Homo sapiens
  Payload ID: 16768
  Gene Symbol: STAU2
  Gene Name: staufen double-stranded RNA binding protein 2
  ENSP ID: ENSP00000428829
MLQINQMFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQRYHCPVPKIFYVQLTVGNNEFFGEGKTRQAARHNAAMKALQALQNEPIPERSPQNGESGKDVDDDKDANKSEISLVFEIALKRNMPVSFEVIKESGPPHM

SEQ ID NO: 84281 - protein, 320 aa, Homo sapiens
  Payload ID: 16768
  Gene Symbol: STAU2
  Gene Name: staufen double-stranded RNA binding protein 2
  ENSP ID: ENSP00000429005
MKALQALQNEPIPERSPQNGESGKDVDDDKDANKSEISLVFEIALKRNMPVSFEVIKESGPPHMKSFVTRVSVGEFSAEGEGNSKKLSKKRAATTVLQELKKLPPLPVVEKPKLFFKKRPKTIVKAGPEYGQGMNPISRLAQIQQAKKEKEPDYVLLSERGMPRRREFVMQVKVGNEVATGTGPNKKIAKKNAAEAMLLQLGYKASTNLQDQLEKTGENKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCS

SEQ ID NO: 84282 - protein, 504 aa, Homo sapiens
  Payload ID: 16768
  Gene Symbol: STAU2
  Gene Name: staufen double-stranded RNA binding protein 2
  ENSP ID: ENSP00000429173
MKRGEPAIYRPLDPKPFPNYRANYNFRGMYNQRYHCPVPKIFYVQLTVGNNEFFGEGKTRQAARHNAAMKALQALQNEPIPERSPQNGESGKDVDDDKDANKSEISLVFEIALKRNMPVSFEVIKESGPPHMKSFVTRVSVGEFSAEGEGNSKKLSKKRAATTVLQELKKLPPLPVVEKPKLFFKKRPKTIVKAGPEYGQGMNPISRLAQIQQAKKEKEPDYVLLSERGMPRRREFVMQVKVGNEVATGTGPNKKIAKKNAAEAMLLQLGYKASTNLQDQLEKTGENKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQVHYCDRQSGKECVTCLTLAPVQMTFHAIGSSIEASHDQAALSALKQFSEQGLDPIDGAMNIEKGSLEKQAKHLREKADNNQAPPGSIAQDCKKSNSAV

SEQ ID NO: 84283 - protein, 491 aa, Homo sapiens
  Payload ID: 16768
  Gene Symbol: STAU2
  Gene Name: staufen double-stranded RNA binding protein 2
  ENSP ID: ENSP00000429973
MVARPLHSTEGQPESLGKMFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQRYHCPVPKIFYVQLTVGNNEFFGEGKTRQAARHNAAMKALQALQNEPIPERSPQNGESGKDVDDDKDANKSEISLVFEIALKRNMPVSFEVIKESGPPHMKSFVTRVSVGEFSAEGEGNSKKLSKKRAATTVLQELKKLPPLPVVEKPKLFFKKRPKTIVKAGPEYGQGMNPISRLAQIQQAKKEKEPDYVLLSERGMPRRREFVMQVKVGNEVATGTGPNKKIAKKNAAEAMLLQLGYKASTNLQDQLEKTGENKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQV

SEQ ID NO: 84284 - protein, 162 aa, Homo sapiens
  Payload ID: 16768
  Gene Symbol: STAU2
  Gene Name: staufen double-stranded RNA binding protein 2
  ENSP ID: ENSP00000430511
TGENKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQVHYCDRQSGKECVTCLTLAPVQMTFHAIGSSIEASHDQV

SEQ ID NO: 84285 - protein, 105 aa, Homo sapiens
  Payload ID: 16768
  Gene Symbol: STAU2
  Gene Name: staufen double-stranded RNA binding protein 2
  Uniprot ID: Q9NUL3
  ENSP ID: ENSP00000430611
MLQINQMFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQR

SEQ ID NO: 84286 - protein, 511 aa, Homo sapiens
  Payload ID: 16768
  Gene Symbol: STAU2
  Gene Name: staufen double-stranded RNA binding protein 2
  ENSP ID: ENSP00000430907
MANPKEKTAMCLVNELARFNRVQPQYKLLNERGPAHSKMFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQRYHCPVPKIFYVQLTVGNNEFFGEGKTRQAARHNAAMKALQALQNEPIPERSPQNGESGKDVDDDKDANKSEISLVFEIALKRNMPVSFEVIKESGPPHMKSFVTRVSVGEFSAEGEGNSKKLSKKRAATTVLQELKKLPPLPVVEKPKLFFKKRPKTIVKAGPEYGQGMNPISRLAQIQQAKKEKEPDYVLLSERGMPRRREFVMQVKVGNEVATGTGPNKKIAKKNAAEAMLLQLGYKASTNLQDQLEKTGENKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQV

SEQ ID NO: 84287 - protein, 473 aa, Homo sapiens
  Payload ID: 16768
  Gene Symbol: STAU2
  Gene Name: staufen double-stranded RNA binding protein 2
  ENSP ID: ENSP00000431111
MFSVQLSLGEQTWESEGSSIKKAQQAVANKALTESTLPKPVQKPPKSNVNNNPGSITPTVELNGLAMKRGEPAIYRPLDPKPFPNYRANYNFRGMYNQRYHCPVPKIFYVQLTVGNNEFFGEGKTRQAARHNAAMKALQALQNEPIPERSPQNGESGKDVDDDKDANKSEISLVFEIALKRNMPVSFEVIKESGPPHMKSFVTRVSVGEFSAEGEGNSKKLSKKRAATTVLQELKKLPPLPVVEKPKLFFKKRPKTIVKAGPEYGQGMNPISRLAQIQQAKKEKEPDYVLLSERGMPRRREFVMQVKVGNEVATGTGPNKKIAKKNAAEAMLLQLGYKASTNLQDQLEKTGENKGWSGPKPGFPEPTNNTPKGILHLSPDVYQEMEASRHKVISGTTLGYLSPKDMNQPSSSFFSISPTSNSSATIARELLMNGTSSTAEAIGLKGSSPTPPCSPVQPSKQLEYLARIQGFQV

SEQ ID NO: 84288 - protein, 1204 aa, Homo sapiens
  Payload ID: 16769
  Gene Symbol: SLK
  Gene Name: STE20-like kinase
  Uniprot ID: Q9H2G2
  ENSP ID: ENSP00000336824
MSFFNFRKIFKLGSEKKKKQYEHVKRDLNPEDFWEIIGELGDGAFGKVYKAQNKETSVLAAAKVIDTKSEEELEDYMVEIDILASCDHPNIVKLLDAFYYENNLWILIEFCAGGAVDAVMLELERPLTESQIQVVCKQTLDALNYLHDNKIIHRDLKAGNILFTLDGDIKLADFGVSAKNTRTIQRRDSFIGTPYWMAPEVVMCETSKDRPYDYKADVWSLGITLIEMAEIEPPHHELNPMRVLLKIAKSEPPTLAQPSRWSSNFKDFLKKCLEKNVDARWTTSQLLQHPFVTVDSNKPIRELIAEAKAEVTEEVEDGKEEDEEEETENSLPIPASKRASSDLSIASSEEDKLSQNACILESVSEKTERSNSEDKLNSKILNEKPTTDEPEKAVEDINEHITDAQLEAMTELHDRTAVIKENEREKRPKLENLPDTEDQETVDINSVSEGKENNIMITLETNIEHNLKSEEEKDQEKQQMFENKLIKSEEIKDTILQTVDLVSQETGEKEANIQAVDSEVGLTKEDTQEKLGEDDKTQKDVISNTSDVIGTCEAADVAQKVDEDSAEDTQSNDGKEVVEVGQKLINKPMVGPEAGGTKEVPIKEIVEMNEIEEGKNKEQAINSSENIMDINEEPGTTEGEEITESSSTEEMEVRSVVADTDQKALGSEVQDASKVTTQIDKEKKEIPVSIKKEPEVTVVSQPTEPQPVLIPSININSDSGENKEEIGSLSKTETILPPESENPKENDNDSGTGSTADTSSIDLNLSISSFLSKTKDSGSISLQETRRQKKTLKKTRKFIVDGVEVSVTTSKIVTDSDSKTEELRFLRRQELRELRFLQKEEQRAQQQLNSKLQQQREQIFRRFEQEMMSKKRQYDQEIENLEKQQKQTIERLEQEHTNRLRDEAKRIKGEQEKELSKFQNMLKNRKKEEQEFVQKQQQELDGSLKKIIQQQKAELANIERECLNNKQQLMRAREAAIWELEERHLQEKHQLLKQQLKDQYFMQRHQLLKRHEKETEQMQRYNQRLIEELKNRQTQERARLPKIQRSEAKTRMAMFKKSLRINSTATPDQDRDKIKQFAAQEEKRQKNERMAQHQKHENQMRDLQLQCEANVRELHQLQNEKCHLLVEHETQKLKELDEEHSQELKEWREKLRPRKKTLEEEFARKLQEQEVFFKMTGESECLNPSTQSRISKFYPIPSLHSTGS

SEQ ID NO: 84289 - protein, 1235 aa, Homo sapiens
  Payload ID: 16769
  Gene Symbol: SLK
  Gene Name: STE20-like kinase
  Uniprot ID: Q9H2G2
  ENSP ID: ENSP00000358770
MSFFNFRKIFKLGSEKKKKQYEHVKRDLNPEDFWEIIGELGDGAFGKVYKAQNKETSVLAAAKVIDTKSEEELEDYMVEIDILASCDHPNIVKLLDAFYYENNLWILIEFCAGGAVDAVMLELERPLTESQIQVVCKQTLDALNYLHDNKIIHRDLKAGNILFTLDGDIKLADFGVSAKNTRTIQRRDSFIGTPYWMAPEVVMCETSKDRPYDYKADVWSLGITLIEMAEIEPPHHELNPMRVLLKIAKSEPPTLAQPSRWSSNFKDFLKKCLEKNVDARWTTSQLLQHPFVTVDSNKPIRELIAEAKAEVTEEVEDGKEEDEEEETENSLPIPASKRASSDLSIASSEEDKLSQNACILESVSEKTERSNSEDKLNSKILNEKPTTDEPEKAVEDINEHITDAQLEAMTELHDRTAVIKENEREKRPKLENLPDTEDQETVDINSVSEGKENNIMITLETNIEHNLKSEEEKDQEKQQMFENKLIKSEEIKDTILQTVDLVSQETGEKEANIQAVDSEVGLTKEDTQEKLGEDDKTQKDVISNTSDVIGTCEAADVAQKVDEDSAEDTQSNDGKEVVEVGQKLINKPMVGPEAGGTKEVPIKEIVEMNEIEEGKNKEQAINSSENIMDINEEPGTTEGEEITESSSTEEMEVRSVVADTDQKALGSEVQDASKVTTQIDKEKKEIPVSIKKEPEVTVVSQPTEPQPVLIPSININSDSGENKEEIGSLSKTETILPPESENPKENDNDSGTGSTADTSSIDLNLSISSFLSKTKDSGSISLQETRRQKKTLKKTRKFIVDGVEVSVTTSKIVTDSDSKTEELRFLRRQELRELRFLQKEEQRAQQQLNSKLQQQREQIFRRFEQEMMSKKRQYDQEIENLEKQQKQTIERLEQEHTNRLRDEAKRIKGEQEKELSKFQNMLKNRKKEVINEVEKAPKELRKELMKRRKEELAQSQHAQEQEFVQKQQQELDGSLKKIIQQQKAELANIERECLNNKQQLMRAREAAIWELEERHLQEKHQLLKQQLKDQYFMQRHQLLKRHEKETEQMQRYNQRLIEELKNRQTQERARLPKIQRSEAKTRMAMFKKSLRINSTATPDQDRDKIKQFAAQEEKRQKNERMAQHQKHENQMRDLQLQCEANVRELHQLQNEKCHLLVEHETQKLKELDEEHSQELKEWREKLRPRKKTLEEEFARKLQEQEVFFKMTGESECLNPSTQSRISKFYPIPSLHSTGS

SEQ ID NO: 84290 - protein, 234 aa, Homo sapiens
  Payload ID: 16770
  Gene Symbol: STRADA
  Gene Name: STE20-related kinase adaptor alpha
  ENSP ID: ENSP00000245865
MSSFLPEGGCYELLTVIGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRSVKASHILISVDGKVYLSGLRSNLSMISHGQRQRVVHDFPKYSVKVLPWLSPEVLQQGYDAKSDIYSVGITACELANGHVPFKDMPATQGEDSTVKGI
